United States Patent 12,569,549 (FLAVIVIRUS VACCINE) - sequence listing, part 52

SEQ ID NO: 18637 - RNA, 9879 nt, synthetic construct
  misc_feature 1..9879: note = derived and/or modified CDS sequence (opt5) from DENV-1__KJ189318__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaaaccgctgaagtcagctgggagcaagaagccgagcattccggcacgtctcacaacatcctggtggaagttcaggacgatgggaccatgaagattaaagacgaggagcgcgatgacacacttaccatcctgctcaaggccacactgctcgctgtgagcggagtctaccccatgtccatccctgcgaccctgtttgtgtggtatttctggcagaaaaagaagcagagatctggcgttctttgggatacacccagcccgcctgaagtggagcgggccgtcctggacgatggcatttaccgcatcctgcaaagagggctcctgggacggtcccaggtgggcgtcggggtgttccaggacggagtttttcatacgatgtggcacgtgacccgcggcgctgtccttatgtatcaggggaaaagactggaaccctcttgggccagcgtgaagaaagacctcatttcctacggaggcggctggcggttccaagggagctggaatacaggagaggaggttcaggtgatcgccgtcgaacctggcaagaaccccaaaaatgtgcagaccaccccggggacatttaagacgcctgagggagaagtgggcgctattgccctggatttcaagcccgggacctctggatcccctatcgttaacagagagggcaaaattgtcggcctctacgggaatggagtggtgacaaccagcggcacatatgtctctgcgatcgctcaagccaaggcctcccaggaagggcccctgcccgagatcgaggacgaagtgtttaaaaagcgcaaccttaccattatggatctgcaccctggaagcggcaaaacgcggagatacctgccggctatcgttcgcgaggccattaagcggaagctcagaacactgatccttgcgcccacccgcgtggtcgcttccgaaatggccgaggccctgaaagggatgcctattcggtatcagaccacagctgtgaagtctgaacataccggcagagagatcgttgacctcatgtgccacgccacattcaccatgcgcctgctgagccccgtgcgggtccctaattacaacatgatcattatggatgaggctcattttacggaccccgcctccatcgcggccagaggatatattagcacacgggtgggcatgggggaagctgccgctatcttcatgaccgccacacctccgggatctgttgaggcctttccccagtccaatgctgtgattcaagatgaagagcgcgacatccctgaaagaagctggaactctggctacgattggatcaccgacttccccgggaaaacggtctggtttgtgcctagcattaagtccggaaatgatatcgcgaactgtctccggaaaaacggcaagcgcgtgattcagctttctagaaagaccttcgacacagagtatcagaaaaccaagaataacgactgggattacgtcgttacaaccgacatcagcgagatgggggccaatttccgggctgatagagtgattgacccccgccggtgcctgaaaccggtgatcctgaaggatggccctgaaagagtcattctcgccggacccatgcccgtgacagttgcctccgctgcccagcgccggggcagaatcgggcgcaaccaaaataaagagggagaccagtacgtgtatatgggccagcctctgaacaatgatgaagaccacgcgcattggaccgaggctaagatgcttctggataacatcaatacgcccgaggggattatccctgccctctttgaaccggagcgggaaaagtctgccgctattgacggagagtacagactgcgcggcgaagccagaaaaacattcgtcgagctgatgcggcgcggggatctccccgtgtggcttagctataaggttgcgtccgagggctttcagtacagcgacagacggtggtgcttcgatggagaacgcaacaatcaagtgctggaggaaaacatggacgtcgagatctggaccaaagaaggcgagagaaagaaactgcggcctagatggctcgacgcccgcacctattctgatcccctggctcttcgggagtttaaggaattcgccgctgggagacgctccgtgagcggagacctgattctcgagatcggcaaactgcctcagcacctgacactccgggcccagaatgctcttgataacctggtcatgctgcacaattccgaacaggggggaaaggcctacagacatgcgatggaggaactccccgacaccatcgagacactgatgcttctggccctcattgctgtgctgacgggcggcgttaccctgtttttcctctctgggaagggacttggcaaaacaagcatcgggctgctgtgtgtgaccgcctcctctgctctcctgtggatggccagcgtggagccgcactggattgccgcttccatcattcttgaatttttcctgatggtcctcctgatccctgagcccgatcggcaacgcacacctcaggacaaccagctggcgtatgttgtgatcggactcctttttatgattctgaccgtggccgctaacgaaatgggcctgctcgagacgaccaagaaagatctggggatcggacatgtcgccgccgagaatcaccaacacgctacaatgcttgacgtggatctgagacccgccagcgcgtggaccctctacgccgttgctacaaccgtgattacgcctatgatgcggcatacaatcgaaaacaccacagccaatatttctctgaccgctatcgccaaccaggcggccattctgatgggcctcgacaagggctggcccatctccaaaatggatatcggggtcccgcttctggctctgggatgctacagccaggtgaatcctctcaccctgacagccgctgtccttatgctggtggcccactatgctattatcggccccgggctccaggccaaggcgacgcgcgaggcccaaaagagaaccgctgccggaattatgaaaaaccccacagttgacggcatcgtggctattgatctggaccctgtcgtgtacgacgccaagttcgaaaaacagctggggcagatcatgctccttatcctgtgtacctctcagattctgctcatgcggacaacctgggccctgtgcgagtccatcacgcttgcgacaggaccgctgaccaccctctgggaaggcagccccggcaagttttggaatacaaccattgctgtttctatggccaacatcttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacacctacaagagaagcgggattatggaggtggatcggtccgaagccaaagagggactgaagagaggcgaaacaaccaaacatgcggtctctcgcgggacagccaagcttcggtggttcgtggagagaaatctggtgaagcctgagggaaaagttatcgacctcggctgtgggcgcggaggctggagctattactgcgctggcctgaagaaagtcaccgaagtgaaggggtatacgaaaggaggccccgggcacgaggaacctatccccatggccacctacggatggaacctggtgaagctccattccggcaaagatgtctttttcatgcctccggagaagtgtgacacacttctgtgcgatattggggaatctagccccaatcctaccatcgaggagggacggacactgagagttctcaagatggtggaaccctggctgcgcggcaaccagttttgtattaaaatccttaatccttacatgccctccgtggtcgagaccctggaacaaatgcagcggaagcacggcgggatgctcgtgagaaacccgctgtctcgcaatagcacacacgagatgtattgggtttcctgcggaaccggcaacattgtgagcgctgtcaacatgacgtctcggatgctgctcaatagattcacaatggcccatcgcaaacctacctttgagcgggacgtggatctgggggcgggaaccagacacgttgccgtggaacccgaggtcgctaaccttgacatcattggccagcgcatcgaaaatatcaagaacgagcataaatccacatggcactacgatgaagacaatccctataagacgtgggcctaccacgggagctatgaggtgaagccttctggatccgctagctctatggtgaacggcgtcgttagactgctcaccaaaccctgggatgtgattcctatggtgacacaaatcgccatgaccgacacaaccccgttcggccagcagcgggtctttaaggagaaagtggacacacgcacccccagagctaagcgggggacgacccagattatggaagttacagccaaatggctgtggggattcctttccagaaataagaagcctcggatctgtacccgcgaggaatttacaagaaaagtgcggagcaacgcggccattggcgctgtcttcgtggatgagaatcaatggaactccgccaaggaagctgttgaggacgagcgcttttgggatctggtgcatagagaacgggagctccacaaacaggggaagtgcgccacctgcgtctacaatatgatgggaaaacgcgaaaagaagctgggcgagttcgggaaagccaagggcagcagagcgatctggtatatgtggctgggagctcggttcctcgaatttgaggccctgggcttcatgaacgaggaccattggttttctcgcgaaaatagcctttccggggtggagggagaaggcctgcacaaactcgggtacatcctgagagatatttctaagatccccggaggcaacatgtacgccgacgatacggctgggtgggacacacggattaccgaggatgaccttcagaatgaggccaaaatcacagatattatggaacctgagcatgctctgctcgccaccagcatcttcaagctgacgtatcagaacaaagttgtgcgcgtccaaagacccgcgaagaacggcaccgtgatggacgtcatctcccggcgcgatcagagaggatctggccaggtggggacatacggactgaatacctttacaaacatggaagttcagctcattcggcaaatggagagcgaaggcatcttcctgccgtccgagcttgagacccctaatctggccgaaagagtgctcgactggctggagaagcacggggctgaacgccttaaacggatggccatttctggagacgattgtgtcgtgaagcccatcgacgatagatttgctacagccctgaccgcgctcaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctggtgggacgcgcccgggttagccagggcgctgggtggtctctcagagagacggcctgcctgggaaagtcctatgctcaaatgtggcagcttatgtacttccatcgccgggatctgagactcgccgctaatgccatttgtagcgcggtgccggtcgactgggtgcctacatctcgcaccacctggtccatccacgcccaccatcagtggatgacaaccgaagatatgctgagcgtctggaaccgggtgtggattgaggaaaatccctggatggaggacaaaacacacgtttcctcttgggaagaggtgccctatcttggcaagagagaggaccagtggtgcgggagcctgatcggactcacggctcgggccacctgggccacaaacattcaagtcgctatcaatcaggtgagacgcctgattggcaacgaaaattacctggattatatgacctccatgaaacggtttaagaacgagagcgaccctgaaggggccctctggtga

SEQ ID NO: 18638 - RNA, 9879 nt, synthetic construct
  misc_feature 1..9879: note = derived and/or modified CDS sequence (opt5) from DENV-1__KJ189319__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtctctcggatgcaagcccctgaccatgtttcttatcacagaaaataagatttggggccggaaatcctggcctctgaacgagggcatcatggccattgggatcgttagcatcctcctgtcttccctcctgaagaatgacgtgccccttgcgggacctctgattgccggcgggatgctgatcgcttgttatgtgattagcggatccagcgccgatctctctctggagaaagctgccgaagtcagctgggagcaagaagccgagcattccggcacctctcacaacatccttgtggaagttcaggacgatgggacgatgaagattaaagacgaggagcgcgatgacaccctgacaatcctcctgaaggctaccctcctggcggtgagcggagtctaccccatgtccatccctgccacacttttcgtgtggtatttttggcagaaaaagaagcagagatctggcgttctgtgggatacccccagcccgcctgaagtggagcgggctgtcctggacgatggcatttaccgcatcctccaaagagggctgcttggacggtcccaggtgggcgtcggggtgttccaggacggagttttccatacaatgtggcacgtgacgcgcggcgccgtcctgatgtatcaggggaaaagactcgaaccctcttgggccagcgtgaagaaagacctgatttcctacggaggcggctggcggtttcaagggagctggaataccggagaggaggttcaggtgatcgctgtcgaacctggcaagaaccccaaaaatgtgcagacaaccccggggaccttcaagacacctgagggagaagtgggcgccattgcgctcgattttaagcccgggacgtctggatcccctatcgttaacagagagggcaaaattgtcggcctgtacgggaatggagtggtgaccacaagcggcacctatgtctctgctatcgcccaagccaaggcttcccaggaagggccccttcccgagatcgaggacgaagtgttcaaaaagcgcaacctgacaattatggatctgcaccctggaagcggcaaaacccggagatacctcccggccatcgttcgcgaggcgattaagcggaagctgagaacgcttatcctggctcccacacgcgtggtcgcctccgaaatggccgaggctctcaaagggatgcctattcggtatcagaccaccgccgtgaagtctgaacatacaggcagagagatcgttgacctgatgtgccacgctacctttacaatgcgcctgctcagccccgtgcgggtccctaattacaacatgatcattatggatgaggcccatttcaccgaccccgcgtccatcgccgctagaggatatattagcacgcgggtgggcatgggggaagccgctgccatctttatgacagccacccctccgggatctgttgaggctttcccccagtccaatgcggtgattcaagatgaagagcgcgacatccctgaaagaagctggaactctggctacgattggatcacagactttcccgggaaaaccgtctggttcgtgcctagcattaagtccggaaatgatatcgccaactgtcttcggaaaaacggcaagcgcgtgattcagctgtctagaaagacgtttgacaccgagtatcagaaaacaaagaataacgactgggattacgtcgttaccacagacatcagcgagatgggggctaatttccgggccgatagagtgattgacccccgccggtgcctgaaaccggtgatcctcaaggatggccctgaaagagtcattctggccggacccatgcccgtgaccgttgcttccgccgcgcagcgccggggcagaatcgggcgcaaccaaaataaagagggagaccagtacgtgtatatgggccagcctcttaacaatgatgaagaccacgctcattggacagaggccaagatgctgctcgataacatcaatacccccgaggggattatccctgccctgttcgaaccggagcgggaaaagtctgctgccattgacggagagtacagactgcgcggcgaagcgagaaaaacgtttgtcgagctcatgcggcgcggggatcttcccgtgtggctgagctataaggttgcctccgagggcttccagtacagcgacagacggtggtgctttgatggagaacgcaacaatcaagtgctggaggaaaacatggacgtcgagatctggacaaaagaaggcgagagaaagaaactccggcctagatggctggacgctcgcacctattctgatccccttgccctgcgggagttcaaggaatttgctgccgggagacgctccgtgagcggagacctcattctggagatcggcaaactgcctcagcacctcacccttcgggctcagaatgccctggataacctggtcatgctccacaattccgaacaggggggaaaggcgtacagacatgccatggaggaactgcccgacacaatcgagacccttatgctgctcgctctgattgccgtgctgacaggcggcgttacgctcttctttctttctgggaagggactgggcaaaaccagcatcgggctgctctgtgtgacagcttcctctgccctgctttggatggccagcgtggagccgcactggattgctgcgtccatcattctggaattctttctcatggtcctgctgatccctgagcccgatcggcaacgcacccctcaggacaaccagctcgcctatgttgtgatcggacttctgttcatgattctgacagtggctgccaacgaaatgggcctcctggagaccacgaagaaagatcttgggatcggacatgtcgccgctgagaatcaccaacacgccaccatgctggacgtggatctcagacccgcgagcgcctggacactgtacgctgttgccaccacagtgattacccctatgatgcggcatacgatcgaaaacacaaccgctaatatttctctgacagccatcgcgaaccaggccgctattctcatgggccttgacaagggctggcccatctccaaaatggatatcggggtcccgctgctggccctcggatgctacagccaggtgaatcctctgacccttaccgctgccgtcctgatgctcgtggctcactatgccattatcggccccgggctgcaggcgaaggccacacgcgaggctcaaaagagaacggccgctggaattatgaaaaaccccaccgttgacggcatcgtggccattgatctggaccctgtcgtgtacgacgccaagtttgaaaaacagctcgggcagatcatgcttctgatcctgtgtacatctcagattctcctgatgcggaccacatgggcgctttgcgagtccatcaccctggctacgggaccgctcacaaccctgtgggaaggcagccccggcaagttctggaataccacaattgccgtttctatggctaacatctttcgcgggagctatctggccggagccggcctcgctttctcccttatgaaatctctggggggaggcagacgggggaccggagcccaaggcgagacactgggcgagaagtggaagcgccagctcaatcagctgagcaaatccgaattcaacacgtacaagagaagcgggattatggaggtggatcggtccgaagcgaaagagggacttaagagaggcgaaaccacaaaacatgccgtctctcgcgggaccgctaagctgcggtggtttgtggagagaaatctcgtgaagcctgagggaaaagttatcgacctgggctgtgggcgcggaggctggagctattactgcgccggcctgaagaaagtcacagaagtgaaggggtataccaaaggaggccccgggcacgaggaacctatccccatggctacgtacggatggaacctcgtgaagcttcattccggcaaagatgtcttctttatgcctccggagaagtgtgacaccctgctgtgcgatattggggaatctagccccaatcctacaatcgaggagggacggaccctcagagttctgaagatggtggaaccctggcttcgcggcaaccagttctgtattaaaatcctgaatccttacatgccctccgtggtcgagacactcgaacaaatgcagcggaagcacggcgggatgctggtgagaaacccgctgtctcgcaatagcacccacgagatgtattgggtttcctgcggaacaggcaacattgtgagcgccgtcaacatgacctctcggatgctcctgaatagatttacgatggcgcatcgcaaacctacattcgagcgggacgtggatcttggggccggaaccagacacgttgctgtggaacccgaggtcgccaacctggacatcattggccagcgcatcgaaaatatcaagaacgagcataaatccacctggcactacgatgaagacaatccctataagacatgggcttaccacgggagctatgaggtgaagccttctggatccgccagctctatggtgaacggcgtcgttagactcctgacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctttggggatttctgtccagaaataagaagcctcggatctgtacacgcgaggaattcaccagaaaagtgcggagcaacgccgctattggcgccgtctttgtggatgagaatcaatggaactccgctaaggaagccgttgaggacgagcgcttctgggatctcgtgcatagagaacgggagctgcacaaacaggggaagtgcgccacatgcgtctacaatatgatgggaaaacgcgaaaagaagctgggcgagtttgggaaagcgaagggcagcagagctatctggtatatgtggctcggagcccggttcctggaattcgaggcccttggctttatgaacgaggaccattggttctctcgcgaaaatagcctgtccggggtggagggagaaggcctccacaaactggggtacatccttagagatatttctaagatccccggaggcaacatgtacgctgacgataccgccgggtgggacacgcggattacagaggatgacctgcagaatgaggctaaaatcaccgatattatggaacctgagcatgccctcctggcgacaagcatctttaagctgacctatcagaacaaagttgtgcgcgtccaaagacccgccaagaacggcacggtgatggacgtcatctcccggcgcgatcagagaggatctggccaggtggggacctacggactcaatacattcaccaacatggaagttcagctgattcggcaaatggagagcgaaggcatctttcttccgtccgagctggagacacctaatctcgctgaaagagtgctggactggcttgagaagcacggggccgaacgcctgaaacggatggctatttctggagacgattgtgtcgtgaagcccatcgacgatagattcgccaccgcgctcacagccctgaacgacatgggcaaagtgcgcaaggatattcctcagtgggagcccagcaaagggtggaatgactggcagcaggttcctttttgctcccaccatttccaccaactgatcatgaaggatggccgggaaatcgtggtcccctgtagaaaccaggacgagctcgtgggacgcgctcgggttagccagggcgccgggtggtctctgagagagaccgcttgccttggaaagtcctatgcccaaatgtggcagctgatgtactttcatcgccgggatctcagactggctgccaatgcgatttgtagcgccgtgccggtcgactgggtgcctacgtctcgcacaacctggtccatccacgctcaccatcagtggatgaccacagaagatatgcttagcgtctggaaccgggtgtggattgaggaaaatccctggatggaggacaaaacccacgtttcctcttgggaagaggtgccctatctgggcaagagagaggaccagtggtgcgggagcctcatcggactgacagcccgggccacgtgggctaccaacattcaagtcgccatcaatcaggtgagacgcctgattggcaacgaaaattacctcgattatatgacatccatgaaacggttcaagaacgagagcgaccctgaaggggcgctgtggtga

SEQ ID NO: 18639 - RNA, 9879 nt, synthetic construct
  misc_feature 1..9879: note = derived and/or modified CDS sequence (opt5) from DENV-1__KJ189320__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattaccgaggtggatcggtccgaagcgaaagagggactgaagagaggcgaaacaaccaaacatgccgtctctcgcgggacagctaagcttcggtggttcgtggagagaaatctggtgaagcctgagggaaaagttatcgacctcggctgtgggcgcggaggctggagctattactgcgccggcctgaagaaagtcaccgaagtgaaggggtatacgaaaggaggccccgggcacgaggaacctatccccatggctacctacggatggaacctggtgaagctccattccggcaaagatgtctttttcatgcctccggagaagtgtgacacacttctgtgcgatattggggaatctagccccaatcctaccatcgaggagggacggacactgagagttctcaagatggtggaaccctggctgcgcggcaaccagttttgtattaaaatccttaatccttacatgccctccgtggtcgagaccctggaacaaatgcagcggaagcacggcgggatgctcgtgagaaacccgctgtctcgcaatagcacacacgagatgtattgggtttcctgcggaaccggcaacattgtgagcgccgtcaacatgacgtctcggatgctgctcaatagattcacaatggcgcatcgcaaacctacctttgagcgggacgtggatctgggggccggaaccagacacgttgctgtggaacccgaggtcgccaaccttgacatcattggccagcgcatcgaaaatatcaagaacgagcataaatccacatggcactacgatgaagacaatccctataagacgtgggcttaccacgggagctatgaggtgaagccttctggatccgccagctctatggtgaacggcgtcgttagactgctcaccaaaccctgggatgtgattcctatggtgacacaaatcgctatgaccgacacaaccccgttcggccagcagcgggtctttaaggagaaagtggacacacgcacccccagagccaagcgggggacgacccagattatggaagttacagcgaaatggctgtggggattcctttccagaaataagaagcctcggatctgtacccgcgaggaatttacaagaaaagtgcggagcaacgccgctattggcgccgtcttcgtggatgagaatcaatggaactccgctaaggaagccgttgaggacgagcgcttttgggatctggtgcatagagaacgggagctccacaaacaggggaagtgcgccacctgcgtctacaatatgatgggaaaacgcgaaaagaagctgggcgagttcgggaaagcgaagggcagcagagctatctggtatatgtggctgggagcccggttcctcgaatttgaggccctgggcttcatgaacgaggaccattggttttctcgcgaaaatagcctttccggggtggagggagaaggcctgcacaaactcgggtacatcctgagagatatttctaagatccccggaggcaacatgtacgctgacgatacggccgggtgggacacacggattaccgaggatgaccttcagaatgaggctaaaatcacagatattatggaacctgagcatgccctgctcgcgaccagcatcttcaagctgacgtatcagaacaaagttgtgcgcgtccaaagacccgccaagaacggcaccgtgatggacgtcatctcccggcgcgatcagagaggatctggccaggtggggacatacggactgaatacctttacaaacatggaagttcagctcattcggcaaatggagagcgaaggcatcttcctgccgtccgagcttgagacccctaatctggctgaaagagtgctcgactggctggagaagcacggggccgaacgccttaaacggatggctatttctggagacgattgtgtcgtgaagcccatcgacgatagatttgccacagcgctgaccgccctcaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctggtgggacgcgctcgggttagccagggcgccgggtggtctctcagagagacggcttgcctgggaaagtcctatgcccaaatgtggcagcttatgtacttccatcgccgggatctgagactcgctgccaatgcgatttgtagcgccgtgccggtcgactgggtgcctacatctcgcaccacctggtccatccacgctcaccatcagtggatgacaaccgaagatatgctgagcgtctggaaccgggtgtggattgaggaaaatccctggatggaggacaaaacacacgtttcctcttgggaagaggtgccctatcttggcaagagagaggaccagtggtgcgggagcctgatcggactcacggcccgggccacctgggctacaaacattcaagtcgccatcaatcaggtgagacgcctgattggcaacgaaaattacctggattatatgacctccatgaaacggtttaagaacgagagcgaccctgaaggggcgctctggtga

SEQ ID NO: 18640 - RNA, 9879 nt, synthetic construct
  misc_feature 1..9879: note = derived and/or modified CDS sequence (opt5) from DENV-1__KJ189323__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcccgttcaaactggagaaggaagtggccgagacccagcacggaaccgtccttgtgcaagttaagtacgagggcacagatgcgccttgcaaaatccccttcagcacccaggacgaaaagggggtgacacagaacggaagactcatcacggctaatcctattgtcaccgataaagagaagcccgtgaacatcgaaacagagcccccttttggcgagtcttatattgtggttggggccggagaaaaagccctgaagctgtcctggttcaagaaaggcagctctatcgggaagatgtttgaggctaccgcccggggcgctagacgcatggccattctcggagacacagcgtgggatttcggcagcatcgggggagtctttacctccgtgggcaaactggtgcatcaggtcttcgggacggcctacggagtgcttttttctggcgttagctggaccatgaagatcgggattggcatcctgctcacatggctgggactgaattcccggagcacctctctttccatgacatgtattgctgtgggcatggtcaccctctacctgggggtgatggttcaagccgacagcggatgcgtgatcaactggaaaggcagagaactgaagtgtgggtctggaattttcgtcacaaacgaggtgcacacctggacggaacagtataagtttcaggctgattccccgaaacgcctcagcgccgcgatcggcaaggcctgggaggagggggtttgcggcattcggtccgctacaagactggaaaatatcatgtggaaacagatctctaacgagcttaatcatattctgctcgaaaacgacatgaagttcaccgtggtcgtgggagacgccaatggcatcctggctcaagggaaaaagatgattcgcccccagcctatggagcacaaatacagctggaagtcctggggaaaggccaaaatcattggcgccgatatccagaacaccacatttatcattgacgggcccgatacccctgaatgtcccgacaatcagcgggcttggaacatctgggaggtggaggattatggattcggcatttttacgacaaatatctggctgaagcttagagactcttacacccaaatgtgcgatcaccgcctcatgagcgcggccattaaagactccaaggctgtccatgccgatatgggctattggatcgaaagcgagaaaaacgaaacatggaagctggcccgggcttctttcatcgaggttaagacctgtacatggccgaaatcccacaccctgtggagcaatggggtgctcgaatctgagatgattatccctaagatttacggaggccccatctcccagcataactatagacctgggtacttcacgcagaccgccggaccctggcacctgggcaaacttgagctggactttgatctctgcgaagggacaaccgtggtcgtggacgagcactgcggaaatcgcggccctagcctgcggacaaccacggttacaggcaagattatccatgaatggtgttgcagatcttgtaccctgcccccgcttcggttccgcggggaggatggatgctggtacggcatggagatcagacctgtgaaagaaaaggaggaaaacctcgtccggagcatggtgtccgcggggagcggagaggttgactctttttccctgggcattctgtgtgtgagcatcatgattgaagaggtcatgagatcccgctggtctcggaagatgctcatgacagggaccctggctgtgttccttctgctcgttatgggacaactgacctggaatgacctgatcagactttgcattatggtgggcgccaacgccagcgatcgcatgggcatggggacaacgtatctggctctcatggccacctttaaaatgagacccatgttcgcggtcggactgctctttcggcgcctgacatccagagaggtgcttctgctcaccatcggcctgtctctggtggctagcgtcgaacttcccaactccctggaggaactcggggacggactggccatgggcattatgatgctcaagctgcttacagagttccagcctcaccagctgtggaccacgctcctgtctctgacatttatcaaaaccacccttagcctggattacgcctggaagacaaccgctatggccctctccatcgttagcctgttcccgctctgtctgtctacaacgtcccagaaaaccacatggcttcccgtgctgctggggagctttggatgcaagcctctcaccatgttcctgattacagaaaataagatctggggccggaaatcttggccccttaacgagggcattatggctatcgggattgtgtccatcctgctcagctctctgctcaagaatgacgtccctctggccggaccccttatcgcgggcgggatgctgattgcctgttatgtgatctccggaagctccgctgatctgagcctcgagaaagccgctgaagtttcttgggagcaagaagccgagcatagcggcacctcccacaacattctggtggaagtccaggacgatgggacgatgaagatcaaagacgaggagcgcgatgacacccttacaattctgctcaaggccaccctgctcgctgtgtctggagtttaccctatgagcatccccgcgacactgtttgtgtggtatttctggcagaaaaagaagcagagatccggcgtcctttgggataccccgtctcctcccgaagtggagcgggccgtcctggacgatggcatctaccgcattctgcaaagagggctcctgggacggagccaggtgggcgttggggtgttccagggaggcgtctttcatacaatgtggcacgtgacgcgcggggctgttcttatgtatcagggaaaaagactggaaccttcctgggcctctgtgaagaaagacctcatcagctacggcggcgggtggcggttccaaggatcctggaataccggcgaggaggtccaggtgattgccgtggaacccgggaagaacccgaaaaatgttcagacaacccctggaacctttaagacacccgagggcgaagtcggggctatcgccctggacttcaagcctggaacgagcggctctcccattgtgaacagagagggcaaaatcgtggggctctacggaaatggcgtcgtgaccacatccgggacctatgttagcgcgattgctcaagccaaggcctctcaggaaggacccctgcctgagatcgaggatgaagtgtttaaaaagcgcaaccttacaatcatggacctgcacccgggctccgggaaaacccggagatacctgcccgctattgtccgcgaggccatcaagcggaagctcagaacgctgattcttgcgcctacacgcgtggttgctagcgaaatggccgaggccctgaaaggcatgcccatccggtatcagaccaccgctgtgaagtccgaacatacaggaagagagattgtcgatctcatgtgccacgccaccttcacaatgcgcctgctgtctcctgtgcgggttcccaattacaacatgatcatcatggacgaggctcattttaccgatcctgccagcattgcggccagaggctatatctccacgcgggtggggatgggagaagctgccgctattttcatgacagccaccccgcccggcagcgtcgaggcctttcctcagtctaatgctgtgatccaagacgaagagcgcgatattcccgaaagatcctggaacagcgggtacgactggatcacagatttccctggaaaaaccgtgtggtttgtcccctctatcaagagcggcaatgacattgcgaactgtctccggaaaaacgggaagcgcgttatccagctttccagaaagacgttcgataccgagtatcagaaaacaaagaataacgactgggactacgtggtgaccacagatatttctgagatgggcgccaatttccgggctgacagagtcatcgatccgcgccggtgcctgaaacctgtgattctgaaggacggacccgaaagagttatcctcgccggccccatgcctgtgaccgtcgccagcgctgcccagcgccgggggagaattggacgcaaccaaaataaagagggcgatcagtacgtgtatatggggcagcccctgaacaatgacgaagatcacgcgcattggacagaggctaagatgcttctggacaacatcaatacccctgagggaatcattccggccctctttgaacccgagcgggaaaagtccgccgctatcgatggcgagtacagactgcgcggggaagccagaaaaacgttcgttgagctgatgcggcgcggcgacctccctgtgtggctttcttataaggtcgcgagcgagggatttcagtactccgatagacggtggtgcttcgacggcgaacgcaacaatcaagtgctggaggaaaacatggatgtcgagatttggacaaaagaaggggagagaaagaaactgcggcccagatggctcgacgcccgcacctatagcgaccctctggctcttcgggagtttaaggaattcgccgctggaagacgctctgtgtccggcgatctgatcctcgagattgggaaactgccccagcacctgaccctccgggcccagaatgctcttgacaacctggttatgctgcacaatagcgaacagggaggcaaggcctacagacatgcgatggaggaactcccggatacaatcgagaccctgatgcttctggccctcatcgctgtgctgacaggcggggtgacgctgtttttcctctccggaaagggccttgggaaaacctctattggactgctgtgtgtcacagccagctccgctctcctgtggatggcctctgttgagcctcactggatcgccgctagcattatccttgaatttttcctgatggtgctcctgattcccgagcctgaccggcaacgcaccccccaggataaccagctggcgtatgtggtcatcggcctcctttttatgatcctgacagtggccgctaacgaaatggggctgctcgagaccacgaagaaagacctgggaattggccatgttgccgccgagaatcaccaacacgctaccatgcttgatgtggacctgagacctgcctccgcgtggacactctacgccgtcgctaccacagtgatcacccccatgatgcggcatacgattgaaaacacaaccgccaatatcagcctgacagctattgccaaccaggcggccatcctgatgggcctcgataaggggtggccgatttctaaaatggacatcggagtccctcttctggctctgggctgctactcccaggtgaatcccctcaccctgaccgccgctgttcttatgctggtggcccactatgctatcattgggcccggactccaggccaaggcgacacgcgaggcccaaaagagaacggctgccggcatcatgaaaaaccctaccgtcgatgggattgtggctatcgacctggatccggttgtgtacgacgccaagttcgaaaaacagctgggacagattatgctccttatcctgtgtacaagccagatcctgctcatgcggaccacatgggccctgtgcgagtctattacccttgcgacgggccccctgacaaccctctgggaaggctcccctgggaagttttggaataccacaatcgctgtcagcatggccaacattttccgcggatcttatctggctggcgccgggctggccttcagcctcatgaaatcccttggaggcgggagacggggaaccggcgctcaaggcgagacactgggggagaagtggaagcgccagctgaatcagctctctaaaagcgaatttaacacgtacaagagatccggaatcatggaggtggaccggagcgaagccaaagagggcctgaagagaggggaaaccacaaaacatgcggtgtcccgcggaaccgccaagcttcggtggttcgttgagagaaatctggtcaagcccgagggcaaagtgattgatctcgggtgtggacgcggcggctggtcttattactgcgctgggctgaagaaagtgacagaagtcaagggatataccaaaggcgggcctggacacgaggaacccatccctatggccacgtacggctggaacctggttaagctccatagcgggaaagacgtgtttttcatgccgcccgagaagtgtgatacccttctgtgcgacatcggagaatcctctcctaatcccacaattgaggagggccggaccctgagagtgctcaagatggtcgaaccttggctgcgcggcaaccagttttgtatcaaaattcttaatccctacatgccgagcgtggttgagacactggaacaaatgcagcggaagcacgggggaatgctcgtgagaaaccctctgtcccgcaattctacccacgagatgtattgggtcagctgcggcacagggaacatcgtgtccgctgttaacatgaccagccggatgctgctcaatagattcacgatggcccatcgcaaacccacatacgagcgggatgtggacctgggagcgggcaccagacacgtcgccgtggaacccgaggtggctaaccttgatattatcgggcagcgcattgaaaatatcaagaacgagcataaatctacctggcactatgacgaagataatccttacaagacatgggcctatcacggatcctacgaggtcagacccagcggctctgcttccagcatggttaacggcgtggtgcggctgctcacgaagccttgggacgtcatcccgatggtgacccaaattgccatgacagataccacaccctttgggcagcagcgcgttttcaaagagaaggtggacaccagaacacctcgggctaaaagaggaaccacgcagatcatggaagtcaccgccaagtggctgtggggctttctttctcggaataaaaagccccgcatttgtacaagagaggaattcacccggaaggtgcgctccaacgcggccatcggggctgtttttgtggacgagaatcaatggaacagcgccaaagaagctgtcgaggatgagagattctgggacctggtgcatcgggaacgcgagctccacaagcagggaaaatgcgccacatgcgtttataatatgatgggcaagagagaaaaaaagctgggggagtttggcaaggccaaaggatcccgggcgatttggtacatgtggctgggcgctcgcttcctcgaattcgaggccctggggtttatgaacgaggatcattggttcagcagagaaaattctcttagcggagtggagggcgaagggctgcacaagctcggatacatcctgcgggacatctccaaaattcctggcgggaacatgtatgccgatgacaccgctggctgggatacgcgcatcacagaggacgatcttcagaatgaggccaagattaccgaaatcatggagcccgaacatgctctgctcgccacatctatttttaaactgacctaccagaacaaggtcgtgagagtccaacggccggcgaaaaacggaacggtgatggacgttatcagccgcagagatcagcggggctccgggcaggtgggaacctatggcctgaatacattcaccaacatggaggtccagctcatcagacaaatggaatctgaggggatttttctgcctagcgagcttgaaacacccaatctggccgagcgcgtgctcgactggctggaaaagcacggagctgagcggcttaagagaatggccatctccggcgatgactgtgtggttaaacctattgacgatcgcttcgctaccgccctgacagcgctcaacgacatggggaaggtgcggaaagatatcccccagtgggaaccttctaagggctggaatgactggcagcaggtccccttttgcagccaccatttccaccaactgattatgaaagatggaagagagatcgtggttccgtgtcgcaaccaggacgagctggtgggccgggccagagtctcccagggggctggatggagcctccgcgaaaccgcctgcctgggcaagtcttacgctcaaatgtggcagcttatgtattttcatcggagagatctgcgcctcgccgctaatgccatctgttccgcggtgcctgtcgactgggtgcccacgagccggacaacctggtctattcacgcccaccatcagtggatgaccacagaggatatgctgtccgtttggaacagagtgtggatcgaagagaatccctggatggaagacaagacccacgtcagctcctgggaggaggtgccttaccttgggaaacgggaagatcagtggtgcggatctctgattggcctcacagctagagccacgtgggccaccaacatccaagttgctattaatcaggtgcgccggctgatcgggaacgagaattatctggactacatgacaagcatgaagagattcaaaaacgaatccgacccggagggcgccctctggtga

SEQ ID NO: 18641 - RNA, 9879 nt, synthetic construct
  misc_feature 1..9879: note = derived and/or modified CDS sequence (opt5) from DENV-1__KJ189324__SS-prME
  source 1..9879: mol_type = other RNA
agcgtgacaatgctgctcatgctgcttcccacagctctggctttccacctcacgaccagaggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccccagatcacagaagctgaacccgacgatgtggactgttggtgcaatgccaccgatacgtgggtgacctatggaacatgttcccagaccggcgagcacagaagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccagaagccacaccctgtggtctaatggggtgctcgaatccgagatgattatcccgaaaatttacggaggccctatcagccagcataactatcgccccgggtacttcacgcagaccgccggaccttggcacctgggcaaacttgagctggactttgatctctgcgaagggacaaccgtggtcgtggacgagcactgcggaaatcggggcccctctctgagaacaaccacggttacaggcaaaattatccatgaatggtgttgccggagctgtaccctgcctccccttcgcttcagaggggaggatggatgctggtacggcatggagatccggccggtgaaggaaaaagaggaaaacctcgtcagatccatggtgagcgcggggtctggagaggttgactcctttagcctgggcattctgtgtgcttccatcatgattgaagaggtgatgcgctctcggtggagcagaaagatgctcatgacagggaccctggccgtcttccttctgctcgtgatgggacaactgacctggaatgacctgatccgcctttgcattatggttggcgccaacgcttccgatagaatgggcatggggacaacgtatctggccctcatggcgacctttaagatgcggcctatgttcgctgtgggactgctctttcgcagactgacatctcgggaggtccttctgctcaccatcggcctgagcctggtggcctccgtggaacttcccaactctctggaggaactcggggacggactggccatgggcattatgatgctcaaactgcttacagagttccagccccaccagctgtggaccacgctcctgagcctgacatttatcaagaccaccctttccctggattacgcttggaaaacaaccgccatggctctcagcatcgtctctctgttccctctctgtctgtccacaacgagccagaagaccacatggcttccggttctgctggggtcttttggatgcaaacccctcaccatgttcctgattacagaaaataagatctggggccgcaagtcctggcctcttaacgagggcattatggccatcgggattgtgagcatcctgctctcttccctgctcaaaaatgacgtgcccctggcgggacctcttatcgccggcgggatgctgattgcttgttatgtcatcagcggatccagcgccgatctgtctctcgagaaggctgccgaagtgagctgggagcaagaagccgagcattccggcacctctcacaacattctggttgaagtgcaggacgatgggacgatgaaaatcaaggacgaggagagagatgacacccttacaattctgctcaaagctaccctgctcgcggtcagcggagtgtaccccatgtccatccctgccacactgtttgtttggtatttctggcagaagaaaaagcagcggtctggcgtgctttgggatacccccagcccgcctgaagtcgagcgcgctgtgctggacgatggcatctaccgcattctgcaacgggggctcctgggacgctcccaggtcggcgtgggggttttccaggacggagtgtttcatacaatgtggcacgtcacgagaggcgccgtgcttatgtatcaggggaagcggctggaaccctcttgggccagcgttaaaaaggacctcatctcctacggaggcggctggagattccaagggagctggaataccggagaggaggtgcaggtcattgctgtggaacctggcaaaaaccccaagaatgtgcagacaaccccggggacctttaaaacacctgagggagaagttggcgccatcgcgctggatttcaagcccgggacgtctggatcccctattgtcaaccgcgagggcaagatcgtgggcctctacgggaatggagtggtcaccacaagcggcacctatgtgtctgctattgcccaagccaaggcttcccaggaagggcccctgcccgagatcgaggacgaagtttttaagaaacggaaccttacaatcatggatctgcaccctggaagcggcaagaccagacgctacctgccggccattgtgcgggaggcgatcaaaagaaagctccgcacgctgattcttgctcccacacgggtcgtggcctccgaaatggccgaggctctgaaggggatgcctatcagatatcagaccaccgccgttaaatctgaacatacaggccgcgagattgtggacctcatgtgccacgctaccttcacaatgcggctgctgagccccgtcagagtgcctaattacaacatgatcatcatggatgaggcccattttaccgaccccgcgtccattgccgctcggggatatatcagcacgcgcgttggcatgggggaagccgctgccattttcatgacagccacccctccgggatctgtggaggcttttccccagtccaatgcggtcatccaagatgaagagagagacattcctgaacggagctggaactctggctacgattggatcacagacttccccgggaagaccgtgtggtttgtgcctagcatcaaatccggaaatgatattgccaactgtctccgcaagaacggcaaaagagtcatccagctttctcggaagacgttcgacaccgagtatcagaagaccaagaataacgactgggattacgttgtgaccacagacattagcgagatgggggctaatttcagagccgatcgcgtgatcgacccccggagatgcctgaagccggtcattctgaaagatggccctgaacgcgtgatcctcgccggacccatgcccgttaccgtggcttccgccgcgcagcggagaggccgcattgggcggaaccaaaataaggagggagaccagtacgtctatatgggccagcctctgaacaatgatgaagaccacgctcattggacagaggccaaaatgcttctggataacatcaatacccccgaggggatcattcctgccctctttgaaccggagagagaaaagtctgctgccatcgacggagagtaccgcctgagaggcgaagcgcggaagacgttcgtggagctgatgcgcagaggggatctccccgtttggcttagctataaagtggcctccgagggctttcagtacagcgaccggcgctggtgcttcgatggagaaagaaacaatcaagtcctggaggaaaacatggacgtggagatttggacaaaggaaggcgagcggaaaaagctgagacctcgctggctcgacgctcggacctattctgatcccctggcccttagagagtttaaagagttcgctgccgggcgccggtccgtcagcggagacctgatcctcgagattggcaagctgcctcagcacctgaccctcagagctcagaatgcccttgataacctggtgatgctgcacaattccgaacaagggggaaaagcgtaccggcatgccatggaggaactccccgacacaatcgagaccctgatgcttctggctctcatcgccgttctgacaggcggcgtgacgctgtttttcctctctgggaagggacttggcaagaccagcattgggctgctgtgtgtgacagcttcctctgccctcctgtggatggccagcgtcgagccgcactggatcgctgcgtccattatccttgaatttttcctgatggttctcctgattcctgagcccgatcgccaaagaacccctcaggacaaccagctggcctatgtggtgatcggactcctttttatgatcctgacagtcgctgccaacgaaatgggcctgctcgagaccacgaaaaaggatctggggattggacatgtggccgctgagaatcaccaacacgccaccatgcttgacgttgatctgcggcccgcgagcgcctggacactctacgctgtggccaccacagtcatcacccctatgatgcgccatacgattgaaaacacaaccgctaatatctctctgacagccattgcgaaccaggccgctatcctgatgggcctcgacaaaggctggcccatttccaagatggatatcggggtgccgcttctggccctgggatgctacagccaggtcaatcctctcaccctgaccgctgccgtgcttatgctggttgctcactatgccatcattggccccgggctccaggcgaaagccacaagagaggctcaaaagcggacggccgctggaatcatgaagaaccccaccgtggacggcattgtcgccatcgatctggaccctgtggtttacgacgccaaattcgaaaagcagctggggcagattatgctccttatcctgtgtacatctcagatcctgctcatgcgcaccacatgggcgctgtgcgagtccattacccttgctacgggaccgctgacaaccctctgggaaggcagccccggcaaattttggaataccacaatcgccgtgtctatggctaacattttcagagggagctatctggccggagccggcctggctttctccctcatgaagtctcttgggggaggccggcgcgggaccggagcccaaggcgagacactgggcgagaaatggaagagacagctgaatcagctcagcaagtccgaatttaacacgtacaaacggagcgggatcatggaggtcgatagatccgaagcgaaggagggactgaaacgcggcgaaaccacaaagcatgccgtgtctcgggggaccgctaaacttagatggttcgtggagcgcaatctggttaagcctgagggaaaggtcattgacctcggctgtgggcggggaggctggagctattactgcgccggcctgaaaaaggtgacagaagtgaaagggtataccaagggaggccccgggcacgaggaacctatccccatggctacgtacggatggaacctggtcaaactccattccggcaaggatgtgtttttcatgcctccggagaaatgtgacacccttctgtgcgatatcggggaatctagccccaatcctacaattgaggagggaagaaccctgcgcgttctcaagatggtggaaccctggctgcggggcaaccagttttgtatcaagattcttaatccttacatgccctccgtcgtggagacactggaacaaatgcagagaaaacacggcgggatgctcgttcgcaacccgctgtctcggaatagcacccacgagatgtattgggtgtcctgcggaacaggcaacatcgtcagcgccgtgaacatgacctctagaatgctgctcaatcgcttcacgatggcgcatcggaagcctacatacgagagagacgttgatctgggggccggaacccgccacgtggctgtcgaacccgaggtggccaaccttgacattatcggccagagaattgaaaatatcaaaaacgagcataagtccacctggcactatgatgaagacaatccctacaaaacatgggcttatcacgggagctacgaggtgaagccttctggatccgccagctctatggtcaacggcgttgtgcggctgctcacgaagccctgggatgtgatccctatggtcacccaaattgctatgacagacaccacaccgtttggccagcagcgcgtgttcaaagagaaggttgacaccagaacaccccgggccaaaagagggaccacgcagatcatggaagtgaccgcgaagtggctgtggggatttctttcccggaataaaaagcctcgcatttgtacaagagaggagttcacccggaaggtccgcagcaacgccgctatcggcgccgtgtttgttgatgagaatcaatggaactccgctaaagaagccgtggaggacgagagattctgggatctggtccatcgggaacgcgagctccacaagcaggggaaatgcgccacatgcgtgtataatatgatgggaaagagagagaaaaagctgggcgagtttgggaaggcgaaaggcagccgggctatttggtacatgtggctgggagcccgcttcctcgagttcgaggccctgggctttatgaacgaggaccattggttctctagagaaaatagcctttccggggttgagggagaaggcctgcacaagctcgggtacatcctgcgggatatctctaaaattcccggaggcaacatgtatgctgacgataccgccgggtgggacacgcgcatcacagaggatgaccttcagaatgaggctaagattaccgaaatcatggagcctgaacatgccctgctcgcgacaagcatttttaaactgacctaccagaacaaggtggtcagagtgcaacggcccgccaaaaacggcacggtcatggatgtgatctcccgcagagaccagcggggatctggccaggttgggacctatggactgaatacattcaccaacatggaggtgcagctcatcagacaaatggaaagcgaggagatttttctgccgtccgaacttgagacacctaatctggctgaacgcgtcctcgattggctggagaagcacggcgccgaacggcttaagagaatggctatctctggggacgactgtgtggtgaaacccattgatgaccgcttcgccaccgcgctgacagccctcaacgatatgggaaaggttcggaaagacatccctcagtgggagcccagcaagggctggaatgattggcaacaggtgcctttttgctcccaccatttccaccaactgattatgaaagacgggagagagatcgtcgtgccctgtcgcaaccaggatgaactggttggccgggctagagtgagccagggagccggctggtctctccgcgagaccgcttgcctggggaagtcctacgcccaaatgtggcagcttatgtattttcatcggagagacctgcgcctcgctgccaatgcgatctgtagcgccgtcccggtggattgggtccctacgtctcggacaacctggtccattcacgctcaccatcagtggatgaccacagaagacatgctgagcgtgtggaacagagtttggatcgaggaaaatccctggatggaggataagacccacgtgtcctcttgggaggaagtcccctaccttggaaaacgggaggaccagtggtgcggcagcctgattgggctcacagccagagccacgtgggctaccaacatccaagtggccattaatcaggttcgccggctgatcggaaacgaaaattatctggactacatgacatccatgaagagattcaaaaacgagagcgatcctgagggcgcgctctggtga

SEQ ID NO: 18642 - RNA, 9879 nt, synthetic construct
  misc_feature 1..9879: note = derived and/or modified CDS sequence (opt5) from DENV-1__KJ189325__SS-prME
  source 1..9879: mol_type = other RNA
agcgtgaccatgctgctcatgctgcttcccaccgccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaaccatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagaacaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattacaccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagccgccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtgattaactggaaaggcagagaactgaagtgtgggtccggaatcttcgtcaccaacgaggtgcacacgtggacagaacagtataagtttcaggctgatagccctaaacgcctctccgccgcgattggcaaggcctgggaggagggggtttgcggcatccggtctgctaccagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacacaacctttatcatcgacgggcctgatacgcccgaatgtcctgacaatcagcgggcttggaacatttgggaggtggaggattatggattcggcatctttacaaccaatatttggctgaaacttagagacagctacacacaaatgtgcgatcaccgcctcatgtccgcggccatcaaagacagcaaggctgtccatgccgatatgggctattggattgaatctgagaaaaacgaaacctggaagctggcccgggcttccttcatcgaggttaagacatgtacctggcccaaaagccacacgctgtggtctaatggggtgctcgaatccgagatgatcattccgaagatctacggaggccctattagccagcataactatagacccgggtacttcacccagacagccggaccttggcacctgggcaaacttgagctggactttgatctctgcgaagggaccacagtggtcgtggacgagcactgcggaaatcgcggcccctctctgcggaccacgacagttaccggcaagatcattcatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggaccctggccgtcttccttctgctcgtgatgggacaactgacatggaatgacctgattagactttgcatcatggttggcgccaacgcttccgatcgcatgggcatggggacgacctatctggccctcatggcgacatttaaaatgagacctatgttcgctgtgggactgctctttcggcgcctgacctctagagaggtccttctgctcacaattggcctgagcctggtggcctccgtggaacttcccaactctctggaggaactcggggacggactggccatgggcatcatgatgctcaagctgcttaccgagttccagccccaccagctgtggattacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaagctgccgaagtgagctgggagcaagaagccgagcattccggcacctctcacaacattctggttgaagtgcaggacgatgggacgatgaagatcaaagacgaggagcgcgatgacacccttacaattctgctcaaggctaccctgctcgcggtcagcggagtgtaccccatgtccatccctgccacactgtttgtttggtatttctggcagaaaaagaagcagagatctggcgtgctttgggatacccccagcccgcctgaagtcgagcgggctgtgctggacgatggcatctaccgcattctgcaaagagggctcctgggacggtcccaggtcggcgtgggggttttccaggacggagtgtttcatacaatgtggcacgtcacgcgcggcgccgtgcttatgtatcaggggaaaagactggaaccctcttgggccagcgttaagaaagacctcatctcctacggaggcggctggcggttccaagggagctggaataccggagaggaggtgcaggtcattgctgtggaacctggcaagaaccccaaaaatgtgcagacaatgccggggacctttaagacccctgagggagaagttggcgccatcgcgctggatttcaagcccgggacatctggatcccctattgtcaacagagagggcaaaatcgtgggcctctacgggaatggagtggtcacgaccagcggcacatatgtgtctgctattgcccaagccaaggcttcccaggaagggcccctgcccgagatcgaggacgaagtttttaaaaagcgcaaccttaccatcatggatctgcaccctggaagcggcaaaacacggagatacctgccggccatggtgcgcgaggcgattaagcggaagctcagaaccctgatccttgctcccacgcgcgtcgtggcctccgaaatggccgaggctctgaaagggatgcctattcggtatcagacaaccgccgttaagtctgaacataccggcagagagatcgtggacctcatgtgccacgctacattcaccatgcgcctgctgagccccgtccgggtgcctaattacaacatgattatcatggatgaggcccattttacagaccccgcgtccatcgccgctagaggatatattagcacccgggttggcatgggggaagccgctgccatcttcatgacggccacacctccgggatctgtggaggcttttccccagtccaatgcggtcattcaagatgaagaacgcgacatccctgaaagaagctggaactctggctacgattggattaccgacttccccgggaaaacagtgtggtttgtgcctagcatcaagtccggaaatgatatcgccaactgtctccggaaaaacggcaagcgcgtcattcagctttctagaaagaccttcgacacggagtatcagaaaaccaagaataacgactgggattacgttgtgacaaccgacatcagcgagatgggggctaatttccgggccgatagagtgattgacccccgccggtgcctgaaaccggtcatcctgaaggatggccctgaaagagtgattctcgccggacccatgcccgttacagtggcttccgccgcgcagcgccggggcagaatcgggcgcaaccaaaataaagagggagaccagtacgtctatatgggccagcctctgaacaatgatgaagaccacgctcattggaccgaggccaagatgcttctggataacattaatacacccgaggggatcatccctgccctctttgaaccggagcgggaaaagtctgctgccattgacggagagtacagactgcgcggcgaagcgagaaaaaccttcgtggagctgatgcggcgcggggatctccccgtttggcttagctataaggtggcctccgagggctttcagtacagcgacagacggtggtgcttcgatggagaacgcaacaatcaagtcctggaggaaaacatggacgtggagatctggacgaaagaaggcgagagaaagaaactgcggcctagatggctcgacgctcgcacatattctgatcccctggcccttcgggagtttaaggagttcgctgccgggagacgctccgtcagcggagacctgattctcgagatcggcaaactgcctcagcacctgaccctccgggctcagaatgcccttgataacctggtgatgctgcacaattccgaacaagggggaaaggcgtacagacatgccatggaggaactccccgacaccattgagacactgatgcttctggctctcatcgccgttctgaccggcggcgtgacactgtttttcctctctgggaagggacttggcaaaacgagcatcgggctgctgtgtgtgaccgcttcctctgccctcctgtggatggccagcgtcgagccgcactggattgctgcgtccatcattcttgaatttttcctgatggttctcctgatccctgagcccgatcggcaacgcacacctcaggacaaccagctggcctatgtggtgattggactcctttttatgatcctgaccgtcgctgccaacgaaatgggcctgctcgagacaaccaagaaagatctggggatcggacatgtggccgctgagaatcaccaacacgccacgatgcttgacgttgatctgagacccgcgagcgcctggaccctctacgctgtggccacaaccgtcattacacctatgatgcggcataccatcgaaaacacgacagctaatatttctctgaccgccatcgcgaaccaggccgctattctgatgggcctcgacaagggctggcccatctccaaaatggatattggggtgccgcttctggccctgggatgctacagccaggtcaatcctctcacactgaccgctgccgtgcttatgctggttgctcactatgccatcatcggccccgggctccaggcgaaggccacccgcgaggctcaaaagagaacagccgctggaattatgaaaaaccccacggtggacggcatcgtcgccattgatctggaccctgtggtttacgacgccaagttcgaaaaacagctggggcagatcatgctccttattctgtgtacctctcagatcctgctcatgcggacaacctgggcgctgtgcgagtccatcacacttgctaccggaccgctgacgacactctgggaaggcagccccggcaagttttggaataccaccattgccgtgtctatggctaacatcttccgcgggagctatctggccggagccggcctggctttctccctcatgaaatctcttgggggaggcagacgggggacaggagcccaaggcgagaccctgggcgagaagtggaagcgccagctgaatcagctcagcaaatccgaatttaacacatacaagagaagcgggattatggaggtcgatcggtccgaagcgaaagagggactgaagagaggcgaaacgaccaaacatgccgtgtctcgcgggacagctaaacttcggtggttcgtggagagaaatctggttaagcctgagggaaaagtcatcgacctcggctgtgggcgcggaggctggagctattactgcgccggcctgaagaaagtgaccgaagtgaaggggtatacaaaaggaggccccgggcacgaggaacctattcccatggctacctacggatggaacctggtcaagctccattccggcaaagatgtgtttttcatgcctccggagaagtgtgacacgcttctgtgcgatatcggggaatctagccccaatcctaccatcgaggagggacggacactgagagttctcaagatggtggaaccctggctgcgcggcaaccagttttgtattaaaatccttaatccttacatgccctccgtcgtggagaccctggaacaaatgcagcggaagcacggcgggatgctcgttagaaacccgctgtctcgcaatagcacacacgagatgtattgggtgtcctgcggaaccggcaacattgtcagcgccgtgaacatgacatctcggatgctgctcaatagattcaccatggcgcatcgcaaacctacgtacgagcgggacgttgatctgggggccggaacaagacacgtggctgtcgaacccgaggtggccaaccttgacatcattggccagcgcatcgaaaatattaagaacgagcataaatccacctggcactatgatgaagacaatccctacaagacctgggcttatcacgggagctacgaggtgaagccttctggatccgccagctctatggtcaacggcgttgtgagactgctcacaaaaccctgggatgtgatccctatggtcacgcaaatcgctatgaccgacacaaccccgtttggccagcagcgggtgttcaaggagaaagttgacacacgcacccccagagccaagcgggggacaacccagattatggaagtgacggcgaaatggctgtggggatttctttccagaaataagaagcctcggatctgtacccgcgaggagttcacaagaaaagtccggagcaacgccgctattggcgccgtgtttgttgatgagaatcaatggaactccgctaaggaagccgtggaggacgagcgcttctgggatctggtccatagagaacgggagctccacaaacaggggaagtgcgctacctgcgtgtataatatgatgggaaaacgcgaaaagaagctgggcgagtttgggaaagcgaagggcagcagagctatctggtacatgtggctgggagcccggttcctcgagttcgaggccctgggctttatgaacgaggaccattggttctctcgcgaaaatagcctttccggggttgagggagaaggcctgcacaaactcgggtacattctgagagatatctctaagatccccggaggcaacatgtatgctgacgatacagccgggtgggacacccggattacggaggatgaccttcagaatgaggctaaaatcacagaaattatggagcctgaacatgccctgctcgcgaccagcatctttaagctgacataccagaacaaagtggtccgcgtgcaaagacccgccaagaacggcaccgtcatggatgtgatttcccggcgcgaccagagaggatctggccaggttgggacgtatggactgaataccttcacaaacatggaggtgcagctcatccggcaaatggaaagcgagggcatctttctgccgtccgagcttgaaacccctaatctggctgagagagtcctcgattggctggaaaagcacggggccgagcgccttaaacggatggctatttctggagacgactgtgtggtgaagcccatcgatgacagattcgccacagcgctgaccgccctcaacgatatgggcaaagttcgcaaggacattcctcagtgggaacccagcaaagggtggaatgattggcaacaggtgcctttttgctcccaccatttccaccaactgatcatgaaggacggccgggagattgtcgtgccctgtagaaaccaggatgagctggttggacgcgctcgggtgagccagggcgccgggtggtctctcagagaaacagcttgcctgggaaagtcctacgcccaaatgtggcagcttatgtattttcatcgccgggacctgagactcgctgccaatgcgatctgtagcgccgtcccggtggattgggtccctacctctcgcacgacatggtccatccacgctcaccatcagtggatgaccaccgaggacatgctgagcgtgtggaaccgggtttggattgaagagaatccctggatggaagataaaacacacgtgtcctcttgggaggaggtcccctaccttggcaagagagaagaccagtggtgcgggagcctgatcggactcaccgcccgggccacatgggctacgaacattcaagtggccatcaatcaggttagacgcctgattggcaacgagaattatctggactacatgacctccatgaaacggttcaagaacgaaagcgatcctgagggggcgctctggtga

SEQ ID NO: 18643 - RNA, 9879 nt, synthetic construct
  misc_feature 1..9879: note = derived and/or modified CDS sequence (opt5) from DENV-1__KJ189326__SS-prME
  source 1..9879: mol_type = other RNA
agcgtgaccatgctgctgatgctgcttcccaccgccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaaccatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagaacaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattacaccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagccgccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtgattaactggaaaggcagagaactgaagtgtgggtccggaatcttcgtcaccaacgaggtgcacacgtggacagaacagtataagtttcaggctgatagccctaaacgcctctccgccgcgattggcaaggcctgggaggagggggtttgcggcatccggtctgctaccagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacacaacctttatcatcgacgggcctgatacgcccgaatgtcctgacaatcagcgggcttggaacatttgggaggtggaggattatggattcggcatctttacaaccaatatttggctgaaacttagagacagctacacacaaatgtgcgatcaccgcctcatgtccgcggccatcaaagacagcaaggctgtccatgccgatatgggctattggattgaatctgagaaaaacgaaacctggaagctggcccgggcttccttcatcgaggttaagacatgtacctggcccaaaagccacacgctgtggtctaatggggtgctcgaatccgagatgatcattccgaagatctacggaggccctattagccagcataactatagacccgggtacttcacccagacagccggaccttggcacctgggcaaacttgagctggactttgatctctgcgaagggaccacagtggtcgtggacgagcactgcggaaatcgcggcccctctctgcggaccacgacagttaccggcaagatcattcatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggaccctggccgtcttccttctgctcgtgatgggacaactgacatggaatgacctgattagactttgcatcatggttggcgccaacgcttccgatcgcatgggcatggggacgacctatctggccctcatggcgacatttaaaatgagacctatgttcgctgtgggactgctctttcggcgcctgacctctagagaggtccttctgctcacaattggcctgagcctggtggcctccgtggaacttcccaactctctggaggaactcggggacggactggccatgggcatcatgatgctcaagctgcttaccgagttccagccccaccagctgtggacgacactcctgagcctgacctttattaaaaccacactttccctggattacgcttggaagaccacagccatggctctcagcatcgtctctctgttccctctctgtctgtccacgaccagccagaaaacaacctggcttccggttctgctggggtcttttggatgcaagcccctcacaatgttcctgatcaccgaaaataagatttggggccggaaatcctggcctcttaacgagggcatcatggccattgggatcgtgagcattctgctctcttccctgctcaagaatgacgtgcccctggcgggacctcttatcgccggcgggatgctgatcgcttgttatgtcattagcggatccagcgccgatctgtctctcgagaaagctgccgaagtgagctgggagcaagaagccgagcattccggcacgtctcacaacatcctggttgaagtgcaggacgatgggaccatgaagattaaagacgaggagcgcgatgacacacttaccatcctgctcaaggctacactgctcgcggtcagcggagtgtaccccatgtccattcctgccaccctgtttgtttggtatttctggcagaaaaagaagcagagatctggcgtgctttgggatacacccagcccgcctgaagtcgagcgggctgtgctggacgatggcatctaccgcatcctgcaaagagggctcctgggacggtcccaggtcggcgtgggggttttccaggacggagtgtttcatacgatgtggcacgtcacccgcggcgccgtgcttatgtatcaggggaaaagactggaaccctcttgggccagcgttaagaaagacctcatttcctacggaggcggctggcggttccaagggctgtggaatacaggagaggaggtgcaggtcatcgctgtggaacctggcaagaaccccaaaaatgtgcagaccaccccggggacatttaagacgcctgagggagaagttggcgccattgcgctcgatttcaagcccgggaccagcggatctcctatcgtcaacagagagggcaaaattgtgggcctgtacgggaatggagtggtcacaacctccggcacatatgtgagcgctatcgcccaagccaaggcttctcaggaagggccccttcccgagattgaggacgaagtttttaaaaagcgcaacctgaccatcatggatctgcaccctggatccggcaaaacgcggagatacctcccggccatggtgcgcgaggcgatcaagcggaagctgagaacacttattctggctcccacccgcgtcgtggccagcgaaatggccgaggctctcaaagggatgcctatccggtatcagaccacagccgttaagtccgaacataccggcagagagattgtggacctgatgtgccacgctacattcaccatgcgcctgctctctcccgtccgggtgcctaattacaacatgatcattatggatgaggcccattttacggaccccgcgagcatcgccgctagaggatatatctccacacgggttggcatgggggaagccgctgccattttcatgaccgccacacctccgggaagcgtggaggcttttccccagtctaatgcggtcatccaagatgaagaacgcgacattcctgaaagatcctggaacagcggctacgattggatcaccgacttccccgggaaaacggtgtggtttgtgccttctattaagagcggaaatgatatcgccaactgtcttcggaaaaacggcaagcgcgtcatccagctgtccagaaagaccttcgacacagagtatcagaaaaccaagaataacgactgggattacgttgtgacaaccgacatttctgagatgggggctaatttccgggccgatagagtgatcgacccccgccggtgcctgaaaccggtcattctcaaggatggccctgaaagagtgatcctggccggacccatgcccgttacagtggctagcgccgcgcagcgccggggcagaattgggcgcaaccaaaataaagagggagaccagtacgtctatatgggccagcctcttaacaatgatgaagaccacgctcattggaccgaggccaagatgctgctcgataacatcaatacgcccgaggggattatccctgccctgtttgaaccggagcgggaaaagtccgctgccatcgacggagagtacagactgcgcggcgaagcgagaaaaacattcgtggagctcatgcggcgcggggatcttcccgtttggctgtcttataaggtggccagcgagggctttcagtactccgacagacggtggtgcttcgatggagaacgcaacaatcaagtcctggaggaaaacatggacgtggagatttggaccaaagaaggcgagagaaagaaactccggcctagatggctggacgctcgcacctatagcgatccccttgccctgcgggagtttaaggagttcgctgccgggagacgctctgtctccggagacctcatcctggagattggcaaactgcctcagcacctcacacttcgggctcagaatgccctggataacctggtgatgctccacaatagcgaacaagggggaaaggcgtacagacatgccatggaggaactgcccgacaccatcgagacacttatgctgctcgctctgattgccgttctgacgggcggcgtgaccctctttttcctttccgggaagggactgggcaaaacatctatcgggctgctctgtgtgaccgctagctccgccctgctttggatggcctctgtcgagccgcactggatcgctgcgagcattatcctggaatttttcctcatggttctgctgattcctgagcccgatcggcaacgcacacctcaggacaaccagctcgcctatgtggtgatcggacttctgtttatgattctgaccgtcgctgccaacgaaatgggcctcctggagacgaccaagaaagatcttgggatcggacatgtggccgctgagaatcaccaacacgccacaatgctggacgttgatctcagacccgcgtccgcctggaccctgtacgctgtggccacaaccgtcatcacgcctatgatgcggcatacaattgaaaacaccacagctaatatcagcctgaccgccattgcgaaccaggccgctatcctcatgggccttgacaagggctggcccatttctaaaatggatatcggggtgccgctgctggccctcggatgctactcccaggtcaatcctctgacccttacagctgccgtgctgatgctcgttgctcactatgccattatcggccccgggctgcaggcgaaggccacgcgcgaggctcaaaagagaaccgccgctggaatcatgaaaaaccccacagtggacggcattgtcgccatcgatctggaccctgtggtttacgacgccaagttcgaaaaacagctcgggcagattatgcttctgatcctgtgtaccagccagattctcctgatgcggacaacctgggcgctttgcgagtctatcacgctggctacaggaccgctcaccaccctgtgggaaggctcccccggcaagttttggaatacaaccatcgccgtgagcatggctaacattttccgcgggtcttatctggccggagccggcctcgctttcagccttatgaaatccctcgggggaggcagacgggggacaggagcccaaggcgagacgctgggcgagaagtggaagcgccagctcaatcagctgtctaaaagcgaatttaacacctacaagagatccgggatcatggaggtcgatcggagcgaagcgaaagagggacttaagagaggcgaaacaaccaaacatgccgtgtcccgcgggacagctaagctgcggtggttcgtggagagaaatctcgttaagcctgagggaaaagtcattgacctgggctgtgggcgcggaggctggtcttattactgcgccggcctgaagaaagtgaccgaagtgaaggggtatacgaaaggaggccccgggcacgaggaacctatccccatggctacctacggatggaacctcgtcaaacttcatagcggcaaagatgtgtttttcatgcctccggagaagtgtgacacactgctgtgcgatattggggaatcctctcccaatcctaccatcgaggagggacggacactcagagttctgaagatggtggaaccctggcttcgcggcaaccagttttgtatcaaaattctgaatccttacatgcccagcgtcgtggagaccctcgaacaaatgcagcggaagcacggcgggatgctggttagaaacccgctgtcccgcaattctacacacgagatgtattgggtgagctgcggaaccggcaacatcgtctccgccgtgaacatgacgagccggatgctcctgaatagattcacaatggcgcatcgcaaacctacctacgagcgggacgttgatcttggggccggaaccagacacgtggctgtcgaacccgaggtggccaacctggacattatcggccagcgcattgaaaatatcaagaacgagcataaatctacatggcactatgatgaagacaatccctacaagacgtgggcttatcacgggtcctacgaggtgaagcctagcggatctgcctccagcatggtcaacggcgttgtgagactcctgaccaaaccctgggatgtgattcctatggtcacacaaatcgctatgaccgacacaaccccgtttggccagcagcgggtgttcaaggagaaagttgacacacgcacccccagagccaagcgggggacgacccagatcatggaagtgacagcgaaatggctttggggatttctgtctagaaataagaagcctcggatttgtacccgcgaggagttcacaagaaaagtccggtccaacgccgctatcggcgccgtgtttgttgatgagaatcaatggaacagcgctaaggaagccgtggaggacgagcgcttctgggatctcgtccatagagaacgggagctgcacaaacaggggaagtgcgctacctgcgtgtataatatgatgggaaaacgcgaaaagaagctgggcgagtttgggaaagcgaagggctccagagctatttggtacatgtggctcggagcccggttcctggagttcgaggcccttggctttatgaacgaggaccattggttcagccgcgaaaattctctgagcggggttgagggagaaggcctccacaaactggggtacatccttagagatatttccaagatccccggaggcaacatgtatgctgacgatacggccgggtgggacacacggatcaccgaggatgacctgcagaatgaggctaaaattacagaaatcatggagcctgaacatgccctcctggcgacctctatttttaagctgacgtaccagaacaaagtggtccgcgtgcaaagacccgccaagaacggcaccgtcatggatgtgatcagccggcgcgaccagagaggatccggccaggttgggacatatggactcaataccttcacaaacatggaggtgcagctgattcggcaaatggaatctgagggcatctttcttccgagcgagctggaaacccctaatctcgctgagagagtcctggattggcttgaaaagcacggggccgagcgcctgaaacggatggctatctccggagacgactgtgtggtgaagcccattgatgacagattcgccacagcgctcaccgccctgaacgatatgggcaaagttcgcaaggacatccctcagtgggaaccctctaaagggtggaatgattggcaacaggtgcctttttgcagccaccatttccaccaactgattatgaaggacggccgggagatcgtcgtgccctgtagaaaccaggatgagctcgttggacgcgctcgggtgtcccagggcgccgggtggagcctgagagaaacggcttgccttggaaagtcttacgcccaaatgtggcagctgatgtattttcatcgccgggacctcagactggctgccaatgcgatttgttccgccgtcccggtggattgggtccctacaagccgcaccacctggtctatccacgctcaccatcagtggatgacaaccgaggacatgctttccgtgtggaaccgggtttggatcgaagagaatccctggatggaagataaaacacacgtgagctcctgggaggaggtcccctacctgggcaagagagaagaccagtggtgcgggtctctcattggactgacggcccgggccacctgggctacaaacatccaagtggccattaatcaggttagacgcctgatcggcaacgagaattatctcgactacatgaccagcatgaaacggttcaagaacgaatccgatcctgagggggcgctgtggtga

SEQ ID NO: 18644 - RNA, 9879 nt, synthetic construct
  misc_feature 1..9879: note = derived and/or modified CDS sequence (opt5) from DENV-1__KJ189327__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagagaagcggtctgtcgccctggctcctcatgtggggctcggactggaaacacgcaccgagacgtggatgagctccgaaggcgcctggaaacagattcagagagttgagacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagactttgttgagggactctccggcgccacatgggtggatgtcgtgctggaacacgggagctgtgtgacgaccatggctaagaataaacccacactggacatcgagctcctgaagaccgaagtcacaaaccctgccattcttcggaaactgtgcatcgaggcgaagatttctaataccacgacagattcccgctgtccgacccagggagaagccaccctcgttgaggagcaggacgctaacttcgtgtgcagacggacatttgtggatcgcggctggggcaatgggtgtggactgttcggcaaagggagccttctgacctgcgccaagtttaagtgcgtcacaaaactcgaaggaaagatcgtgcagtacgagaacctgaaatattctgttatcgtgacggtccacaccggcgaccaacatcaggtggggaatgaaacaaccgagcacggaacaattgctaccatcacgccccaggcccctacctccgaaattcagctgacagattacggcgccctcaccctggactgtagccccagaacaggccttgacttcaacgagatggttctgctcaccatgaaggagaaatcttggctggtgcataagcaatggtttcttgatctgcctctcccctggacgtccggggctagcacatcccaggaaacctggaatcggcaggacctgctggtcacattcaaaaccgcgcacgccaagaagcaagaggtggtcgtgctcggatctcaggaaggcgctatgcacaccgccctgacaggggccacggagatccagaccagcggaacaaccacaatttttgctggccatcttaaatgccgcctgaagatggataaactcaccctgaaggggacgtcctatgttatgtgtacaggcagcttcaaactggaaaaggaggtggccgagacccagcacggaaccgtccttgtgcaagttaagtacgaaggcacagacgcgccgtgcaaaatccctttctctacccaggatgagaagggggtgacacagaacggaagactcatcacggctaatcccattgtcaccgacaaagaaaagcctgtgaacatcgagacagagcccccctttggcgaatcctatattgtggttggggccggagagaaagccctgaagctgagctggttcaagaaaggctctagcatcgggaagatgtttgaagctaccgcccggggcgctagacgcatggccattctcggagatacagcgtgggacttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgattctggatgcgtgatcaactggaaaggcagagagctgaagtgtgggtccggaattttcgtcacaaacgaagtgcacacctggacggagcagtataagtttcaggctgacagccctaaacgcctctccgccgcgatcggcaaggcctgggaggaaggggtttgcggcattcggtctgctacaagactggagaatatcatgtggaaacagatcagcaacgaacttaatcatattctgctcgagaacgatatgaagttcaccgtggtcgtgggagacgccaatggcatcctggctcaagggaaaaagatgattcgcccgcagcccatggaacacaaatactcctggaagtcttggggaaaggccaaaatcattggcgccgacacccagaacacaacctttatcatcgatgggcctgacacgcccgagtgtcctgataatcagcgggcttggaacatttgggaggtggaagactatggattcggcatctttacaaccaatatttggctgaagcttagagatagctacacacaaatgtgcgaccaccgcctcatgtccgcggccatcaaagatagcaaggctgtccatgccgacatgggctattggattgagtctgaaaaaaacgagacctggaagctggcccgggcttccttcatcgaagttaagacatgtacctggcccaaaagccacacgctgtggtctaatggggtgctcgagtccgagatgatcattccgaagatctacggaggccctattagccagcataactatagacccgggtacttcacccagacagccggaccttggcacctgggcaaacttgaactggattttgacctctgcgaggggaccacagtggtcgtggatgaacactgcggaaatcgcggcccctctctgcggaccacgacagttaccggcaagatcattcatgagtggtgttgcagaagctgtacactgcctccccttcggttccgcggggaggacggatgctggtacggcatggaaatcagaccggtgaaagagaaggaagagaacctcgtccggtccatggtgagcgcggggtctggagaagttgattcctttagcctgggcatcctgtgtgcttccattatgatcgaggaggtgatgagatctcgctggagccggaagatgctcatgaccgggaccctggccgtcttccttctgctcattatgggacaactgacatggaatgacctgatcagactttgcattatggtgggcgccaacgcttccgaccgcatgggcatggggacgacctatctggccctcatggcgacatttaaaatgagacctatgttcgctgttggactgctctttcggcgcctgacctctagagaagtgcttctgctcacaatcggcctgagcctggtcgcctccgtggagcttcccaactctctggaagagctcggggatggactggccatgggcattatgatgctcaagctgcttaccgaattccagccccaccagctgtggacgacactcctgagcctgacctttatcaaaaccacactttccctggactacgcttggaagaccacagccatggctctcagcatcgtgtctctgttccctctctgtctgtccacgaccagccagaaaacaacctggcttccggtcctgctggggtcttttggatgcaagcccctcacaatgttcctgattaccgagaataagatctggggccggaaatcctggcctcttaacgagggcattatggccatcgggattgttagcatcctgctctcttccctgctcaagaatgatgtgcccctggcgggacctcttatcgccggcgggatgctgattgcttgttatgtgatcagcggatccagcgccgacctgtctctcgaaaaagctgccgaggtcagctgggaacaagaggccgaacattccggcacgtctcacaacattctggtggaggttcaggatgacgggaccatgaagatcaaagatgaggaacgcgacgatacacttaccattctgctcaaggctacactgctcgcggtgagcggagtctaccccatgtccatccctgccaccctgtttgtgtggtatttctggcagaaaaagaagcagagatctggcgttctttgggacacacccagcccgcctgaggtggaacgggctgtcctggatgacggcatctaccgcattctgcaaagagggctcctgggacggtcccaggtgggcgtcggggtgttccaggatggagtttttcatacgatgtggcacgtgacccgcggcgccgtccttatgtatcaggggaaaagactggagccctcttgggccagcgtgaagaaagacctcatctcctacggaggcggctggcggttccaagggagctggaatacaggagaggaagttcaggtgattgctgtcgagcctggcaagaaccccaaaaatgtgcagaccaccccggggacatttaagacgcctgaaggagaggtgggcgccatcgcgctggacttcaagcccgggacctctggatcccctattgttaacagagaaggcaaaatcgtcggcctctacgggaatggagtggtgacaaccagcggcacatatgtctctgctattgcccaagccaaggcttcccaggaggggcccctgcccgagatcgaagatgaggtgtttaaaaagcgcaaccttaccatcatggacctgcaccctggaagcggcaaaacgcggagatacctgccggccattgttcgcgaagcgatcaagcggaagctcagaacactgattcttgctcccacccgcgtggtcgcctccgagatggccgaagctctgaaagggatgcctatccggtatcagaccacagccgtgaagtctgagcataccggcagagagattgttgatctcatgtgccacgctacattcaccatgcgcctgctgagccccgtgcgggtccctaattacaacatgatcatcatggacgaagcccattttacggatcccgcgtccattgccgctagaggatatatcagcacacgggtgggcatgggggaggccgctgccattttcatgaccgccacacctccgggatctgttgaagcttttccccagtccaatgcggtgatccaagacgaggaacgcgatattcctgagagaagctggaactctggctacgactggatcaccgatttccccgggaaaacggtctggtttgtgcctagcatcaagtccggaaatgacattgccaactgtctccggaaaaacggcaagcgcgtgatccagctttctagaaagaccttcgatacagagtatcagaaaaccaagaataacgactgggactacgtcgttacaaccgatattagcgaaatgggggctaatttccgggccgacagagtgatcgatccccgccggtgcctgaaaccggtgattctgaaggacggccctgagagagtcatcctcgccggacccatgcccgtgacagttgcttccgccgcgcagcgccggggcagaattgggcgcaaccaaaataaagaaggagatcagtacgtgtatatgggccagcctctgaacaatgacgaggatcacgctcattggaccgaggccaagatgcttctggacaacatcaatacgcccgaagggatcattcctgccctctttgagccggaacgggagaagtctgctgccatcgatggagaatacagactgcgcggcgaggcgagaaaaacattcgtcgagctgatgcggcgcggggacctccccgtgtggcttagctataaggttgcctccgaaggctttcagtacagcgatagacggtggtgcttcgacggagagcgcaacaatcaagtgctggaagagaacatggatgtcgaaatttggaccaaagagggcgagagaaagaaactgcggcctagatggctcgacgctcgcacctattctgaccccctggcccttcgggaatttaaggagttcgctgccgggagacgctccgtgagcggagatctgatcctcgaaattggcaaactgcctcagcacctgacactccgggctcagaatgcccttgacaacctggtcatgctgcacaattccgagcaggggggaaaggcgtacagacatgccatggaagagctccccgataccatcgagacactgatgcttctggctctcatcgccgtgctgacgggcggcgttaccctgtttttcctctctgggaagggacttggcaaaacaagcattgggctgctgtgtgtgaccgcttcctctgccctcctgtggatggccagcgtggaaccgcactggatcgctgcgtccattatccttgagtttttcctgatggtcctcctgattcctgaacccgaccggcaacgcacacctcaggataaccagctggcctatgttgtgatcggactcctttttatgatcctgaccgtggctgccaacgagatgggcctgctcgagacgaccaagaaagacctggggattggacatgtcgccgctgaaaatcaccaacacgccacaatgcttgatgtggacctgagacccgcgagcgcctggaccctctacgctgttgccacaaccgtgatcacgcctatgatgcggcatacaattgagaacaccacagctaatatctctctgaccgccattgcgaaccaggccgctatcctgatgggcctcgataagggctggcccatttccaaaatggacatcggggtcccgcttctggccctgggatgctacagccaggtgaatcctctcaccctgacagctgccgtccttatgctggtggctcactatgccatcattggccccgggctccaggcgaaggccacgcgcgaagctcaaaagagaaccgccgctggaatcatgaaaaaccccacagttgatggcattgtggccatcgacctggatcctgtcgtgtacgacgccaagttcgagaaacagctggggcagattatgctccttatcctgtgtacctctcagatcctgctcatgcggacaacctgggcgctgtgcgaatccattacgcttgctacaggaccgctgaccaccctctgggagggcagccccggcaagttttggaatacaaccatcgccgtttctatggctaacattttccgcgggagctatctggccggagccggcctggctttctccctcatgaaatctcttgggggaggcagacgggggacaggagcccaaggcgagacgctgggcgaaaagtggaagcgccagctgaatcagctcagcaaatccgagtttaacacctacaagagaagcgggatcatggaagtggaccggtccgaggcgaaagaaggactgaagagaggcgagacaaccaaacatgccgtctctcgcgggacagctaagcttcggtggttcgtggagagaaatctggtgaagcctgaaggaaaagttattgatctcggctgtgggcgcggaggctggagctattactgcgccggcctgaagaaagtcaccgaggtgaaggggtatacgaaaggaggccccgggcacgaagagcctatccccatggctacctacggatggaacctggtgaagctccattccggcaaagacgtctttttcatgcctccggaaaagtgtgatacacttctgtgcgacatcggggagtctagccccaatcctaccattgaggaaggacggacactgagagttctcaagatggtggagccctggctgcgcggcaaccagttttgtatcaaaattcttaatccttacatgccctccgtggtcgaaaccctggagcaaatgcagcggaagcacggcgggatgctcgtgagaaacccgctgtctcgcaatagcacacacgagatgtattgggtttcctgcggaaccggcaacatcgtgagcgccgtcaacatgacgtctcggatgctgctcaatagattcacaatggcgcatcgcaaacctacctttgaacgggatgtggacctgggggccggaaccagacacgttgctgtggagcccgaagtcgccaaccttgatattatcggccagcgcattgagaatatcaagaacgaacataaatccacatggcactacgacgaggataatccctataagacgtgggcttaccacgggagctatgaggtgaagccttctggatccgccagctctatggtgaacggcgtcgttagactgctcaccaaaccctgggacgtgatccctatggtgacacaaattgctatgaccgatacaaccccgttcggccagcagcgggtctttaaggaaaaagtggacacacgcacccccagagccaagcgggggacgacccagatcatggaggttacagcgaaatggctgtggggattcctttccagaaataagaagcctcggatttgtacccgcgaagagtttacaagaaaagtgcggagcaacgccgctatcggcgccgtcttcgtggacgaaaatcaatggaactccgctaaggaggccgttgaggatgaacgcttttgggacctggtgcatagagagcgggaactccacaaacaggggaagtgcgccacctgcgtctacaatatgatgggaaaacgcgagaagaagctgggcgaattcgggaaagcgaagggcagcagagctatttggtatatgtggctgggagcccggttcctcgagtttgaggccctgggcttcatgaacgaagatcattggttttctcgcgagaatagcctttccggggtggaaggagagggcctgcacaaactcgggtacatcctgagagacatctctaagattcccggaggcaacatgtacgctgatgacacggccgggtgggatacacggatcaccgaggacgatcttcagaatgaagctaaaattacagacatcatggagcctgaacatgccctgctcgcgaccagcattttcaagctgacgtatcagaacaaagttgtgcgcgtccaaagacccgccaagaacggcaccgtgatggatgtcatctcccggcgcgaccagagaggatctggccaggtggggacatacggactgaatacctttacaaacatggaggttcagctcatccggcaaatggaaagcgagggcattttcctgccgtccgagcttgaaacccctaatctggctgagagagtgctcgattggctggaaaagcacggggccgagcgccttaaacggatggctatctctggagacgactgtgtcgtgaagcccattgatgacagatttgccacagcgctgaccgccctcaacgatatgggcaaagtgcgcaaggacatccctcagtgggaacccagcaaagggtggaatgattggcagcaggttcctttctgctcccaccattttcaccaactgattatgaaggacggccgggagatcgtggtcccctgtagaaaccaggatgagctggtgggacgcgctcgggttagccagggcgccgggtggtctctcagagaaacggcttgcctgggaaagtcctatgcccaaatgtggcagcttatgtacttccatcgccgggacctgagactcgctgccaatgcgatctgtagcgccgtgccggtcgattgggtgcctacatctcgcaccacctggtccattcacgctcaccatcagtggatgacaaccgaggacatgctgagcgtctggaaccgggtgtggatcgaagagaatccctggatggaagataaaacacacgtttcctcttgggaggaggtgccctatcttggcaagagagaagaccagtggtgcgggagcctgattggactcacggcccgggccacctgggctacaaacatccaagtcgccattaatcaggtgagacgcctgatcggcaacgagaattacctggactatatgacctccatgaaacggtttaagaacgaaagcgatcctgagggggcgctctggtga

SEQ ID NO: 18645 - RNA, 9879 nt, synthetic construct
  misc_feature 1..9879: note = derived and/or modified CDS sequence (opt5) from DENV-1__KJ189328__SS-prME
  source 1..9879: mol_type = other RNA
agcgtgacaatgctgctcatgctgcttcccacagctctggctttccacctcacgaccagaggcggggagcctcatatgatcgtctccaagcaggaacggggaaaatctctgctttttaagacaagcgctggcgttaacatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcacagaagagagaagcggtctgtcgccctggctcctcatgtggggctcggactggaaacacgcaccgagacgtggatgagctccgaaggcgcctggaaacagattcagagagttgagacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagactttgttgagggactctccggcgccacatgggtggatgtcgtgctggaacacgggagctgtgtgacgaccatggctaagaataaacccacactggacatcgagctcctgaagaccgaagtcacaaaccctgccattcttcggaaactgtgcatcgaggcgaagatttctaataccacgacagattcccgctgtccgacccagggagaagccaccctcgttgaggagcaggacgctaacttcgtgtgcagacggacatttgtggatcgcggctggggcaatgggtgtggactgttcggcaaagggagccttctgacctgcgccaagtttaagtgcgtcacaaaactcgaaggaaagatcgtgcagtacgagaacctgaaatattctgttatcgtgacggtccacaccggcgaccaacatcaggtggggaatgaaacaaccgagcacggaacaattgctaccatcacgccccaggcccctacctccgaaattcagctgacagattacggcgccctcaccctggactgtagccccagaacaggccttgacttcaacgagatggttctgctcaccatgaaggagaaatcttggctggtgcataagcaatggtttcttgatctgcctctcccctggacgtccggggctagcacatcccaggaaacctggaatcggcaggacctgctggtcacattcaaaaccgcgcacgccaagaagcaagaggtggtcgtgctcggatctcaggaaggcgctatgcacaccgccctgacaggggccacggagatccagaccagcggaacaaccacaatttttgctggccatcttaaatgccgcctgaagatggataaactcaccctgaaggggacgtcctatgttatgtgtacaggcagcttcaaactggaaaaggaggtggccgagacccagcacggaaccgtccttgtgcaagttaagtacgaaggcacagacgcgccgtgcaaaatccctttctctacccaggatgagaagggggtgacacagaacggaagactcatcacggctaatcccattgtcaccgacaaagaaaagcctgtgaacatcgagacagagccgccctttggcgaatcctatattgtggttggggccggagagaaagccctgaagctgagctggttcaagaaaggctctagcatcgggaagatgtttgaagctaccgcccggggcgctagacgcatggccattctcggagatacagcgtgggacttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgattctggatgcgtgatcaactggaaaggcagagagctgaagtgtgggtccggaattttcgtcacaaacgaagtgcacacctggacggagcagtataagtttcaggctgacagccctaaacgcctctccgccgcgatcggcaaggcctgggaggaaggggtttgcggcattcggtctgctacaagactggagaatatcatgtggaaacagatcagcaacgaacttaatcatattctgctcgagaacgatatgaagttcaccgtggtcgtgggagacgccaatggcatcctggctcaagggaaaaagatgattcgcccgcagcccatggaacacaaatactcctggaagtcttggggaaaggccaaaatcattggcgccgacatccagaacaccacatttatcattgatgggcctgacacccccgagtgtcctgataatcagcgggcttggaacatctgggaggtggaagactatggattcggcatttttacgacaaatatctggctgaaacttagagatagctacacccaaatgtgcgaccaccgcctcatgtccgcggccattaaagatagcaaggctgtccatgccgacatgggctattggatcgagtctgagaagaatgagacatggaagctggcccgggcttccttcatcgaagttaagacctgtacatggcccaaaagccacaccctgtggtctaatggggtgctcgagtccgagatgattatcccgaagatttacggaggccctatcagccagcataactatagacccgggtacttcacgcagaccgccggaccttggcacctgggcaaacttgaactggattttgacctctgcgaggggacaaccgtggtcgtggatgaacactgcggaaatcgcggcccctctctgcggacaaccacggttacaggcaagattatccatgagtggtgttgcagaagctgtaccctgcctccccttcggttccgcggggaggacggatgctggtacggcatggaaatcagaccggtgaaagagaaggaagagaacctcgtccggtccatggtgagcgcggggtctggagaagttgattcctttagcctgggcattctgtgtgtgtccatcatgattgaggaggtcatgagatctcgctggagccggaagatgctcatgacagggaccctggctgtgttccttctgctcatcatgggacaactgacctggaaagacctgattagactttgcatcatggttggcgccaatgcctccgaccgcatgggcatggggacaacgtatctggctctcatggccacctttaagatgagacctatgttcgcggtgggactgctctttcggcgcctgacatctagagaagtccttctgctcaccattggcctgagcctggtggcttccgtggagcttcccaactctctggaagaactcggggatggactggccatgggcatcatgatgctcaaactgcttacagagttccacccccatcagctgtggaccacgctcctgagcctgacatttatcaagaccaccctttccctggactacgcctggaaaacaaccgctatggccctcagcattgtctctctgttccctctctgtctgtccacaacgagccagaagaccacatggcttccggttctgctggggtcttttggatgcaagcccctcaccatgttcctgatcacagagaacaaaatttggggccggaagtcctggcctcttaatgagggcatcatggctattgggatcgtgagcatcctgctctcttccctgctcaaaaacgatgtgcccctggccggacctcttattgcgggcgggatgctgatcgcctgttatgtcattagcggatccagcgctgacctgtctctcgaaaaggccgctgaggtgagctgggaacaggaggccgaacactccggcacctctcataatatcctggttgaggtgcaagatgacgggacgatgaaaattaaggatgaggaacgcgacgatacccttacaatcctgctcaaagccaccctgctcgctgtcagcggagtgtaccccatgtccatccctgcgacactgtttgtttggtatttctggcagaagaagaaacagagatctggcgtgctttgggacacccccagcccgcctgaggtcgaacgggccgtgctggatgacggcatttaccgcatcctgcagagagggctcctgggacggtcccaagtcggcgtgggggttttccaggatggagtgtttcacacaatgtggcacgtcacgcgcggcgctgtgcttatgtatcaggggaagagactggagccctcttgggccagcgttaaaaaggacctcatttcctacggaggcggctggcggttccaggggagctggaacaccggagaggaagtgcaagtcatcgccgtggagcctggcaaaaatcccaagaacgtgcagacaaccccggggacctttaagacacctgaaggagaggttggcgctattgccctggacttcaaacccgggacgtctggatcccctatcgtcaatagagaaggcaagattgtgggcctctacgggaacggagtggtcaccacaagcggcacctatgtgtctgcgatcgctcaggccaaagcctcccaagaggggcccctgcccgagatcgaagatgaggtttttaagaaacgcaatcttacaattatggacctgcatcctggaagcggcaagacccggagatacctgccggctatcgtgcgcgaagccattaagcggaaactcagaacgctgatccttgcgcccacacgcgtcgtggcttccgagatggccgaagccctgaaggggatgcctattcggtatcagaccaccgctgttaaatctgagcacacaggcagagagatcgtggatctcatgtgccatgccaccttcacaatgcgcctgctgagccccgtccgggtgcctaactacaatatgatcattatggacgaagctcactttaccgatcccgcctccatcgcggccagaggatatattagcacgcgggttggcatgggggaggctgccgctatcttcatgacagccacccctccgggatctgtggaagcctttccccagtccaacgctgtcattcaggacgaggaacgcgatatccctgagagaagctggaactctggctacgactggatcacagatttccccgggaagaccgtgtggtttgtgcctagcattaaatccggaaacgacatcgcgaattgtctccggaagaacggcaagcgcgtcattcaactttctagaaaaacgttcgataccgagtatcagaagaccaagaataatgactgggactacgttgtgaccacagatatcagcgaaatgggggccaacttccgggctgacagagtgattgatccccgccggtgcctgaagccggtcatcctgaaagacggccctgagagagtgattctcgccggacccatgcccgttaccgtggcctccgctgcccagcgccggggcagaatcgggcgcaatcagaacaaggaaggagatcaatacgtctatatgggccagcctctgaataacgacgaggatcatgcgcactggacagaggctaagatgcttctggacaatatcaacacccccgaagggattatccctgccctctttgagccggaacgggagaaatctgccgctattgatggagaatacagactgcgcggcgaggccagaaagacgttcgtggagctgatgcggcgcggggacctccccgtttggcttagctataaagtggcgtccgaaggctttcagtacagcgatagacggtggtgcttcgacggagagcgcaataaccaggtcctggaagagaatatggatgtggaaatctggacaaaggagggcgagcgcaaaaagctgcggcctagatggctcgacgcccgcacctattctgaccccctggcccttcgggaatttaaagagttcgccgctgggagacgctccgtcagcggagatctgattctcgaaatcggcaagctgcctcaacacctgaccctccgggcccagaacgctcttgacaatctggtgatgctgcataactccgagcaagggggaaaggcctacagacacgcgatcgaagaactccccgatacaattgagaccctgatgcttctggccctcatcgctgttctgacaggcggcgtgacgctgtttttcctctctgggaaaggacttggcaagaccagcattgggctgctgtgtgtgacagcctcctctgctctcctgtggatggccagcgtcgaaccgcattggatcgccgcttccattatccttgagtttttcctgatggttctcctgatccctgaacccgaccggcagcgcacccctcaagataatcagctggcgtatgtggtgattggactcctttttatgatcctgacagtcgccgctaacgagatgggcctgctcgagaccacgaaaaaggacctggggattggacacgtggccgccgaaaaccaccagcatgctaccatgcttgatgttgacctgagacccgccagcgcgtggacactctacgccgtggctaccacagtcatcacccctatgatgcggcacacgattgagaatacaaccgccaacatctctctgacagctattgccaatcaagcggccatcctgatgggcctcgataaaggctggcccatctccaagatggacattggggtgccgcttctggctctgggatgctacagccaggtcaaccctctcaccctgaccgccgctgtgcttatgctggttgcccattatgctatcattggccccgggctccaggccaaggcgacacgcgaagcccagaaaagaacggctgccggaatcatgaagaatcccaccgtggatggcattgtcgctatcgacctggatcctgtggtttacgacgccaaattcgagaagcaactggggcagatcatgctccttattctgtgtacatctcagatcctgctcatgcggaccacatgggccctgtgcgaatccattacccttgcgacgggaccgctgacaaccctctgggagggcagccccggcaaattttggaacaccacaatcgctgtgtctatggccaatattttccgcgggagctatctggctggagccggcctggccttctccctcatgaagtctcttgggggaggcagacgggggaccggagctcagggcgagacactgggcgaaaagtggaaacgccaactgaaccagctcagcaagtccgagtttaatacgtacaaaagaagcgggatcatggaagtcgaccggtccgaggccaaggaaggactgaaaagaggcgagaccacaaagcacgcggtgtctcgcgggaccgccaaacttcggtggttcgtggagagaaacctggttaaacctgaaggaaaggtcatcgatctcggctgtgggcgcggaggctggagctattactgcgctggcctgaaaaaggtgacagaggtgaaagggtataccaagggaggccccgggcatgaggaacctattcccatggccacgtacggatggaatctggtcaaactccactccggcaaggacgtgtttttcatgcctccggaaaagtgtgatacccttctgtgcgacatcggggagtctagccccaaccctacaattgaggaaggacggaccctgagagttctcaaaatggtggagccctggctgcgcggcaatcagttttgtatcaagattcttaacccttacatgccctccgtcgtggaaacactggagcagatgcaacggaaacacggcgggatgctcgttagaaatccgctgtctcgcaacagcacccatgagatgtattgggtgtcctgcggaacaggcaatatcgtcagcgctgtgaacatgacctctcggatgctgctcaacagattcacgatggcccaccgcaagcctacatacgaacgggatgttgacctgggggcgggaaccagacatgtggccgtcgagcccgaagtggctaatcttgatattatcggccagcgcatcgagaacattaaaaatgaacacaagtccacctggcactatgacgaggataacccctacaagacatgggcctatcatgggagctacgaggtgaaaccttctggatccgctagctctatggtcaatggcgttgtgagactgctcacgaagccctgggacgtgatccctatggtcacccagattgccatgacagataccacaccgtttggccaacagcgggtgttcaaagaaaaggttgacacccgcacacccagagctaaacgggggaccacgcagatcatggaggtgaccgccaagtggctgtggggatttctttccagaaacaagaaacctcggatttgtacacgcgaagagttcaccagaaaggtccggagcaatgcggccatcggcgctgtgtttgttgacgaaaaccagtggaactccgccaaagaggctgtggaggatgaacgcttctgggacctggtccacagagagcgggaactccataagcaagggaaatgcgccacatgcgtgtataacatgatgggaaagcgcgagaagaaactgggcgaatttgggaaggccaaaggcagcagagcgatctggtacatgtggctgggagctcggttcctcgagttcgaggccctgggctttatgaatgaagatcactggttctctcgcgagaacagcctttccggggttgaaggagagggcctgcataagctcgggtacattctgagagacatctctaaaattcccggaggcaatatgtatgccgatgacaccgctgggtgggatacgcggatcacagaggacgatcttcagaacgaagccaagattaccgacatcatggagcctgaacacgctctgctcgccacaagcatctttaaactgacctaccagaataaggtggtccgcgtgcagagacccgcgaagaacggcacggtcatggatgtgatttcccggcgcgaccaaagaggatctggccaggttgggacctatggactgaacacattcaccaatatggaggtgcagctcatccggcagatggaaagcgagggcatttttctgccgtccgagcttgaaacacctaacctggccgagagagtcctcgattggctggaaaaacacggggctgagcgccttaagcggatggccatctctggagacgactgtgtggtgaaacccattgatgacagattcgctaccgccctgacagcgctcaatgatatgggcaaggttcgcaaagacatccctcaatgggaacccagcaaggggtggaacgattggcaacaggtgcctttttgctcccatcacttccatcagctgatcatgaaggacggccgggagattgtcgtgccctgtagaaatcaagatgagctggttggacgcgcccgggtgagccagggcgctgggtggtctctcaaagaaaccgcctgcctgggaaagtcctacgctcagatgtggcaacttatgtattttcacagacgcgacctgcggctcgccgctaacgccatctgtagcgcggtcccggtggattgggtccctacgtctagaacaacctggtccattcacgcccatcaccagtggatgaccacagaggacatgctgagcgtgtggaatcgcgtttggatcgaagagaacccctggatggaagataaaacccatgtgtcctcttgggaggaggtcccctaccttggcaagcgggaagaccagtggtgcgggagcctgattggactcacagctagagccacgtgggccaccaatatccaggtggctattaaccaagttcggagactgatcggcaatgagaactatctggactacatgacatccatgaaacgcttcaagaatgaaagcgatcctgagggggccctctggtga

SEQ ID NO: 18646 - RNA, 9879 nt, synthetic construct
  misc_feature 1..9879: note = derived and/or modified CDS sequence (opt5) from DENV-1__KJ189329__SS-prME
  source 1..9879: mol_type = other RNA
tccgtgaccatgctgctgatgctgcttcccaccgccctggctttccacctcacgaccagaggcggggaacctcatatgatcgtctccaagcaggaacggggaaaatctctgctttttaagacaagcgccggcgttaacatgtgcaccctgattgcgatggacctcggggagctgtgtgaagatacaatgacctacaaatgcccgcagatcacagaggctgaacccgacgatgtggactgttggtgcaatgccaccgatgcctgggtgacgtatggaacctgttcccagacaggcgagcaccgcagagacaagcggtctgtcgctctggcccctcatgtggggctcggactggagacccgcacagaaacctggatgagctccgagggcgcttggaaacagattcagagagttgaaacgtgggcccttcggcaccccggcttcacagtgatcgcgtttttcctggcccatgctattgggacctctatcacacagaagggaatcatttttatcctcctgatgcttgtcacccctagcatggccatgcgctgcgtgggcattgggaacagagatttcgttgagggactgtccggcgctacctgggtggacgtcgtgctcgagcacgggagctgtgtgacaacgatggccaagaataaacccaccctggatatcgaactgctcaagacagaggtcaccaaccctgcgattctgcggaaactttgcatcgaagccaagatttctaatacaaccacggactcccgctgtccgacacagggagaggctaccctggttgaagaacaggatgccaactttgtgtgcagacggaccttcgtggaccgcggctggggcaatgggtgtggactctttggcaaagggagcctgcttacatgcgctaagttcaagtgcgtcaccaaactggagggaaagatcgtgcagtacgaaaacctcaaatattctgttatcgtgacagtccacacgggcgatcaacatcaggtggggaatgagaccacagaacacggaaccattgccacaatcacaccccaggcccctacgtccgagattcagctgaccgactacggcgctctgacactcgactgtagccccagaaccggcctggattttaacgaaatggttcttctgacaatgaaggagaaatcttggctcgtgcataagcaatggttcctggaccttcctctgccctggacctccggggcgagcacgtcccaggagacatggaatcggcaggatctcctggtcacctttaaaacagcccacgctaagaagcaagaagtggtcgtgctgggatctcaggagggcgccatgcacaccgccctcaccggggctacagaaatccagacgagcggaaccacaaccattttcgccggccatctgaaatgccgccttaagatggacaaactgacactcaaggggacctcctatgttatgtgtacgggcagcttcaaactggagaaggaagtggcggagacacagcacggaaccgtcctggtgcaagttaagtacgagggcaccgatgctccgtgcaaaatccctttttctacacaggacgaaaagggggtgacccagaacggaagacttatcacagccaatcccattgtcacggataaagagaagcctgtgaacatcgaaaccgagccgcccttcggcgagtcctatattgtggttggggccggagaaaaagctctcaagctgagctggtttaagaaaggctctagcatcgggaagatgttcgaggccacagctcggggcgccagacgcatggcgattctgggagacaccgcctgggattttggctccatcgggggagtcttcacatctgtgggcaaactcgtgcatcaggtctttgggaccgcttacggagtgctgttcagcggcgtttcctggacgatgaagatcgggattggcatccttctgacctggctcggactgaatagccggtctacatccctgagcatgacctgtattgccgtgggcatggtcacactttacctcggggtgatggttcaagctgactctggatgcgtgatcaactggaaaggcagagaactgaagtgtgggtccggaatttttgtcaccaacgaggtgcacacatggaccgaacagtataagttccaggccgatagccctaaacgcctgtccgcggccatcggcaaggcttgggaggagggggtttgcggcattcggtctgccacgagactcgaaaatatcatgtggaaacagatcagcaacgagctgaatcatattcttctggaaaacgacatgaagtttacagtggtcgtgggagacgctaatggcatcctcgcccaagggaaaaagatgattcgcccgcagcccatggagcacaaatactcctggaagtcttggggaaaggccaaaatcattggcgctgatatccagaacaccaccttcatcattgacgggcctgatacacccgaatgtcctgacaatcagcgggcgtggaacatctgggaggtggaggattatggatttggcattttcaccacgaatatctggctgaagctgagagacagctacacacaaatgtgcgatcaccgccttatgtccgccgctattaaagacagcaaggccgtccatgccgatatgggctattggatcgaatctgagaaaaacgaaacctggaagctcgctcgggcctccttcatcgaggttaagacatgtacctggcccaaaagccacacactgtggtctaatggggtgctggaatccgagatgattatcccgaagatttacggaggccctatcagccagcataactatagatctgggtactttacccagacggcgggaccctggcacctcggcaaactggagcttgacttcgatctgtgcgaagggaccacagtggtcgtggacgagcactgcggaaatcgcggccctagcctccggaccacaaccgttacgggcaagattatccatgaatggtgttgcagatcctgtacactgccccctctgcggtttcgcggggaggatggatgctggtacggcatggagatcagacccgtgaaagaaaaggaggaaaaccttgtccggagcatggtgtctgctgggtccggagaggttgacagcttctccctcggcattctgtgtgcctctatcatgattgaagaggtgatgagaagccgctggtcccggaagatgctgatgaccgggacactcgccgtctttctgcttctggtgatgggacaactcacctggaatgacctgatcagactgtgcattatggttggcgctaacgcctctgatcgcatgggcatggggaccacatatcttgcgctgatggctacgttcaaaatgagaccgatgtttgccgtgggactcctgttccggcgcctcaccagcagagaggtcctgcttctgacaatcggcctctccctggtggcctctgtggaactgcctaacagccttgaggaactgggggacggactcgctatgggcattatgatgctgaagctcctgaccgagtttcagccccaccagctttggacaaccctgctctccctgacgttcatcaaaacaaccctgagccttgattacgcctggaagaccacagctatggccctgtctatcgtctccctctttcccctgtgtctcagcaccacatctcagaaaacgacctggctgcctgttcttctggggtccttcggatgcaagccgctgacaatgtttctcattaccgaaaataagatctggggccggaaaagctggcccctgaacgagggcattatggcgatcgggattgtgtctatccttctgtccagcctcctgaagaatgacgtgcctctcgccggacccctgatcgctggcgggatgcttattgcctgttatgtcatctccggaagctctgctgatctgagcctggagaaagccgccgaagtgtcctgggagcaagaagctgagcattctggcacaagccacaacattctcgttgaagtgcaggacgatgggaccatgaagatcaaagacgaggagcgcgatgacacgctgaccattcttctgaaggcgacactcctggccgtctccggagtgtaccctatgtctatccccgctaccctcttcgtttggtatttctggcagaaaaagaagcagagaagcggcgtgctgtgggatacacctagccctcccgaagtcgagcgggccgtgcttgacgatggcatctaccgcattctgcaaagagggctgctcggacggtctcaggtcggcgtgggggtttttcaggacggagtgttccataccatgtggcacgtcacacgcggcgccgtgctgatgtatcaggggaaaagacttgaacccagctgggcttccgttaagaaagacctgatcagctacggaggcggctggcggtttcaagggtcttggaatacgggagaggaggtgcaggtcattgccgtggaacccggcaagaaccctaaaaatgtgcagaccacacccgggaccttcaagaccccggagggagaagttggcgcgatcgctctcgattttaagcctgggacatccggaagccccattgtcaacagagagggcaaaatcgtgggcctgtacgggaatggagtggtcacgacctctggcacatatgtgtccgccattgcccaagctaaggccagccaggaagggcctctccccgagatcgaggacgaagttttcaaaaagcgcaacctgaccatcatggatcttcaccccggatccggcaaaacacggagatacctgcctgcgattgtgcgcgaggctatcaagcggaagctgagaaccctcattctggccccgacgcgcgtcgtggcctctgaaatggctgaggcccttaaagggatgcccatccggtatcagacaaccgctgttaagagcgaacataccggcagagagattgtggacctgatgtgccacgccacatttaccatgcgcctcctgtcccctgtccgggtgcccaattacaacatgatcatcatggatgaggcgcatttcacagaccctgccagcattgctgccagaggatatatctctacccgggttggcatgggggaagctgccgccatttttatgacggctacaccccctggatccgtggaggcgttcccgcagagcaatgccgtcatccaagatgaagaacgcgacattcccgaaagatcttggaacagcggctacgattggatcaccgactttcctgggaaaacagtgtggttcgtgccctccatcaagtctggaaatgatattgctaactgtctgcggaaaaacggcaagcgcgtcatccagctcagcagaaagaccttcgacacggagtatcagaaaaccaagaataacgactgggattacgttgtgacaaccgacatttccgagatgggggccaattttcgggccgatagagtgatcgaccctcgccggtgccttaaacccgtcattctgaaggatggcccggaaagagtgatcctggctggacctatgcccgttacagtggcctctgcggctcagcgccggggcagaattgggcgcaaccaaaataaagagggagaccagtacgtctatatgggccagcccctcaacaatgatgaagaccacgcccattggaccgaggccaagatgctgcttgataacatcaatacacctgaggggatcattcccgctctgttcgaacctgagcgggaaaagagcgccgcgatcgacggagagtacagactccgcggcgaagccagaaaaacctttgtggagctgatgcggcgcggggatctgccggtttggctctcctataaggtggctagcgagggcttccagtactctgacagacggtggtgctttgatggagaacgcaacaatcaagtccttgaggaaaacatggacgtggagatttggacgaaagaaggcgagagaaagaaactgcggcccagatggctggacgcccgcacatattccgatcctctcgctctgcgggagttcaaggaatttgccgctgggagacgcagcgtctccggagaccttatcctggagattggcaaactcccccagcacctgacctctcgggcccagaatgcgctggataacctcgtgatgcttcacaatagcgaacaagggggaaaggcctacagacatgctatggaggaactgcctgacaccatcgagacactgatgctcctggcccttatcgctgttctgaccggcggcgtgacactcttctttctgtccgggaagggactgggcaaaacgtctattgggctcctttgtgtgaccgccagctccgccctgctgtggatggctagcgtcgagccccactggatcgcggcctctattatcctcgagttctttctgatggttcttctgattccggagcctgatcggcaacgcacaccccaggacaaccagctcgcttatgtggtgatcggactgctgttcatgatcctcaccgtcgccgccaacgaaatgggccttctggagacaaccaagaaagatctggggattggacatgtggctgccgagaatcaccaacacgcgacgatgctcgacgttgatctgagacctgcctccgcttggaccctttacgccgtggctacaaccgtcatcacacccatgatgcggcataccattgaaaacacgacagccaatatcagcctgaccgcgattgccaaccaggctgccatcctcatgggcctggacaagggctggcctatttctaaaatggatatcggggtgcccctgctcgctcttggatgctactcccaggtcaatccgctgacactgaccgccgctgtgctcatgctggttgcccactatgcgatcattggccctgggcttcaggccaaggctacccgcgaggcccaaaagagaacagctgccggaatcatgaaaaaccccacggtggacggcattgtcgccatcgatctggaccccgtggtttacgacgcgaagtttgaaaaacagctcgggcagattatgctgctgatcctctgtaccagccagatccttctgatgcggacaacctgggctctgtgcgagtctattacactcgccaccggacctctgacgacactttgggaaggcagcccgggcaagttctggaataccaccatcgctgtgtccatggccaacattttccgcgggtcttatctggccggagctggcctcgcctttagcctgatgaaatccctcgggggaggcagacgggggacaggagcgcaaggcgagaccctcggcgagaagtggaagcgccagcttaatcagctgagcaaatccgagttcaacacatacaagagatctgggatcatggaggtcgatcggagcgaagccaaagagggactgaagagaggcgaaacgaccaaacatgctgtgtcccgcgggacagccaagctccggtggtttgtggagagaaatctggttaagcccgagggaaaagtcattgaccttggctgtgggcgcggaggctggtcttattactgcgctggcctgaagaaagtgaccgaagtgaaggggtatacaaaaggaggccctgggcacgaggaacccatccctatggccacctacggatggaacctcgtcaagctgcatagcggcaaagatgttttctttatgccccctgagaagtgtgacacgctgctctgcgatatcggggaatcctctccgaatcccaccattgaggagggacggacacttagagtgctgaagatggtggaaccttggctgcgcggcaaccagttctgtatcaaaattctcaatccctacatgcctagcgtcgtggagaccctggaacaaatgcagcggaagcacggcgggatgcttgttagaaaccccctgtcccgcaatagcacacacgagatgtattgggtgtcttgcggaaccggcaacatcgtctccgcggtgaacatgacaagccggatgctcctgaatagatttaccatggcccatcgcaaaccgacgtacgagcgggacgttgatctgggggctggaacaagacacgtggccgtcgaacctgaggtggctaacctcgacattatcggccagcgcattgaaaatatcaagaacgagcataaatctacctggcactatgatgaagacaatccctacagaacctgggcctatcacgggtcctacgaggtgaagcccagcggatctgcttccagcatggtcaacggcgttgtgcggctgcttacaaagccttgggatgtgatccccatggtcacgcaaattgccatgaccgacacaacccctttcggccagcagcgcgtgtttaaagagaaggttgacacaagaaccccgcgggcgaaaagagggacaacccagatcatggaagtgacggccaagtggctgtggggattcctctcccggaataaaaagccccgcatttgtaccagagaggaatttacacggaaggtccgcagcaacgctgccatcggcgctgtgttcgttgatgagaatcaatggaactctgccaaagaagccgtggaggacgagagattttgggatctggtccatcgggaacgcgagcttcacaagcaggggaaatgcgcgacctgcgtgtataatatgatgggaaagagagagaagaagctgggcgagttcgggaaggctaaaggcagccgggccatttggtacatgtggctcggagcccgcttcctggaatttgaggctctgggcttcatgaacgaggaccattggttttccagagaaaattctctcagcggggttgagggagaaggcctgcacaaacttgggtacatcctgcgggatatctccaaaattcctggaggcaacatgtatgccgacgatacagctgggtgggacacccgcatcacggaggatgacctccagaatgaggccaagattacagaaatcatggagcccgaacatgcgctgcttgccacctctattttcaaactgacataccagaacaaggtggtcagagtgcaacggcctgctaaaaacggcaccgtcatggatgtgatcagccgcagagaccagcggggatccggccaggttgggacgtatggactcaatacctttacaaacatggaggtgcagctgatcagacaaatggaatctgagggcattttcctgcccagcgagctcgaaaccccgaatctggccgagcgcgtccttgattggctggaaaagcacggggctgagcggctcaagagaatggccatctccggagacgactgtgtggtgaaacctattgatgaccgctttgcgacagccctgaccgctcttaacgatatgggcaaggttcggaaagacatcccccagtgggaacctagcaaggggtggaatgattggcaacaggtgcccttctgctctcaccattttcaccaactgattatgaaagacggcagagagatcgtcgtgccttgtcgcaaccaggatgagctcgttggacgggccagagtgtcccagggcgctgggtggagcctgcgcgaaacagcctgcctgggaaagtcttacgctcaaatgtggcagctcatgtatttccatcggagagacctgcgccttgccgcgaatgccatctgttccgctgtccccgtggattgggtcccgaccagccggacgacatggtccattcacgcccaccatcagtggatgaccaccgaggacatgctgtctgtgtggaacagagtttggatcgaagagaatccttggatggaagataagacacacgtgagctcctgggaggaggtcccctacctcggcaaacgggaagaccagtggtgcgggagcctgattggacttaccgccagagctacatgggccacgaacatccaagtggcgattaatcaggttcgccggctgatcggcaacgagaattatctcgactacatgacctctatgaagagatttaaaaacgaatccgatcccgagggggctctgtggtga

SEQ ID NO: 18647 - RNA, 9879 nt, synthetic construct
  misc_feature 1..9879: note = derived and/or modified CDS sequence (opt5) from DENV-1__KJ189331__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgatcgggacactggccgtcttccttctgctcattatgggacaactgacctggaatgacctgatcagactttgcattatggtgggcgccaacgcttccgatcgcatgggcatggggaccacatatctggccctcatggcgacgtttaaaatgagacctatgttcgctgttggactgctctttcggcgcctgacctctagagaggtgcttctgctcacaatcggcctgagcctggtcgcctccgtggaacttcccaactctctggaggaactcggggacggactggccatgggcatcatgatgctcaagctgcttaccgagttccagccccaccagctgtggacaaccctcctgagcctgacgtttattaaaacaaccctttccctggattacgcttggaagaccacagccatggctctcagcatcgtgtctctgttccctctctgtctgtccaccacaagccagaaaacgacctggcttccggtcctgctggggtcttttggatgcaagcccctcacaatgttcctgattaccgaaaataagatctggggccggaaatcctggcctcttaacgagggcattatggccatcgggatcgttagcattctgctctcttccctgctcaagaatgacgtgcccctggcgggacctcttatcgccggcgggatgctgattgcttgttatgtgatcagcggatccagcgccgatctgtctctcgagaaaacagctgaagtcagctgggagcaagaagccgagcattccggcacctctcacaacattctggtggaagttcaggacgatgggacgatgaagatcaaagacgaggagcgcgatgacacccttacaatcctgctcaaggccaccctgctcgctgtgagcggagtctaccccatgtccattcctgcgacactgtttgtgtggtatttctggcagaaaaagaagcagagatctggcgttctttgggatacccccagcccgcctgaagtggagcgggccgtcctggacgatggcatctaccgcattctgcaaagagggctcctgggacggtcccaggtgggcgtcggggtgttccaggacggagtttttcatacaatgtggcacgtgacgcgcggcgctgtccttatgtatcaggggaaaagactggaaccctcttgggccagcgtgaagaaagacctcatctcctacggaggcggctggcggttccaagggagctggaataccggagaggaggttcaggtgattgccgtcgaacctggcaagaaccccaaaaatgtgcagacaaccccggggacctttaagacacctgagggagaagtgggcgctatcgccctggatttcaagcccgggacgtctggatcccctattgttaacagagagggcaaaatcgtcggcctctacgggaatggagtggtgaccacaagcggcacctatgtctctgcgatcgctcaagccaaggcctcccaggaagggcccctgcccgagattgaggacgaagtgtttaaaaagcgcaaccttacaatcatggatctgcaccctggaagcggcaaaacccggagatacctgccggctattgttcgcgaggccatcaagcggaagctcagaacgctgattcttgcgcccacacgcgtggtcgcttccgaaatggccgaggccctgaaagggatgcctatccggtatcagaccaccgctgtgaagtctgaacatacaggcagagagatcgttgacctcatgtgccacgccaccttcacaatgcgcctgctgagccccgtgcgggtccctaattacaacatgattatcatggatgaggctcattttaccgaccccgcctccattgcggccagaggatatatcagcacgcgggtgggcatgggggaagctgccgctattttcatgacagccacccctccgggatctgttgaggcctttccccagtccaatgctgtgatccaagatgaagagcgcgacatccctgaaagaagctggaactctggctacgattggattacagacttccccgggaaaaccgtctggtttgtgcctagcatcaagtccggaaatgatattgcgaactgtctccggaaaaacggcaagcgcgtgatccagctttctagaaagacgttcgacaccgagtatcagaaaacaaagaataacgactgggattacgtcgttaccacagacattagcgagatgggggccaatttccgggctgatagagtgatcgacccccgccggtgcctgaaaccggtgattctgaaggatggccctgaaagagtcatcctcgccggacccatgcccgtgaccgttgcctccgctgcccagcgccggggcagaatcgggcgcaaccaaaataaagagggagaccagtacgtgtatatgggccagcctctgaacaatgatgaagaccacgcgcattggacagaggctaagatgcttctggataacattaatacccccgaggggatcattcctgccctctttgaaccggagcgggaaaagtctgccgctatcgacggagagtacagactgcgcggcgaagccagaaaaacgttcgtcgagctgatgcggcgcggggatctccccgtgtggcttagctataaggttgcgtccgagggctttcagtacagcgacagacggtggtgcttcgatggagaacgcaacaatcaagtgctggaggaaaacatggacgtcgagatttggacaaaagaaggcgagagaaagaaactgcggcctagatggctcgacgcccgcacctattctgatcccctggctcttcgggagtttaaggaattcgccgctgggagacgctccgtgagcggagacctgatcctcgagatcggcaaactgcctcagcacctgaccctccgggcccagaatgctcttgataacctggccatgctgcacaattccgaacaggggggaaaggcgtacagacatgccatggaggaactccccgacacaattgagaccctgatgcttctggctctcatcgccgtcctgacaggcggcgtgacgctgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgatccctgagcccgatcggcaacgcacccctcaggacaaccagctggcctatgtcgttattggactcctttttatgatcctgacagtggctgccaacgaaatgggcctgctcgagaccacgaagaaagatctggggattggacatgtggccgctgagaatcaccaacacgccaccatgcttgacgtcgatctgagacccgcgagcgcctggacactctacgctgtggccaccacagttatcacccctatgatgcggcatacgattgaaaacacaaccgctaatatctctctgacagccattgcgaaccaggccgctatcctgatgggcctcgacaagggctggcccatctccaaaatggatattggggtgccgcttctggccctgggatgctacagccaggtcaatcctctcaccctgaccgctgccgtgcttatgctggtcgctcactatgccatcattggccccgggctccaggcgaaggccacacgcgaggctcaaaagagaacggccgctggaatcatgaaaaaccccaccgtggacggcattgttgccatcgatctggaccctgtggtctacgacgccaagttcgaaaaacagctggggcagatcatgctccttattctgtgtacatctcagatcctgctcatgcggaccacatgggcgctgtgcgagtccattacccttgctacgggaccgctgacaaccctctgggaaggcagccccggcaagttttggaataccacaatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggatcatggaggttgatcggtccgaagcgaaagagggactgaagagaggcgaaaccacaaaacatgccgtgtctcgcgggaccgctaagcttcggtggttcgtcgagagaaatctggtgaagcctgagggaaaagtgatcgacctcggctgtgggcgcggaggctggagctattactgcgccggcctgaagaaagttacagaagtcaaggggtataccaaaggaggccccgggcacgaggaacctattcccatggctacgtacggatggaacctggtgaagctccattccggcaaagatgtgtttttcatgcctccggagaagtgtgacacccttctgtgcgatatcggggaatctagccccaatcctacaattgaggagggacggaccctgagagtcctcaagatggttgaaccctggctgcgcggcaaccagttttgtatcaaaattcttaatccttacatgccctccgtggtggagacactggaacaaatgcagcggaagcacggcgggatgctcgtcagaaacccgctgtctcgcaatagcacccacgagatgtattgggtgtcctgcggaacaggcaacatcgttagcgccgtgaacatgacctctcggatgctgctcaatagattcacgatggcgcatcgcaaacctacatttgagcgggacgtcgatctgggggccggaaccagacacgtggctgttgaacccgaggtggccaaccttgacattatcggccagcgcatcgaaaatattaagaacgagcataaatccacctggcactacgatgaagacaatccctataagacatgggcttaccacgggagctatgaggtcaagccttctggatccgccagctctatggtgaacggcgtggtcagactgctcacgaaaccctgggatgttatccctatggtgacccaaattgctatgacagacaccacaccgttcggccagcagcgggtgtttaaggagaaagtcgacacccgcacacccagagccaagcgggggaccacgcagatcatggaagtgaccgcgaaatggctgtggggattcctttccagaaataagaagcctcggatttgtacacgcgaggaatttaccagaaaagttcggagcaacgccgctatcggcgccgtgttcgtcgatgagaatcaatggaactccgctaaggaagccgtggaggacgagcgcttttgggatctggttcatagagaacgggagctccacaaacaggggaagtgcgccacatgcgtgtacaatatgatgggaaaacgcgaaaagaagctgggcgagttcgggaaagcgaagggcagcagagctatctggtatatgtggctgggagcccggttcctcgaatttgaggccctgggcttcatgaacgaggaccattggttttctcgcgaaaatagcctttccggggtcgagggagaaggcctgcacaaactcgggtacattctgagagatatctctaagattcccggaggcaacatgtacgctgacgataccgccgggtgggacacgcggatcacagaggatgaccttcagaatgaggctaaaattaccgatatcatggaacctgagcatgccctgctcgcgacaagcatcttcaagctgacctatcagaacaaagtggttcgcgtgcaaagacccgccaagaacggcacggtcatggacgtgatttcccggcgcgatcagagaggatctggccaggtcgggacctacggactgaatacatttaccaacatggaagtgcagctcatccggcaaatggagagcgaaggcattttcctgccgtccgagcttgagacacctaatctggctgaaagagttctcgactggctggagaagcacggggccgaacgccttaaacggatggctatctctggagacgattgtgtggtcaagcccattgacgatagatttgccaccgcgctgacagccctcaacgacatgggcaaagtgcgcaaggatatccctcagtgggagcccagcaaagggtggaatgactggcagcaggtgcctttctgctcccaccattttcaccaactgatcatgaaggatggccgggaaattgttgtgccctgtagaaaccaggacgagctggtcggacgcgctcgggtgagccagggcgccgggtggtctctcagagagaccgcttgcctgggaaagtcctatgcccaaatgtggcagcttatgtacttccatcgccgggatctgagactcgctgccaatgcgatctgtagcgccgttccggtggactgggtccctacgtctcgcacaacctggtccattcacgctcaccatcagtggatgaccacagaagatatgctgagcgtgtggaaccgggtctggatcgaggaaaatccctggatggaggacaaaacccacgtgtcctcttgggaagaggttccctatcttggcaagagagaggaccagtggtgcgggagcctgattggactcacagcccgggccacgtgggctaccaacatccaagtggccattaatcaggtcagacgcctgatcggcaacgaaaattacctggattatatgacatccatgaaacggtttaagaacgagagcgaccctgaaggggcgctctggtga

SEQ ID NO: 18648 - RNA, 9879 nt, synthetic construct
  misc_feature 1..9879: note = derived and/or modified CDS sequence (opt5) from DENV-1__KJ189332__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaaccatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagagcaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattaccccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagcccccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtgattaactggaaaggcagagaactgaagtgtgggtccggaatcttcgtcaccaacgaggtgcacacgtggacagaacagtataagtttcaggctgatagccctaaacgcctctccgccgcgattggcaaggcctgggaggagggggtttgcggcatccggtctgctaccagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacacaacctttatcatcgacgggcctgatacgcccgaatgtcctgacaatcagcgggcttggaacatttgggaggtggaggattatggattcggcatctttacaaccaatatttggctgaagcttagagacagctacacacaaatgtgcgatcaccgcctcatgtccgcggccatcaaagacagcaaggctgtccatgccgatatgggctattggattgaatctgagaaaaacgaaacctggaagctggcccgggcttccttcatcgaggttaagacatgtacctggcccaaaagccacacgctgtggtctaatggggtgctcgaatccgagatgatcattccgaagatctacggaggccctattagccagcataactatagacccgggtacttcacccagacagccggaccttggcacctgggcaaacttgagctggactttgatctctgcgaagggaccacagtggtcgtggacgagcactgcggaaatcgcggcccctctctgcggaccacgacagttaccggcaagatcattcatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggaccctggccgtcttccttctgctcattatgggacaactgacatggaatgacctgatcagactttgcattatggtgggcgccaacgcttccgatcgcatgggcatggggacgacctatctggccctcatggcgacatttaaaatgagacctatgttcgctgttggactgctctttcggcgcctgacctctagagaggtgcttctgctcacaatcggcctgagcctggtcgcctccgtggaacttcccaactctctggaggaactcggggacggactggccatgggcattatgatgctcaagctgcttaccgagttccagccccaccagctgtggacgacactcctgagcctgacctttatcaaaaccacactttccctggattacgcttggaagaccacagccatggctctcagcatcgtgtctctgttccctctctgtctgtccacgaccagccagaaaacaacctggcttccggtcctgctggggtcttttggatgcaagcccctcacaatgttcctgattaccgaaaataagatctggggccggaaatcctggcctcttaacgagggcattatggccatcgggattgttagcatcctgctctcttccctgctcaagaatgacgtgcccctggcgggacctcttatcgccggcgggatgctgattgcttgttatgtgatcagcggatccagcgccgatctgtctctcgagaaaacggctgaagtcagctgggagcaagaagccgagcattccggcacctctcacaacattctggtggaagttcaggacgatgggacaatgaagatcaaagacgaggagcgcgatgacacccttacaattctgctcaaggccaccctgctcgctgtgagcggagtctaccccatgtccatccctgcgacactgtttgtgtggtatttctggcagaaaaagaagcagagatctggcgttctttgggatacgcccagcccgcctgaagtggagcgggccgtcctggacgatggcatctaccgcattctgcaaagagggctcctgggacggtcccaggtgggcgtcggggtgttccaggacggagtttttcataccatgtggcacgtgacacgcggcgctgtccttatgtatcaggggaaaagactggaaccctcttgggccagcgtgaagaaagacctcatctcctacggaggcggctggcggttccaagggagctggaataccggagaggaggttcaggtgattgccgtcgaacctggcaagaaccccaaaaatgtgcagaccacaccggggacgtttaagacccctgagggagaagtgggcgctatcgccctggatttcaagcccgggacatctggatcccctattgttaacagagagggcaaaatcgtcggcctctacgggaatggagtggtgaccacaagcggcacctatgtctctgcgattgctcaagccaaggcctcccaggaagggcccctgcccgagatcgaggacgaagtgtttaaaaagcgcaaccttacgatcatggatctgcaccctggaagcggcaaaacacggagatacctgccggctattgttcgcgaggccatcaagcggaagctcagaaccctgattcttgcgcccacccgcgtggtcgcttccgaaatggccgaggccctgaaagggatgcctatccggtatcagacaaccgctgtgaagtctgaacatacaggcagagagattgttgacctcatgtgccacgccaccttcacgatgcgcctgctgagccccgtgcgggtccctaattacaacatgatcatcatggatgaggctcattttacagaccccgcctccattgcggccagaggatatatcagcacccgggtgggcatgggggaagctgccgctattttcatgacagccacccctccgggatctgttgaggcctttccccagtccaatgctgtgatccaagatgaagagcgcgacattcctgaaagaagctggaactctggctacgattggatcacggacttccccgggaaaaccgtctggtttgtgcctagcatcaagtccggaaatgatattgcgaactgtctccggaaaaacggcaagcgcgtgatccagctttctagaaagacattcgacaccgagtatcagaaaacaaagaataacgactgggattacgtcgttaccacagacattagcgagatgggggccaatttccgggctgatagagtgatcgacccccgccggtgcctgaaaccggtgattctgaaggatggccctgaaagagtcatcctcgccggacccatgcccgtgaccgttgcctccgctgcccagcgccggggcagaattgggcgcaaccaaaataaagagggagaccagtacgtgtatatgggccagcctctgaacaatgatgaagaccacgcgcattggacggaggctaagatgcttctggataacatcaatacacccgaggggatcattcctgccctctttgaaccggagcgggaaaagtctgccgctatcgacggagagtacagactgcgcggcgaagccagaaaaaccttcgtcgagctgatgcggcgcggggatctccccgtgtggcttagctataaggttgcgtccgagggctttcagtacagcgacagacggtggtgcttcgatggagaacgcaacaatcaagtgctggaggaaaacatggacgtcgagatttggaccaaagaaggcgagagaaagaaactgcggcctagatggctcgacgcccgcacatattctgatcccctggctcttcgggagtttaaggaattcgccgctgggagacgctccgtgagcggagacctgatcctcgagattggcaaactgcctcagcacctgaccctccgggcccagaatgctcttgataacctggccatgctgcacaattccgaacaggggggaaaggcgtacagacatgccatggaggaactccccgacacaatcgagacgctgatgcttctggctctcatcgccgtcctgaccggcggcgtgacactgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgattcctgagcccgatcggcaacgcacccctcaggacaaccagctggcctatgtcgttatcggactcctttttatgatcctgacggtggctgccaacgaaatgggcctgctcgagaccacaaagaaagatctggggattggacatgtggccgctgagaatcaccaacacgccaccatgcttgacgtcgatctgagacccgcgagcgcctggacactctacgctgtggccaccacggttatcacacctatgatgcggcataccattgaaaacacaaccgctaatatctctctgaccgccattgcgaaccaggccgctatcctgatgggcctcgacaagggctggcccatttccaaaatggatatcggggtgccgcttctggccctgggatgctacagccaggtcaatcctctcacactgacggctgccgtgcttatgctggtcgctcactatgccatcattggccccgggctccaggcgaaggccacccgcgaggctcaaaagagaacagccgctggaatcatgaaaaaccccaccgtggacggcattgttgccatcgatctggaccctgtggtctacgacgccaagttcgaaaaacagctggggcagattatgctccttatcctgtgtacatctcagatcctgctcatgcggaccacgtgggcgctgtgcgagtccattacacttgctaccggaccgctgaccacactctgggaaggcagccccggcaagttttggaataccacaatcgccgtgtctatggctaacattttccgcgggagctatctggccggagccggcctggctttctccctcatgaaatctcttgggggaggcagacgggggacgggagcccaaggcgagaccctgggcgagaagtggaagcgccagctgaatcagctcagcaaatccgaatttaacacatacaagagaagcgggatcatggaggttgatcggtccgaagcgaaagagggactgaagagaggcgaaaccacaaaacatgccgtgtctcgcgggaccgctaagcttcggtggttcgtcgagagaaatctggtgaagcctgagggaaaagtgattgacctcggctgtgggcgcggaggctggagctattactgcgccggcctgaagaaagttacggaagtcaaggggtataccaaaggaggccccgggcacgaggaacctatccccatggctacatacggatggaacctggtgaagctccattccggcaaagatgtgtttttcatgcctccggagaagtgtgacacccttctgtgcgatatcggggaatctagccccaatcctacaattgaggagggacggaccctgagagtcctcaagatggttgaaccctggctgcgcggcaaccagttttgtatcaaaattcttaatccttacatgccctccgtggtggagacactggaacaaatgcagcggaagcacggcgggatgctcgtcagaaacccgctgtctcgcaatagcacccacgagatgtattgggtgtcctgcggaacgggcaacatcgttagcgccgtgaacatgacatctcggatgctgctcaatagattcaccatggcgcatcgcaaacctacctttgagcgggacgtcgatctgggggccggaacaagacacgtggctgttgaacccgaggtggccaaccttgacattatcggccagcgcattgaaaatatcaagaacgagcataaatccacgtggcactacgatgaagacaatccctataagacctgggcttaccacgggagctatgaggtcaagccttctggatccgccagctctatggtgaacggcgtggtcagactgctcacaaaaccctgggatgttatccctatggtgacccaaattgctatgacagacaccacaccgttcggccagcagcgggtgtttaaggagaaagtcgacacccgcacgcccagagccaagcgggggaccacacagatcatggaagtgaccgcgaaatggctgtggggattcctttccagaaataagaagcctcggatttgtacacgcgaggaatttaccagaaaagttcggagcaacgccgctatcggcgccgtgttcgtcgatgagaatcaatggaactccgctaaggaagccgtggaggacgagcgcttttgggatctggttcatagagaacgggagctccacaaacaggggaagtgcgccacgtgcgtgtacaatatgatgggaaaacgcgaaaagaagctgggcgagttcgggaaagcgaagggcagcagagctatttggtatatgtggctgggagcccggttcctcgaatttgaggccctgggcttcatgaacgaggaccattggttttctcgcgaaaatagcctttccggggtcgagggagaaggcctgcacaaactcgggtacatcctgagagatatctctaagattcccggaggcaacatgtacgctgacgatacagccgggtgggacacccggatcacagaggatgaccttcagaatgaggctaaaattaccgatatcatggaacctgagcatgccctgctcgcgacgagcattttcaagctgacctatcagaacaaagtggttcgcgtgcaaagacccgccaagaacggcacagtcatggacgtgatctcccggcgcgatcagagaggatctggccaggtcgggacctacggactgaatacatttaccaacatggaagtgcagctcatccggcaaatggagagcgaaggcattttcctgccgtccgagcttgagacacctaatctggctgaaagagttctcgactggctggagaagcacggggccgaacgccttaaacggatggctatctctggagacgattgtgtggtcaagcccattgacgatagatttgccaccgcgctgacggccctcaacgacatgggcaaagtgcgcaaggatatccctcagtgggagcccagcaaagggtggaatgactggcagcaggtgcctttctgctcccaccattttcaccaactgattatgaaggatggccgggaaatcgttgtgccctgtagaaaccaggacgagctggtcggacgcgctcgggtgagccagggcgccgggtggtctctcagagagacagcttgcctgggaaagtcctatgcccaaatgtggcagcttatgtacttccatcgccgggatctgagactcgctgccaatgcgatctgtagcgccgttccggtggactgggtccctacctctcgcaccacatggtccattcacgctcaccatcagtggatgaccacagaagatatgctgagcgtgtggaaccgggtctggatcgaggaaaatccctggatggaggacaaaacgcacgtgtcctcttgggaagaggttccctatcttggcaagagagaggaccagtggtgcgggagcctgattggactcaccgcccgggccacatgggctaccaacatccaagtggccattaatcaggtcagacgcctgatcggcaacgaaaattacctggattatatgacatccatgaaacggtttaagaacgagagcgaccctgaaggggcgctctggtga

SEQ ID NO: 18649 - RNA, 9879 nt, synthetic construct
  misc_feature 1..9879: note = derived and/or modified CDS sequence (opt5) from DENV-1__KJ189334__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaaggttagcgccggcgtgaacatgtgcacactgattgcgatggacctcggggagctgtgtgaagataccatgacatacaaatgcccgcaaatcaccgaggctgaacccgacgatgtggactgttggtgcaatgccacagatacctgggtcacgtatggaacctgttcccagacaggcgagcaccgcagagacaagcggtctgtggccctggctcctcatgttgggctcggactggagacccgcacagaaacctggatgagctccgagggcgcctggaaacagattcagagagtggaaacgtgggctcttcggcaccccggcttcacagtcatcgcctttttcctggcgcatgccattgggacctctatcacacaaaagggaatcatttttatcctcctgatgcttgtgacccctagcatggctatgcgctgcgttggcattgggaacagagatttcgtggagggactgtccggcgccacctgggtcgacgtggtgctcgagcacgggagctgtgtcacaacgatggctaagaataaacccaccctggatatcgaactgctcaagacagaggttaccaaccctgccattctgcggaaactttgcatcgaagcgaagatttctaatacaaccacggactcccgctgtccgacacagggagaggccaccctggtggaagagcaggatgctaactttgtgtgcagacggaccttcgtcgaccgcggctggggcaatgggtgtggactctttggcaaagggagcctgcttacatgcgccaagttcaagtgcgtgaccaaactggagggaaagatcgttcagtacgaaaacctcaaatattctgtgatcgtcacagtgcacacgggcgatcaacatcaggttgggaatgagaccacagaacacggaaccattgctacaatcaccccccaggcccctacgtccgagattcagctgaccgactacggcgccctgacactcgactgtagccccagaaccggcctggattttaacgaaatggtgcttctgacaatgaaggagaaatcttggctcgtccataagcaatggttcctggaccttcctctgccctggacctccggggctagcacgtcccaggagacatggaatcggcaggatctcctggtgacctttaaaacagcgcacgccaagaagcaagaagtcgtggttctgggatctcaggagggcgctatgcacaccgccctcaccggggccacagaaatccagacgagcggaaccacaaccattttcgctggccatctgaaatgccgccttaagatggacaaactgacactcaaggggacctcctatgtgatgtgtacgggcagcttcaaactggagaaggaagtcgccgagacacagcacggaaccgtgctggttcaagtgaagtacgagggcaccgatgcgccgtgcaaaatccctttttctacacaggacgaaaagggggtcacccagaacggaagacttatcacagctaatcccattgtgacggataaagagaagcctgtgaacatcgaaaccgagccccccttcggcgagtcctatattgttgtcggggccggagaaaaagccctcaagctgagctggtttaagaaaggctctagcatcgggaagatgttcgaggctacagcccggggcgctagacgcatggccattctgggagacaccgcgtgggattttggctccatcgggggagtgttcacatctgtgggcaaactcgtccatcaggtgtttgggaccgcctacggagttctgttcagcggcgtgtcctggacgatgaagatcgggattggcatccttctgacctggctcggactgaatagccggtctacatccctgagcatgacctgtattgctgtcggcatggtgacactttacctcggggttatggtgcaagccgactctggatgcgtcatcaactggaaaggcagagaactgaagtgtgggtccggaatttttgtgaccaacgaggttcacacatggaccgaacagtataagttccaggctgatagccctaaacgcctgtccgccgcgatcggcaaggcctgggaggagggggtgtgcggcattcggtctgctacgagactcgaaaatatcatgtggaaacagatcagcaacgagctgaatcatattcttctggaaaacgacatgaagtttacagtcgtggtgggagacgccaatggcatcctcgctcaagggaaaaagatgattcgcccgcagcccatggagcacaaatactcctggaagtcttggggaaaggccaaaatcattggcgccgatatccagaacaccaccttcatcattgacgggcctgatacacccgaatgtcctgacaatcagcgggcttggaacatctgggaggtcgaggattatggatttggcattttcaccacgaatatctggctgaagctgagagacagctacacacaaatgtgcgatcaccgccttatgtccgcggccattaaagacagcaaggctgttcatgccgatatgggctattggatcgaatctgagaaaaacgaaacctggaagctcgcccgggcttccttcatcgaggtgaagacatgtacctggcccaaaagccacacactgtggtctaatggggtgctggaatccgagatgattatcccgaagatttacggaggccctatcagccagcataactatagacccgggtactttacccagacggccggaccttggcacctcggcaaactggagcttgacttcgatctgtgcgaagggaccacagtcgtggttgacgagcactgcggaaatcgcggcccctctctccggaccacaaccgtgacgggcaagattatccatgaatggtgttgcagaagctgtacactgcctcccctgcggtttcgcggggaggatggatgctggtacggcatggagatcagaccggtcaaagaaaaggaggaaaaccttgtgcggtccatggttagcgcggggtctggagaggtggactccttcagcctcggcattctgtgtgtctccatcatgattgaagaggtgatgagatctcgctggagccggaagatgctgatgaccgggacactcgctgtttttctgcttctggtgatgggacaactcacctggaatgacctgatcagactgtgcattatggtcggcgccaacgcctccgatcgcatgggcatggggaccacatatcttgctctgatggccacgttcaaaatgagacctatgtttgcggtgggactcctgttccggcgcctcacctctagagaggtgctgcttctgacaatcggcctcagcctggtcgcttccgttgaactgcccaactctcttgaggaactgggggacggactcgccatgggcattatgatgctgaagctcctgaccgagtttcagccccaccagctttggacaaccctgctcagcctgacgttcatcaaaacaaccctgtcccttgattacgcctggaagaccacagctatggccctgagcatcgtgtctctctttcctctgtgtctctccaccacaagccagaaaacgacctggctgccggtgcttctggggtctttcggatgcaagcccctgacaatgtttctcattaccgaaaataagatctggggccggaaatcctggcctctgaacgagggcattatggctatcgggattgtcagcatccttctgtcttccctcctgaagaatgacgtgcccctcgccggacctctgatcgcgggcgggatgcttattgcctgttatgttatcagcggatccagcgctgatctgtctctggagaaagccgctgaagtgagctgggagcaagaagccgagcattccggcacatctcacaacattctcgtcgaagtgcaggacgatgggaccatgaagatcaaagacgaggagcgcgatgacacgctgaccattcttctgaaggccacactcctggctgttagcggagtgtaccccatgtccatccctgcgaccctcttcgtctggtatttctggcagaaaaagaagcagagatctggcgtgctgtgggatacacccagcccgcctgaagtcgagcgggccgtgcttgacgatggcatctaccgcattctgcaaagagggctgctcggacggtcccaggttggcgtgggggtctttcaggacggagtgttccataccatgtggcacgttacacgcggcgctgtgctgatgtatcaggggaaaagacttgaaccctcttgggccagcgtcaagaaagacctgatctcctacggaggcggctggcggtttcaagggagctggaatacgggagaggaggtgcaggtgattgccgttgaacctggcaagaaccccaaaaatgtccagaccacaccggggaccttcaagacccctgagggagaagtgggcgctatcgccctcgattttaagcccgggacatctggatcccctattgtgaacagagagggcaaaatcgtcggcctgtacgggaatggagtggttacgaccagcggcacatatgtgtctgcgattgctcaagccaaggcctcccaggaagggcccctccccgagatcgaggacgaagtcttcaaaaagcgcaacctgaccatcatggatcttcaccctggaagcggcaaaacacggagatacctgccggctattgtgcgcgaggccatcaagcggaagctgagaaccctcattctggcgcccacgcgcgttgtggcttccgaaatggccgaggcccttaaagggatgcctatccggtatcagacaaccgctgtcaagtctgaacataccggcagagagattgtggacctgatgtgccacgccacatttaccatgcgcctcctgagccccgttcgggtgcctaattacaacatgatcatcatggatgaggctcatttcacagaccccgcctccattgcggccagaggatatatcagcacccgggtcggcatgggggaagctgccgctatttttatgacggccacacctccgggatctgtggaggccttcccccagtccaatgctgtgatccaagatgaagagcgcgacattcctgaaagaagctggaactctggctacgattggatcaccgactttcccgggaaaacagtctggttcgttcctagcatcaagtccggaaatgatattgcgaactgtctgcggaaaaacggcaagcgcgtgatccagctctctagaaagaccttcgacacggagtatcagaaaaccaagaataacgactgggattacgtggtcacaaccgacattagcgagatgggggccaattttcgggctgatagagtgatcgacccccgccggtgccttaaaccggttattctgaaggatggccctgaaagagtgatcctggccggacccatgcccgtcacagtggcctccgctgcccagcgccggggcagaattgggcgcaaccaaaataaagagggagaccagtacgtttatatgggccagcctctcaacaatgatgaagaccacgcgcattggaccgaggctaagatgctgcttgataacatcaatacacccgaggggatcattcctgccctgttcgaaccggagcgggaaaagaacgccgctatcgacggagagtacagactccgcggcgaagccagaaaaacctttgtggagctgatgcggcgcggggatctgcccgtctggctctcttataaggtggcgagcgagggcttccagtactccgacagacggtggtgctttgatggagaacgcaataaccaagtccttgaggaaaatatggacgtggagatttggacgaaagaaggcgagagaaagaaactgcggcctagatggctggacgcccgcacatatagcgatcccctcgctctgcgggagttcaaggaatttgccgctgggagacgctctgtttccggagaccttatcctggagattggcaaactccctcagcacctgaccctgcgggcccagaacgctctcgataatcttgtgatgctgcacaacagcgaacaggggggaaaggcctacagacatgcgatggaggaactgcccgacaccatcgagacactcatgctgcttgccctgatcgctgtgctcaccggcggcgtcacactgttctttctgtccgggaagggactcggcaaaacgtctattgggcttctgtgtgttaccgccagctccgctctgctctggatggcctctgtggagccgcactggatcgccgctagcattatcctggaattctttcttatggtgctgctcattcctgagcccgatcggcaacgcacacctcaggacaaccagctggcgtatgtcgtgatcggactgctcttcatgatccttaccgttgccgctaatgaaatgggcctgctggagacaaccaagaaagatctcgggattggacatgtggccgccgagaaccaccaacacgctacgatgctggacgtcgatcttagacccgcctccgcgtggaccctgtacgccgtggctacaaccgtcatcacacctatgatgcggcataccattgaaaatacgacagccaacatcagcctcaccgctattgccaatcaggcggccatcctgatgggcctggacaagggctggcccatttctaaaatggatatcggggtgccgctccttgctctgggatgctactcccaggttaaccctctgacactcaccgccgctgtgctgatgcttgtcgcccactatgctatcattggccccgggctgcaggccaaggcgacccgcgaggcccaaaagagaacagctgccggaatcatgaaaaatcccacggtggacggcattgttgctatcgatctcgaccctgtggtctacgacgccaagtttgaaaaacagctggggcagattatgctgctcatcctttgtaccagccagatcctgctgatgcggacaacctgggccctctgcgagtctattacactggcgaccggaccgcttacgacactgtgggaaggctcccccggcaagttctggaacaccaccatcgctgtgagcatggccaatattttccgcgggtcttatctcgctggagccggcctggcctttagcctgatgaaatccctcgggggaggcagacgggggacaggagctcaaggcgagacccttggcgagaagtggaagcgccagctgaaccagctgtctaaaagcgaattcaatacatacaagagatccgggatcatggaggtggatcggagcgaagccaaagagggactcaagagaggcgaaacgaccaaacatgcggtttcccgcgggacagccaagctgcggtggtttgtcgagagaaaccttgtgaagcctgagggaaaagtgattgacctgggctgtgggcgcggaggctggtcttattactgcgctggcctcaagaaagtcaccgaagttaaggggtatacaaaaggaggccccgggcacgaggaacctatccccatggccacctacggatggaatctggtgaagctgcatagcggcaaagatgtgttctttatccctccggagaagtgtgacacgctcctttgcgatattggggaatcctctcccaaccctaccatcgaggagggacggacactgagagtcctgaagatggtggaaccctggctccgcggcaatcagttctgtattaaaatcctgaacccttacatgcccagcgttgtggaggctcttgaacaaatgcagcggaagcacggcgggatgctggtcagaaatccgctctcccgcaactctacccacgagatgtattgggtgagctgcggaacaggcaacattgtttccgccgtgaatatgaccagccggatgctgctgaacagatttacaatggcgcatcgcaaacctacctacgagcgggacgtcgatctcggggccggaacgagacacgtggctgtggaacccgaggtcgccaatctggacatcattggccagcgcatcgaaaacatcaagaatgagcataaatctacatggcactatgatgaagacaacccctacaagacctgggcttatcacgggtcctacgaggttaagcctagcggatctgcctccagcatggtgaatggcgtggtcagacttctgaccaaaccctgggatgtgattcctatggttacacaaatcgctatgacggacaccacaccgttcggccagcagcgggtgtttaaggagaaagtcgacacccgcacacccagagccaagcgggggaccacacagattatggaagtgaccgcgaaatggctctggggattcctgtctagaaacaagaagcctcggatctgtacgcgcgaggaatttaccagaaaagttcggtccaatgccgctattggcgccgtgttcgtcgatgagaaccaatggaatagcgctaaggaagccgtggaggacgagcgcttttgggatcttgttcatagagaacgggagctgcacaaacaggggaagtgcgccacatgcgtgtataacatgatgggaaaacgcgaaaagaagctcggcgagttcgggaaagcgaagggctccagagctatctggtacatgtggctgggagcccggttcctggaatttgaggccctcggcttcatgaatgaggaccattggtttagccgcgaaaactctctgagcggggtcgagggagaaggccttcacaaactggggtacatcctcagagatatttccaagatccccggaggcaatatgtatgctgacgataccgccgggtgggacacacggattaccgaggatgacctgcagaacgaggctaaaatcacggaaattatggagcctgaacatgcccttctggcgacatctatcttcaagctcacctaccagaacaaagtggtccgcgtgcaaagacccgccaagaatggcacagttatggatgtgatcagccggcgcgaccagagaggatccggccaggtcgggacctatggactgaacacgtttaccaatatggaggtgcagctgattcggcaaatggaatctgagggcatcttcctcccgagcgagctggaaacacctaaccttgctgagagagtgctggattggctcgaaaagcacggggccgagcgcctgaaacggatggctatttccggagacgactgtgttgtgaagcccatcgatgacagatttgccaccgcgcttacagccctgaatgatatgggcaaagtccgcaaggacattcctcagtgggaaccctctaaagggtggaacgattggcagcaggtgcctttctgcagccaccattttcaccaactcatcatgaaggacggccgggagatcgttgtgccctgtagaaatcaggatgagctggtcggacgcgctcgggtgtcccagggcgccgggtggagcctgagagaaaccgcttgcctcggaaagtcttacgcccaaatgtggcagctgatgtatttccatcgccgggaccttagactggctgccaacgcgatttgttccgccgtcccggtggattgggttcctacaagccgcaccacgtggtctatccacgctcaccatcagtggatgacaaccgaggacatgctctccgtgtggaatcgggtctggattgaagagaacccctggatggaagataaaacccacgtgagctcctgggaggaggttccctacctgggcaagagagaagaccagtggtgcgggtctcttatcggactgacagcccgggccacctgggctacaaatattcaagtggccatcaaccaggtcagacgcctcattggcaatgagaactatctggactacatgacgagcatgaaacggtttaagaatgaatccgatcctgagggggcgctgtggtga

SEQ ID NO: 18650 - RNA, 9879 nt, synthetic construct
  misc_feature 1..9879: note = derived and/or modified CDS sequence (opt5) from DENV-1__KJ189335__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgcctttttcctggcgcatgccattgggacatctatcacccaaaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaagaataaacccacactggatatcgaactgctcaagaccgaggtcacaaaccctgccattctgcggaaactttgcatcgaagcgaagatttctaataccacgacagactcccgctgtccgacccagggagaggccaccctggttgaagagcaggatgctaactttgtgtgcagacggacattcgtggaccgcggctggggcaatgggtgtggactctttggcaaagggagcctgcttacctgcgccaagttcaagtgcgtcacaaaactggagggaaagatcgtgcagtacgaaaacctcaaatattctgttatcgtgacggtccacaccggcgatcaacatcaggtggggaatgagacaaccgaacacggaacaattgctaccatcacgccccaggcccctacctccgagattcagctgacagactacggcgccctgaccctcgactgtagccccagaacaggcctggattttaacgaaatggttcttctgaccatgaaggagaaatcttggctcgtgcataagcaatggttcctggaccttcctctgccctggacgtccggggctagcacatcccaggagacctggaatcggcaggatctcctggtcacatttaaaaccgcgcacgccaagaagcaagaagtggtcgtgctgggatctcaggagggcgctatgcacaccgccctcacaggggccacggaaatccagaccagcggaacaaccacaattttcgctggccatctgaaatgccgccttaagatggacaaactgaccctcaaggggacgtcctatgttatgtgtacaggcagcttcaaactggagaaggaagtggccgagacccagcacggaaccgtcctggtgcaagttaagtacgagggcacagatgcgccgtgcaaaatccctttttctacccaggacgaaaagggggtgacacagaacggaagacttatcacggctaatcccattgtcaccgataaagagaagcctgtgaacatcgaaacagagccccccttcggcgagtcctatattgtggttggggccggagaaaaagccctcaagctgagctggtttaagaaaggctctagcatcgggaagatgttcgaggctaccgcccggggcgctagacgcatggccattctgggagacacagcgtgggattttggctccatcgggggagtcttcacctctgtgggcaaactcgtgcatcaggtctttgggacggcctacggagtgctgttcagcggcgtttcctggaccatgaagatcgggattggcatccttctgacatggctcggactgaatagccggtctacctccctgagcatgacatgtattgctgtgggcatggtcaccctttacctcggggtgatggttcaagccgactctggatgcgtgatcaactggaaaggcagagaactgaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagactcgaaaatatcatgtggaaacagatcagcaacgagctgaatcatattcttctggaaaacgacatgaagtttaccgtggtcgtgggagacgccaatggcatcctcgctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacaatcagcgggcttggaacatctgggaggtggaggattatggatttggcattttcacgacaaatatctggctgaagctgagagacagctacacccaaatgtgcgatcaccgccttatgtccgcggccattaaagacagcaaggctgtccatgccgatatgggctattggatcgaatctgagaaaaacgaaacatggaagctcgcccgggcttccttcatcgaggttaagacctgtacatggcccaaaagccacaccctgtggtctaatggggtgctggaatccgagatgattatcccgaagatttacggaggccctatcagccagcataactatagacccgggtactttacgcagaccgccggaccttggcacctcggcaaactggagcttgacttcgatctgtgcgaagggacaaccgtggtcgtggacgagcactgcggaaatcgcggcccctctctccggacaaccacggttacaggcaagattatccatgaatggtgttgcagaagctgtaccctgcctcccctgcggtttcgcggggaggatggatgctggtacggcatggagatcagaccggtgaaagaaaaggaggaaaaccttgtccggtccatggtgagcgcggggtctggagaggttgactccttcagcctcggcattctgtgtgtgtccatcatgattgaagaggtcatgagatctcgctggagccggaagatgctgatgacagggaccctcgctgtgtttctgcttctggttatgggacaactcacctggaatgacctgatcagactgtgcattatggtgggcgccaacgcctccgatcgcatgggcatggggacaacgtatcttgctctgatggccaccttcaaaatgagacctatgtttgcggtcggactcctgttccggcgcctcacatctagagaggtgctgcttctgaccatcggcctcagcctggtggcttccgtcgaactgcccaactctcttgaggaactgggggacggactcgccatgggcattatgatgctgaagctcctgacagagtttcagccccaccagctttggaccacgctgctcagcctgacattcatcaaaaccaccctgtcccttgattacgcctggaagacaaccgctatggccctgagcatcgtttctctctttcctctgtgtctctccacaacgagccagaaaaccacatggctgccggtgcttctggggtctttcggatgcaagcccctgaccatgtttctcattacagaaaataagatctggggccggaaatcctggcctctgaacgagggcattatggctatcgggattgtgagcatccttctgtcttccctcctgaagaatgacgtccccctcgccggacctctgatcgcgggcgggatgcttattgcctgttatgtgatcagcggatccagcgctgatctgtctctggagaaagccgctgaagttagctgggagcaagaagccgagcattccggcacctctcacaacattctcgtggaagtccaggacgatgggacgatgaagatcaaagacgaggagcgcgatgacaccctgacaattcttctgaaggccaccctcctggctgtgagcggagtttaccccatgtccatccctgcgacactcttcgtgtggtatttctggcagaaaaagaagcagagatctggcgtcctgtgggatacccccagcccgcctgaagtggagcgggccgtccttgacgatggcatctaccgcattctgcaaagagggctgctcggacggtcccaggtgggcgttggggtgtttcaggacggagtcttccatacaatgtggcacgtgacgcgcggcgctgttctgatgtatcaggggaaaagacttgaaccctcttgggccagcgtgaagaaagacctgatctcctacggaggcggctggcggtttcaagggagctggaataccggagaggaggtccaggtgattgccgtggaacctggcaagaaccccaaaaatgttcagacaaccccggggaccttcaagacacctgagggagaagtcggcgctatcgccctcgattttaagcccgggacgtctggatcccctattgtgaacagagagggcaaaatcgtgggcctgtacgggaatggagtcgtgaccacaagcggcacctatgtttctgcgattgctcaagccaaggcctcccaggaagggcccctccccgagatcgaggacgaagtgttcaaaaagcgcaacctgacaatcatggatcttcaccctggaagcggcaaaacccggagatacctgccggctattgtccgcgaggccatcaagcggaagctgagaacgctcattctggcgcccacacgcgtggttgcttccgaaatggccgaggcccttaaagggatgcctatccggtatcagaccaccgctgtgaagtctgaacatacaggcagagagattgtcgacctgatgtgccacgccacctttacaatgcgcctcctgagccccgtgcgggttcctaattacaacatgatcatcatggatgaggctcatttcaccgaccccgcctccattgcggccagaggatatatcagcacgcgggtgggcatgggggaagctgccgctatttttatgacagccacccctccgggatctgtcgaggccttcccccagtccaatgctgtgatccaagatgaagagcgcgacattcctgaaagaagctggaactctggctacgattggatcacagactttcccgggaaaaccgtgtggttcgtccctagcatcaagtccggaaatgatattgcgaactgtctgcggaaaaacggcaagcgcgttatccagctctctagaaagacgttcgacaccgagtatcagaaaacaaagaataacgactgggattacgtggtgaccacagacattagcgagatgggggccaattttcgggctgatagagtcatcgacccccgccggtgccttaaaccggtgattctgaaggatggccctgaaagagttatcctggccggacccatgcccgtgaccgtcgcctccgctgcccagcgccggggcagaattgggcgcaaccaaaataaagagggagaccagtacgtgtatatgggccagcctctcaacaatgatgaagaccacgcgcattggacagaggctaagatgctgcttgataacatcaatacccccgaggggatcattcctgccctgttcgaaccggagcgggaaaagaacgccgctatcgacggagagtacagactccgcggcgaagccagaaaaacgtttgttgagctgatgcggcgcggggatctgcccgtgtggctctcttataaggtcgcgagcgagggcttccagtactccgacagacggtggtgctttgatggagaacgcaataaccaagtgcttgaggaaaatatggacgtcgagatttggacaaaagaaggcgagagaaagaaactgcggcctagatggctggacgcccgcacctatagcgatcccctcgctctgcgggagttcaaggaatttgccgctgggagacgctctgtgtccggagaccttatcctggagattggcaaactccctcagcacctgaccctgcgggcccagaacgctctcgataatcttgttatgctgcacaacagcgaacaggggggaaaggcctacagacatgcgatggaggaactgcccgacacaatcgagaccctcatgctgcttgccctgatcgctgtgctcacaggcggcgtgacgctgttctttctgtccgggaagggactcggcaaaacctctattgggcttctgtgtgtcacagccagctccgctctgctctggatggcctctgttgagccgcactggatcgccgctagcattatcctggaattctttcttatggtgctgctcattcctgagcccgatcggcaacgcacccctcaggacaaccagctggcgtatgtggtcatcggactgctcttcatgatccttacagtggccgctaatgaaatgggcctgctggagaccacgaagaaagatctcgggattggacatgttgccgccgagaaccaccaacacgctaccatgctggacgtggatcttagacccgcctccgcgtggacactgtacgccgtcgctaccacagtgatcacccctatgatgcggcatacgattgaaaatacaaccgccaacatcagcctcacagctattgccaatcaggcggccatcctgatgggcctggacaagggctggcccatttctaaaatggatatcggggtcccgctccttgctctgggatgctactcccaggtgaaccctctgaccctcaccgccgctgttctgatgcttgtggcccactatgctatcattggccccgggctgcaggccaaggcgacacgcgaggcccaaaagagaacggctgccggaatcatgaaaaatcccaccgtcgacggcattgtggctatcgatctcgaccctgttgtgtacgacgccaagtttgaaaaacagctggggcagattatgctgctcatcctttgtacaagccagatcctgctgatgcggaccacatgggccctctgcgagtctattaccctggcgacgggaccgcttacaaccctgtgggaaggctcccccggcaagttctggaacaccacaatcgctgtcagcatggccaatattttccgcgggtcttatctcgctggagccggcctggcctttagcctgatgaaatccctcgggggaggcagacgggggaccggagctcaaggcgagacacttggcgagaagtggaagcgccagctgaaccagctgtctaaaagcgaattcaatacgtacaagagatccgggatcatggaggtggatcggagcgaagccaaagagggactcaagagaggcgaaaccacaaaacatgcggtgtcccgcgggaccgccaagctgcggtggtttgttgagagaaaccttgtcaagcctgagggaaaagtgattgacctgggctgtgggcgcggaggctggtcttattactgcgctggcctcaagaaagtgacagaagtcaaggggtataccaaaggaggccccgggcacgaggaacctatccccatggccacgtacggatggaatctggttaagctgcatagcggcaaagatgtgttctttatccctccggagaagtgtgacaccctcctttgcgatattggggaatcctctcccaaccctacaatcgaggagggacggaccctgagagtgctgaagatggtcgaaccctggctccgcggcaatcagttctgtattaaaatcctgaacccttacatgcccagcgtggttgaggctcttgaacaaatgcagcggaagcacggcgggatgctggtgagaaatccgctctcccgcaactctacacacgagatgtattgggtcagctgcggaaccggcaacattgtgtccgccgttaatatgacaagccggatgctgctgaacagatttaccatggcgcatcgcaaacctacgtacgagcgggacgtggatctcggggccggaacaagacacgtcgctgtggaacccgaggtggccaatctggacatcattggccagcgcatcgaaaacatcaagaatgagcataaatctacctggcactatgatgaagacaacccctacaagacctgggcttatcacgggtcctacgaggtcaagcctagcggatctgcctccagcatggttaatggcgtggtgagacttctgacaaaaccctgggatgtcattcctatggtgacgcaaatcgctatgaccgacacaaccccgttcggccagcagcgggtttttaaggagaaagtggacacacgcacccccagagccaagcgggggacaacccagattatggaagtcacggcgaaatggctctggggattcctgtctagaaacaagaagcctcggatctgtacccgcgaggaatttacaagaaaagtgcggtccaatgccgctattggcgccgttttcgtggatgagaaccaatggaatagcgctaaggaagccgtcgaggacgagcgcttttgggatcttgtgcatagagaacgggagctgcacaaacaggggaagtgcgccacctgcgtttataacatgatgggaaaacgcgaaaagaagctcggcgagttcgggaaagcgaagggctccagagctatctggtacatgtggctgggagcccggttcctggaatttgaggccctcggcttcatgaatgaggaccattggtttagccgcgaaaactctctgagcggggtggagggagaaggccttcacaaactggggtacatcctcagagatatttccaagatccccggaggcaatatgtatgctgacgatacagccgggtgggacacccggattacggaggatgacctgcagaacgaggctaaaatcacagaaattatggagcctgaacatgcccttctggcgacctctatcttcaagctcacataccagaacaaagtcgtgcgcgtccaaagacccgccaagaatggcaccgtgatggatgttatcagccggcgcgaccagagaggatccggccaggtggggacgtatggactgaacacctttacaaatatggaggtccagctgattcggcaaatggaatctgagggcatcttcctcccgagcgagctggaaacccctaaccttgctgagagagtgctggattggctcgaaaagcacggggccgagcgcctgaaacggatggctatttccggagacgactgtgtggttaagcccatcgatgacagatttgccacagcgcttaccgccctgaatgatatgggcaaagtgcgcaaggacattcctcagtgggaaccctctaaagggtggaacgattggcagcaggtccctttctgcagccaccattttcaccaactcatcatgaaggacggccgggagatcgtggttccctgtagaaatcaggatgagctggtgggacgcgctcgggtctcccagggcgccgggtggagcctgagagaaacagcttgcctcggaaagtcttacgcccaaatgtggcagctgatgtatttccatcgccgggaccttagactggctgccaacgcgatttgttccgccgtgccggtcgattgggtgcctaccagccgcacgacatggtctatccacgctcaccatcagtggatgaccaccgaggacatgctctccgtttggaatcgggtgtggattgaagagaacccctggatggaagataaaacacacgtcagctcctgggaggaggtgccctacctgggcaagagagaagaccagtggtgcgggtctcttatcggactgaccgcccgggccacatgggctacgaatattcaagttgccatcaaccaggtgagacgcctcattggcaatgagaactatctggactacatgaccagcatgaaacggtttaagaatgaatccgatcctgagggggcgctgtggtga

SEQ ID NO: 18651 - RNA, 9879 nt, synthetic construct
  misc_feature 1..9879: note = derived and/or modified CDS sequence (opt5) from DENV-1__KJ189336__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatcgtcaccctctacctgggggtgatggttcaagccgactctggatgcgtgattaactggaaaggcagagaactgaagtgtgggtccggaatcttcgtcacaaacgaggtgcacacctggacggaacagtataagtttcaggctgatagccctaaacgcctctccgccgcgattggcaaggcctgggaggagggggtttgcggcatccggtctgctacaagactggaaaatatcatgtggaaacagattagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatatccagaacaccacatttattatcgacgggcctgatacccccgaatgtcctgacaatcagcgggcttggaacatttgggaggtggaggattatggattcggcatctttacgacaaatatttggctgaagcttagagacagctacacccaaatgtgcgatcaccgcctcatgtccgcggccatcaaagacagcaaggctgtccatgccgatatgggctattggatcgaatctgagaaaaacgaaacatggaagctggcccgggcttccttcattgaggttaagacctgtacatggcccaaaagccacaccctgtggtctaatggggtgctcgaatccgagatgatcattccgaagatctacggaggccctattagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagatcatccatgaatggtgttgcagaagctgtaccctgcctccccttcggttccgcggggaggatggatgctggtacggcatggagattagaccggtgaaagaaaaggaggaaaacctcgtccggtccatggtgagcgcggggtctggagaggttgactcctttagcctgggcatcctgtgtgtgtccattatgatcgaagaggtcatgagatctcgctggagccggaagatgctcatgacagggaccctggctgtgttccttctgctcgttatgggacaactgacctggaatgacctgattagactttgcatcatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccattggcctgagcctggtggcttccgtcgaacttcccaactctctggaggaactcggggacggactggccatgggcatcatgatgctcaagctgcttacagagttccagccccaccagctgtggaccacgctcctgagcctgacatttatcaaaaccaccctttccctggattacgcctggaagacaaccgctatggccctcagcattgtttctctgttccctctctgtctgtccacaacgagccagaaaaccacatggcttccggtgctgctggggtcttttggatgcaagcccctcaccatgttcctgatcacagaaaataagatttggggccggaaatcctggcctcttaacgagggcatcatggctattgggatcgtgagcatcctgctctcttccctgctcaagaatgacgtccccctggccggacctcttattgcgggcgggatgctgatcgcctgttatgtgattagcggatccagcgctgatctgtctctcgagaaagccgctgaagttagctgggagcaagaagccgagcattccggcacctctcacaacatcctggtggaagtccaggacgatgggacgatgaagattaaagacgaggagcgcgatgacacccttacaatcctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatttaccgcatcctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatttcctacggaggcggctggcggttccaagggagctggaataccggagaggaggtccaggtgatcgccgtggaacctggcaagaaccccaaaaatgttcagacaaccccggggacctttaagacacctgagggagaagtcggcgctattgccctggatttcaagcccgggacgtctggatcccctatcgtgaacagagagggcaaaattgtgggcctctacgggaatggagtcgtgaccacaagcggcacctatgtttctgcgatcgctcaagccaaggcctcccaggaagggcccctgcccgagatcgaggacgaagtgtttaaaaagcgcaaccttacaattatggatctgcaccctggaagcggcaaaacccggagatacctgccggctatcgtccgcgaggccattaagcggaagctcagaacgctgatccttgcgcccacacgcgtggttgcttccgaaatggccgaggccctgaaagggatgcctattcggtatcagaccaccgctgtgaagtctgaacatacaggcagagagatcgtcgacctcatgtgccacgccaccttcacaatgcgcctgctgagccccgtgcgggttcctaattacaacatgatcattatggatgaggctcattttaccgaccccgcctccatcgcggccagaggatatattagcacgcgggtgggcatgggggaagctgccgctatcttcatgacagccacccctccgggatctgtcgaggcctttccccagtccaatgctgtgattcaagatgaagagcgcgacatccctgaaagaagctggaactctggctacgattggatcacagacttccccgggaaaaccgtgtggtttgtccctagcattaagtccggaaatgatatcgcgaactgtctccggaaaaacggcaagcgcgttattcagctttctagaaagacgttcgacaccgagtatcagaaaacaaagaataacgactgggattacgtggtgaccacagacatcagcgagatgggggccaatttccgggctgatagagtcattgacccccgccggtgcctgaaaccggtgatcctgaaggatggccctgaaagagttattctcgccggacccatgcccgtgaccgtcgcctccgctgcccagcgccggggcagaatcgggcgcaaccaaaataaagagggagaccagtacgtgtatatgggccagcctctgaacaatgatgaagaccacgcgcattggacagaggctaagatgcttctggataacatcaatacccccgaggggattatccctgccctctttgaaccggagcgggaaaagtctgccgctattgacggagagtacagactgcgcggcgaagccagaaaaacgttcgttgagctgatgcggcgcggggatctccccgtgtggcttagctataaggtcgcgtccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgcccgcacctattctgatcccctggctcttcgggagtttaaggaattcgccgctgggagacgctccgtgagcggagacctgattctcgagatcggcaaactgcctcagcacctgaccctccgggcccagaatgctcttgataacctggttatgctgcacaattccgaacaggggggaaaggcctacagacatgcgatggaggaactccccgacacaatcgagaccctgatgcttctggccctcattgctgtgctgacaggcggcgtgacgctgtttttcctctctgggaagggacttggcaaaaccagcatcgggctgctgtgtgtcacagcctcctctgctctcctgtggatggccagcgttgagccgcactggattgccgcttccatcattcttgaatttttcctgatggtgctcctgatccctgagcccgatcggcaacgcacccctcaggacaaccagctggcgtatgtggtcatcggactcctttttatgattctgacagtggccgctaacgaaatgggcctgctcgagaccacgaagaaagatctggggatcggacatgttgccgccgagaatcaccaacacgctaccatgcttgacgtggatctgagacccgccagcgcgtggacactctacgccgtcgctaccacagtgattacccctatgatgcggcatacgatcgaaaacacaaccgccaatatttctctgacagctatcgccaaccaggcggccattctgatgggcctcgacaagggctggcccatctccaaaatggatatcggggtcccgcttctggctctgggatgctacagccaggtgaatcctctcaccctgaccgccgctgttcttatgctggtggcccactatgctattatcggccccgggctccaggccaaggcgacacgcgaggcccaaaagagaacggctgccggaattatgaaaaaccccaccgtcgacggcatcgtggctattgatctggaccctgttgtgtacgacgccaagttcgaaaaacagctggggcagatcatgctccttatcctgtgtacatctcagattctgctcatgcggaccacatgggccctgtgcgagtccatcacccttgcgacgggaccgctgacaaccctctgggaaggcagccccggcaagttttggaataccacaattgctgtctctatggccaacatcttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggattatggaggtggatcggtccgaagccaaagagggactgaagagaggcgaaaccacaaaacatgcggtgtctcgcgggaccgccaagcttcggtggttcgttgagagaaatctggtcaagcctgagggaaaagtgatcgacctcggctgtgggcgcggaggctggagctattactgcgctggcctgaagaaagtgacagaagtcaaggggtataccaaaggaggccccgggcacgaggaacctatccccatggccacgtacggatggaacctggttaagctccattccggcaaagatgtgtttttcatgcctccggagaagtgtgacacccttctgtgcgatattggggaatctagccccaatcctacaatcgaggagggacggaccctgagagtgctcaagatggtcgaaccctggctgcgcggcaaccagttttgtattaaaatccttaatccttacatgccctccgtggttgaggctctggaacaaatgcagcggaagcacggcgggatgctcgtgagaaacccgctgtctcgcaatagcacacacgagatgtattgggtctcctgcggaaccggcaacattgtgagcgccgttaacatgacatctcggatgctgctcaatagattcaccatggcgcatcgcaaacctacgtacgagcgggacgtggatctgggggccggaacaagacacgtcgctgtggaacccgaggtggccaaccttgacatcattggccagcgcatcgaaaatatcaagaacgagcataaatccacctggcactatgatgaagacaatccctacaagacctgggcttatcacgggagctacgaggtcaagccttctggatccgccagctctatggttaacggcgtggtgagactgctcacaaaaccctgggatgtcattcctatggtgacgcaaatcgctatgaccgacacaaccccgtttggccagcagcgggttttcaaggagaaagtggacacacgcacccccagagccaagcgggggacaacccagattatggaagtcacggcgaaatggctgtggggatttctttccagaaataagaagcctcggatctgtacccgcgaggaattcacaagaaaagtgcggagcaacgccgctattggcgccgtttttgtggatgagaatcaatggaactccgctaaggaagccgtcgaggacgagcgcttctgggatctggtgcatagagaacgggagctccacaaacaggggaagtgcgccacctgcgtttataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtggagggagaaggcctgcacaaactcgggtacatcctgagagatatttctaagatccccggaggcaacatgtatgctgacgatacagccgggtgggacacccggattacggaggatgaccttcagaatgaggctaaaatcacagaaattatggagcctgaacatgccctgctcgcgaccagcatctttaagctgacataccagaacaaagtcgtgcgcgtccaaagacccgccaagaacggcaccgtgatggatgttatctcccggcgcgaccagagaggatctggccaggtggggacgtatggactgaataccttcacaaacatggaggtccagctcattcggcaaatggaaagcgagggcatctttctgccgtccgagcttgaaacccctaatctggctgagagagtgctcgattggctggaaaagcacggggccgagcgccttaaacggatggctatttctggagacgactgtgtggttaagcccatcgatgacagattcgccacagcgctgaccgccctcaacgatatgggcaaagtgcgcaaggacattcctcagtgggaacccagcaaagggtggaatgattggcagcaggtccctttttgctcccaccatttccaccaactgatcatgaaggacggccgggagatcgtggttccctgtagaaaccaggatgagctggtgggacgcgctcgggtcagccagggcgccgggtggtctctcagagaaacagcttgcctgggaaagtcctacgcccaaatgtggcagcttatgtattttcatcgccgggacctgagactcgctgccaatgcgatttgtagcgccgtgccggtcgattgggtgcctacctctcgcacgacatggtccatccacgctcaccatcagtggatgaccaccgaggacatgctgagcgtttggaaccgggtgtggattgaagagaatccctggatggaagataaaacacacgtctcctcttgggaggaggtgccctaccttggcaagagagaagaccagtggtgcgggagcctgatcggactcaccgcccgggccacatgggctacgaacattcaagttgccatcaatcaggtgagacgcctgattggcaacgagaattatctggactacatgacctccatgaaacggttcaagaacgaaagcgatcctgagggggcgctctggtga

SEQ ID NO: 18652 - RNA, 9879 nt, synthetic construct
  misc_feature 1..9879: note = derived and/or modified CDS sequence (opt5) from DENV-1__KJ189337__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagatctggaatcggcaggatctgctggtcaccttcaaaacagcgcacgccaagaagcaagaagtggtcgtgctcggatctcaggagggcgctatgcacaccgccctgaccggggccacagaaattcagacgagcggaaccacaaccatctttgctggccatcttaaatgccgcctgaagatggacaaactcacactgaaggggacctcctatgttatgtgtacgggcagcttcaaactggagaaggaagtggccgagacacagcacggaaccgtccttgtgcaagttaagtacgagggcaccgatgcgccgtgcaaaatccctttctctacacaggacgaaaagggggtgacccagaacggaagactcattacagctaatcccatcgtcacggataaagagaagcctgtgaacattgaaaccgagcccccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccatcgggggagtctttacatctgtgggcaaactggtgcatcaggtcttcgggaccgcctacggagtgctttttagcggcgtttcctggacgatgaagattgggatcggcattctgctcacctggctgggactgaatagccggtctacatcccttagcatgacctgtatcgctgtgggcatggtcacactctacctgggggtgatggttcaagccgactctggatgcgtgattaactggaaaggcagagaactgaagtgtgggtccggaatcttcgtcaccaacgaggtgcacacatggaccgaacagtataagtttcaggctgatagccctaaacgcctctccgccgcgattggcaaggcctgggaggagggggtttgcggcatccggtctgctacgagactggaaaatatcatgtggaaacagattagcaacgagcttaatcatatcctgctcgaaaacgacatgaagttcacagtggtcgtgggagacgccaatggcattctggctcaagggaaaaagatgatccgcccgcagcccatggagcacaaatactcctggaagtcttggggaaaggccaaaattatcggcgccgatatccagaacaccacctttattatcgacgggcctgatacacccgaatgtcctgacaatcagcgggcttggaacatttgggaggtggaggattatggattcggcatctttaccacgaatatttggctgaagcttagagacagctacacacaaatgtgcgatcaccgcctcatgtccgcggccatcaaagacagcaaggctgtccatgccgatatgggctattggatcgaatctgagaaaaacgaaacctggaagctggcccgggcttccttcattgaggttaagacatgtacctggcccaaaagccacacactgtggtctaatggggtgctcgaatccgagatgatcattccgaagatctacggaggccctattagccagcataactatagacccgggtacttcacccagacggccggaccttggcacctgggcaaacttgagctggactttgatctctgcgaagggaccacagtggtcgtggacgagcactgcggaaatcgcggcccctctctgcggaccacaaccgttacgggcaagatcatccatgaatggtgttgcagaagctgtacactgcctccccttcggttccgcggggaggatggatgctggtacggcatggagattagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggacactggccgtcttccttctgctcattatgggacaactgacctggaatgacctgatcagactttgcattatggtgggcgccaacgcttccgatcgcatgggcatggggaccacatatctggccctcatggcgacgtttaaaatgagacctatgttcgctgttggactgctctttcggcgcctgacctctagagaggtgcttctgctcacaatcggcctgagcctggtcgcctccgtggaacttcccaactctctggaggaactcggggacggactggccatgggcatcatgatgctcaagctgcttaccgagttccagccccaccagctgtggacaaccctcctgagcctgacgtttattaaaacaaccctttccctggattacgcttggaagaccacagccatggctctcagcatcgtgtctctgttccctctctgtctgtccaccacaagccagaaaacgacctggcttccggtcctgctggggtcttttggatgcaagcccctcacaatgttcctgattaccgaaaataagatctggggccggaaatcctggcctcttaacgagggcattatggccatcgggatcgttagcattctgctctcttccctgctcaagaatgacgtgcccctggcgggacctcttatcgccggcgggatgctgattgcttgttatgtgatcagcggatccagcgccgatctgtctctcgagaaagctgccgaagtcagctgggagcaagaagccgagcattccggcacatctcacaacattctggtggaagttcaggacgatgggaccatgaagatcaaagacgaggagcgcgatgacacgcttaccatcctgctcaaggctacactgctcgcggtgagcggagtctaccccatgtccattcctgccaccctgtttgtgtggtatttctggcagaaaagaaagcagcggtctggcgttctttgggatacacccagcccgcctgaagtggagcgcgctgtcctggacgatggcatctacagaattctgcaacgggggctcctgggacgctcccaggtgggcgtcggggtgttccaggacggagtttttcataccatgtggcacgtgacaagaggcgccgtccttatgtatcaggggaagcggctggaaccctcttgggccagcgtgaaaaaggacctcatctcctacggaggcggctggagattccaagggagctggaatacgggagaggaggttcaggtgattgctgtcgaacctggcaaaaaccccaagaatgtgcagaccacaccggggacctttaaaacccctgagggagaagtgggcgccatcgcgctggatttcaagcccgggacatctggatcccctattgttaaccgcgagggcaagatcgtcggcctctacgggaatggagtggtgacgaccagcggcacatatgtctctgctatcgcccaagccaaagcttcccaggaagggcccctgcccgagattgaggacgaagtgtttaagaaacggaaccttaccatcatggatctgcaccctggaagcggcaagacaagacgctacctgccggccattgttcgggaggcgatcaaaagaaagctccgcaccctgattcttgctcccacgcgggtggtcgcctccgaaatggccgaggctctgaaggggatgcctatcagatatcagacaaccgccgtgaaatctgaacataccggccgcgagatcgttgacctcatgtgccacgctacattcaccatgcggctgctgagccccgtgagagtccctaattacaacatgattatcatggatgaggcccattttacagaccccgcgtccattgccgctcggggatatatcagcacccgcgtgggcatgggggaagccgctgccattttcatgacggccacacctccgggatctgttgaggcttttccccagtccaatgcggtgatccaagatgaagagagagacatccctgaacggagctggaactctggctacgattggattaccgacttccccgggaagacagtctggtttgtgcctagcatcaaatccggaaatgatattgccaactgtctccgcaagaacggcaaaagagtgatccagctttctcggaagaccttcgacacggagtatcagaagaccaaaaataacgactgggattacgtcgttacaaccgacattagcgagatgggggctaatttcagagccgatcgcgtgatcgacccccggagatgcctgaagccggtgattctgaaagatggccctgaacgcgtcatcctcgccggacccatgcccgtgacagttgcttccgccgcgcagcggagaggccgcatcgggcggaaccaaaataaggagggagaccagtacgtgtatatgggccagcctctgaacaatgatgaagaccacgctcattggaccgaggccaaaatgcttctggataacattaatacacccgaggggatcattcctgccctctttgaaccggagagagaaaagtctgctgccatcgacggagagtaccgcctgagaggcgaagcgcggaagaccttcgtcgagctgatgcgcagaggggatctccccgtgtggcttagctataaagttgcctccgagggctttcagtacagcgaccggcgctggtgcttcgatggagaaagaaacaatcaagtgctggaggaaaacatggacgtcgagatttggacgaaggaaggcgagcggaaaaagctgagacctcgctggctcgacgctcggacatattctgatcccctggcccttagagagtttaaagaattcgctgccgggcgccggtccgtgagcggagacctgatcctcgagatcggcaagctgcctcagcacctgaccctcagagctcagaatgcccttgataacctggtcatgctgcacaattccgaacaggggggaaaagcgtaccggcatgccatggaggaactccccgacaccattgagacactgatgcttctggctctcatcgccgtgctgaccggcggcgttacactgtttttcctctctgggaagggacttggcaagacgagcattgggctgctgtgtgtgaccgcttcctctgccctcctgtggatggccagcgtggagccgcactggatcgctgcgtccattatccttgaatttttcctgatggtcctcctgatccctgagcccgatcgccaaagaacacctcaggacaaccagctggcctatgttgtgattggactcctttttatgatcctgaccgtggctgccaacgaaatgggcctgctcgagacaaccaaaaaggatctggggattggacatgtcgccgctgagaatcaccaacacgccacgatgcttgacgtggatctgcggcccgcgagcgcctggaccctctacgctgttgccacaaccgtgatcacacctatgatgcgccataccattgaaaacacgacagctaatatctctctgaccgccattgcgaaccaggccgctatcctgatgggcctcgacaaaggctggcccatctccaagatggatattggggtcccgcttctggccctgggatgctacagccaggtgaatcctctcacactgaccgctgccgtccttatgctggtggctcactatgccatcattggccccgggctccaggcgaaagccaccagagaggctcaaaagcggacagccgctggaatcatgaagaaccccacggttgacggcattgtggccatcgatctggaccctgtcgtgtacgacgccaaattcgaaaagcagctggggcagatcatgctccttattctgtgtacctctcagatcctgctcatgcgcacaacctgggcgctgtgcgagtccattacacttgctaccggaccgctgacgacactctgggaaggcagccccggcaaattttggaataccaccatcgccgtttctatggctaacattttcagagggagctatctggccggagccggcctggctttctccctcatgaagtctcttgggggaggccggcgcgggacaggagcccaaggcgagaccctgggcgagaaatggaagagacagctgaatcagctcagcaagtccgaatttaacacatacaaacggagcgggatcatggaggtggatagatccgaagcgaaggagggactgaaacgcggcgaaacgaccaagcatgccgtctctcgggggacagctaaacttagatggttcgtggagcgcaatctggtgaagcctgagggaaaggttatcgacctcggctgtgggcggggaggctggagctattactgcgccggcctgaaaaaggtcaccgaagtgaaagggtatacaaagggaggccccgggcacgaggaacctattcccatggctacctacggatggaacctggtgaaactccattccggcaaggatgtctttttcatgcctccggagaaatgtgacacgcttctgtgcgatatcggggaatctagccccaatcctaccattgaggagggaagaacactgcgcgttctcaagatggtggaaccctggctgcggggcaaccagttttgtatcaagattcttaatccttacatgccctccgtggtcgagaccctggaacaaatgcagagaaaacacggcgggatgctcgtgcgcaacccgctgtctcggaatagcacacacgagatgtattgggtttcctgcggaaccggcaacatcgtgagcgccgtcaacatgacatctagaatgctgctcaatcgcttcaccatggcgcatcggaagcctacgtttgagagagacgtggatctgggggccggaacacgccacgttgctgtggaacccgaggtcgccaaccttgacattatcggccagagaatcgaaaatgtgaaaaacgagcataagtccacctggcactacgatgaagacaatccctataaaacctgggcttaccacgggagctatgaggtgaagccttctggatccgccagctctatggtcaacggcgttgtgcggctgctcacaaagccctgggatgtgattcctatggtcacgcaaatcgctatgaccgacacaaccccgttcggccagcagcgcgtgtttaaagagaaggttgacacaagaaccccccgggccaaaagagggacaacccagattatggaagtgacggcgaagtggctgtggggattcctttcccggaataaaaagcctcgcatctgtaccagagaggaatttacacggaaggtccgcagcaacgccgctattggcgccgtgttcgttgatgagaatcaatggaactccgctaaagaagccgtggaggacgagagattttgggatctggtccatcgggaacgcgagctccacaagcaggggaaatgcgccacctgcgtgtacaatatgatgggaaagagagaaaaaaagctgggcgagttcgggaaggcgaaaggcagccgggctatctggtatatgtggctgggagcccgcttcctcgaatttgaggccctgggcttcatgaacgaggaccattggttttctagagaaaatagcctttccggggttgagggagaaggcctgcacaagctcgggtacatcctgcgggatatttctaaaatccccggaggcaacatgtacgctgacgatacagccgggtgggacacccgcattacggaggatgaccttcagaatgaggctaagatcacagatattatggaacctgagcatgccctgctcgcgaccagcatcttcaaactgacatatcagaacaaggtggtcagagtgcaacggcccgccaaaaacggcaccgtcatggacgtgatctcccgcagagatcagcggggatctggccaggttgggacgtacggactgaatacctttacaaacatggaagtgcagctcattagacaaatggagagcgaaggcatcttcctgccgtccgagcttgagacccctaatctggctgaacgcgtcctcgactggctggagaagcacggggccgaacggcttaagagaatggctatttctggagacgattgtgtggtgaaacccatcgacgatcgctttgccacagcgctgaccgccctcaacgacatgggcaaggttcggaaagatattcctcagtgggagcccagcaaggggtggaatgactggcagcaggtgcctttctgctcccaccattttcaccaactgatcatgaaagatggcagagaaatcgtcgtgccctgtcgcaaccaggacgagctggttggacgggctagagtgagccagggcgccgggtggtctctccgcgagacagcttgcctgggaaagtcctatgcccaaatgtggcagcttatgtacttccatcggagagatctgcgcctcgctgccaatgcgatttgtagcgccgtcccggtggactgggtccctacctctcggacgacatggtccatccacgctcaccatcagtggatgaccaccgaagatatgctgagcgtgtggaacagagtttggattgaggaaaatccctggatggaggacaagacacacgtgtcctcttgggaagaggtcccctatcttggcaaacgggaggaccagtggtgcgggagcctgatcggactcaccgccagagccacatgggctacgaacattcaagtggccatcaatcaggttcgccggctgattggcaacgaaaattacctggattatatgacctccatgaagagatttaaaaacgagagcgaccctgaaggggcgctctggtga

SEQ ID NO: 18653 - RNA, 9879 nt, synthetic construct
  misc_feature 1..9879: note = derived and/or modified CDS sequence (opt5) from DENV-1__KJ189340__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaggcgggacctatgttagcgcgattgctcaagccaaggcctctcaggaaggacccctgcccgagatcgaggacgaagtgtttaaaaagcgcaaccttacaatcatggatctgcaccctggctccgggaaaacccggagatacctgccggctattgtccgcgaggccatcaagcggaagctcagaacgctgattcttgcgcccacacgcgtggttgctagcgaaatggccgaggccctgaaaggcatgcctatccggtatcagaccaccgctgtgaagtccgaacatacaggaagagagattgtcgacctcatgtgccacgccaccttcacaatgcgcctgctgtctcccgtgcgggttcctaattacaacatgatcatcatggatgaggctcattttaccgaccccgccagcattgcggccagaggctatatctccacgcgggtggggatgggagaagctgccgctattttcatgacagccacccctccgggcagcgtcgaggcctttccccagtctaatgctgtgatccaagatgaagagcgcgacattcctgaaagatcctggaacagcgggtacgattggatcacagacttccccggaaaaaccgtgtggtttgtcccttctatcaagagcggcaatgatattgcgaactgtctccggaaaaacgggaagcgcgttatccagctttccagaaagacgttcgacaccgagtatcagaaaacaaagaataacgactgggattacgtggtgaccacagacatttctgagatgggcgccaatttccgggctgatagagtcatcgacccccgccggtgcctgaaaccggtgattctgaaggatggacctgaaagagttatcctcgccggccccatgcccgtgaccgtcgccagcgctgcccagcgccgggggagaattggacgcaaccaaaataaagagggcgaccagtacgtgtatatggggcagcctctgaacaatgatgaagaccacgcgcattggacagaggctaagatgcttctggataacatcaatacccccgagggaatcattcctgccctctttgaaccggagcgggaaaagtccgccgctatcgacggcgagtacagactgcgcggggaagccagaaaaacgttcgttgagctgatgcggcgcggcgatctccccgtgtggctttcttataaggtcgcgagcgagggatttcagtactccgacagacggtggtgcttcgatggcgaacgcaacaatcaagtgctggaggaaaacatggacgtcgagatttggacaaaagaaggggagagaaagaaactgcggcctagatggctcgacgcccgcacctatagcgatcccctggctcttcgggagtttaaggaattcgccgctggaagacgctctgtgtccggcgacctgatcctcgagattgggaaactgcctcagcacctgaccctccgggcccagaatgctcttgataacctggttatgctgcacaatagcgaacagggaggcaaggcctacagacatgcgatggaggaactccccgacacaatcgagaccctgatgcttctggccctcatcgctgtgctgacaggcggggtgacgctgtttttcctctccggaaagggccttgggaaaacctctattggactgctgtgtgtcacagccagctccgctctcctgtggatggcctctgttgagccgcactggatcgccgctagcattatccttgaatttttcctgatggtgctcctgattcctgagcccgatcggcaacgcacccctcaggacaaccagctggcgtatgtggtcatcggcctcctttttatgatcctgacagtggccgctaacgaaatggggctgctcgagaccacgaagaaagatctgggaattggccatgttgccgccgagaatcaccaacacgctaccatgcttgacgtggatctgagacccgcctccgcgtggacactctacgccgtcgctaccacagtgatcacccctatgatgcggcatacgattgaaaacacaaccgccaatatcagcctgacagctattgccaaccaggcggccatcctgatgggcctcgacaaggggtggcccatttctaaaatggatatcggagtcccgcttctggctctgggctgctactcccaggtgaatcctctcaccctgaccgccgctgttcttatgctggtggcccactatgctatcattgggcccggactccaggccaaggcgacacgcgaggcccaaaagagaacggctgccggcatcatgaaaaaccccaccgtcgacgggattgtggctatcgatctggaccctgttgtgtacgacgccaagttcgaaaaacagctgggacagattatgctccttatcctgtgtacaagccagatcctgctcatgcggaccacatgggccctgtgcgagtctattacccttgcgacgggcccgctgacaaccctctgggaaggctcccccgggaagttttggaataccacaatcgctgtcagcatggccaacattttccgcggatcttatctggctggcgccgggctggccttcagcctcatgaaatcccttggaggcgggagacggggaaccggcgctcaaggcgagacactgggggagaagtggaagcgccagctgaatcagctctctaaaagcgaatttaacacgtacaagagatccggaatcatggaggtggatcggagcgaagccaaagagggcctgaagagaggggaaaccacaaaacatgcggtgtcccgcggaaccgccaagcttcggtggttcgttgagagaaatctggtcaagcctgagggcaaagtgattgacctcgggtgtggacgcggcggctggtcttattactgcgctgggctgaagaaagtgacagaagtcaagggatataccaaaggcgggcccggacacgaggaacctatccccatggccacgtacggctggaacctggttaagctccatagcgggaaagatgtgtttttcatgcctccggagaagtgtgacacccttctgtgcgatatcggagaatcctctcccaatcctacaattgaggagggccggaccctgagagtgctcaagatggtcgaaccctggctgcgcggcaaccagttttgtatcaaaattcttaatccttacatgcccagcgtggttgaggctctggaacaaatgcagcggaagcacgggggaatgctcgtgagaaacccgctgtcccgcaattctacacacgagatgtattgggtcagctgcggcaccgggaacatcgtgtccgccgttaacatgacaagccggatgctgctcaatagattcaccatggcgcatcgcaaacctacgtacgagcgggacgtggatctgggagccggcacaagacacgtcgctgtggaacccgaggtggccaaccttgacattatcgggcagcgcattgaaaatatcaagaacgagcataaatctacctggcactatgatgaagacaatccctacaagacctgggcttatcacggatcctacgaggtcaagcctagcggctctgcctccagcatggttaacggcgtggtgagactgctcacaaaaccctgggatgtcatccctatggtgacgcaaattgctatgaccgacacaaccccgtttgggcagcagcgggttttcaaggagaaagtggacacacgcacccccaaggccaaaagaggaacaacccagatcatggaagtcacggcgaagtggctgtggggctttctttctcggaataagaaacctagaatttgtacccgggaggaattcacacgcaaggtgagatccaacgccgctatcggggccgtttttgtggatgagaatcaatggaacagcgctaaagaagccgtcgaggacgagcggttctgggatctggtgcatcgcgaaagagagctccacaagcagggaaaatgcgccacctgcgtttataatatgatgggcaagcgggaaaagaaactgggggagtttggcaaggcgaaaggatcccgcgctatttggtacatgtggctgggcgccagattcctcgaattcgaggccctggggtttatgaacgaggaccattggttcagccgggaaaattctcttagcggagtggagggcgaagggctgcacaagctcggatacatcctgcgcgatatctccaaaattcccggcgggaacatgtatgctgacgatacagccggctgggacaccagaatcacggaggatgaccttcagaatgaggctaagattacagaaatcatggagcctgaacatgccctgctcgcgacctctatttttaaactgacataccagaacaaggtcgtgcgggtccaacgccccgccaagaacggaaccgtgatggatgttatcagcagacgggaccagcgcggctccgggcaggtgggaacgtatggcctgaataccttcacaaacatggaggtccagctcatcagacaaatggaatctgaggggatttttctgccgagcgagcttgaaacccctaatctggctgagcgggtgctcgattggctggaaaaacacggagccgagagacttaagcgcatggctatctccggcgacgactgtgtggttaaacccattgatgaccggttcgccacagcgctgaccgccctcaacgatatggggaaggtgagaaaagacatccctcagtgggaaccctctaagggctggaatgattggcagcaggtccctttttgcagccaccatttccaccaactgattatgaaggacggacgcgagatcgtggttccctgtcggaaccaggatgagctggtgggcagagctcgcgtctcccagggggccggatggagcctccgggaaacagcttgcctgggcaaatcttacgcccaaatgtggcagcttatgtattttcatagacgcgacctgcggctcgctgccaatgcgatctgttccgccgtgccggtcgattgggtgcctaccagcagaacgacatggtctattcacgctcaccatcagtggatgaccaccgaggacatgctgtccgtttggaaccgcgtgtggatcgaagagaatccctggatggaagataagacacacgtcagctcctgggaggaggtgccctaccttgggaaacgggaagaccagtggtgcggatctctgattggcctcaccgccagagccacatgggctacgaacatccaagttgccattaatcaggtgcggagactgatcgggaacgagaattatctggactacatgaccagcatgaagcgcttcaaaaacgaatccgatcctgagggcgcgctctggtga

SEQ ID NO: 18654 - RNA, 9879 nt, synthetic construct
  misc_feature 1..9879: note = derived and/or modified CDS sequence (opt5) from DENV-1__KJ189341__SS-prME
  source 1..9879: mol_type = other RNA
agcgtgaccatgctgcttatgctgcttcccacagcgctggctttccacctgacgaccagaggaggggaacctcatatgatcgtctccaagcaggaacggggaaaatctctgctttttaagacaagcgctggagttaatatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggagggcaccgcagagagaagcggtctgtcgccctggctcctcatgtgggactcggactggagacacgcaccgaaacgtggatgagctccgagggagcctggaaacagattcagagagttgaaacatgggcccttcggcaccccgggttcaccgtgatcgccctgtttctcgcgcatgccattggaacatctatcacccaaaagggcatcattttcatcctgcttatgctggtcacccctagcatggctatgcgctgcgtggggattggaaatagagactttgttgagggcctctccggggccacatgggtggatgtcgtgctggagcacggaagctgtgtgacgaccatggctaagaataaacccacactggacatcgaactcctgaagaccgaggtcacaaaccctgccgttcttcggaaactgtgcattgaagcgaagatctctaataccacgacagattcccgctgtccgacccagggcgaggccaccctcgtggaagaacaagacgctaacttcgtgtgcagacggacatttgtcgatcgcggctgggggaatggatgtggcctgttcgggaaaggaagccttctgacctgcgccaagtttaagtgcgtgacaaaactcgagggcaagattgttcagtacgaaaacctgaaatattctgtgatcgtcacggtgcacaccggggaccaacatcaggttggaaatgagacaaccgaacacggcacaatcgctaccattacgccccaggcccctacctccgagatccagctgacagattacggcgccctcaccctggactgtagccccagaacagggcttgacttcaacgaaatggtgctgctcaccatgaaggagaaatcttggctggtccataagcaatggtttcttgatctgcctctcccctggacgtccggagctagcacatcccaggagacctggaatcggcaggacctgctggtgacattcaaaaccgcgcacgccaagaagcaagaagtcgtggttctcggctctcaggagggggctatgcacaccgccctgacaggagccacggaaattcagaccagcggcacaaccacaatctttgctgggcatcttaaatgccgcctgaagatggataaactcaccctgaagggcacgtcctatgtgatgtgtacaggaccgttcaaactggagaaggaagtcgccgagacccagcacggcaccgtgcttgttcaagtgaagtacgaggggacagacgcgccttgcaaaattcccttcagcacccaggatgaaaagggagtcacacagaacggcagactcatcacggctaatcctatcgtgaccgacaaagagaagcccgtgaacattgaaacagagcccccttttggggagtcttatatcgttgtcggagccggcgaaaaagccctgaagctgtcctggttcaagaaagggagctctattggcaagatgtttgaggctaccgcccggggagctagacgcatggccatcctcggcgatacagcgtgggacttcgggagcattggaggcgtgtttacctccgtggggaaactggtccatcaggtgttcggaacggcctacggcgttctcttttctggggtgagctggaccatgaagatcggcatcggcattctgctcacatggctgggcctcaattcccggagcacctctctttccatgacatgtatcgtcgtggggattgttaccctctacctgggagtgatggtccaagctgatagcggctgcgtgatcaactggaaagggagagaactgaagtgtggatctggcattttcgttacaaacgaggtgcacacctggacggaacagtataagtttcaggccgactccccgaaacgcctcagcgctgccatcgggaaggcgtgggaggagggcgtctgcggcattcggtccgccacaagactggaaaatatcatgtggaaacagatctctaacgagcttaatcatattctgctcgaaaacgatatgaagttcaccgtggtggtcggcgacgctaatgggatcctggcccaaggcaagaagatgattcgcccccagcctatggagcacaaatacagctggaagtcctggggcaaggctaaaatcattggggccgacacccagaacacaacctttatcatcgatggacccgacacgcctgaatgtcccgataatcagcgggcctggaacatttgggaggttgaggactatggcttcggcatctttacaaccaatatttggctgaaacttagagattcttacacacaaatgtgcgaccaccgcctcatgagcgctgcgatcaaagattccaaggccgtgcatgctgacatggggtattggattgaaagcgagaaaaacgaaacctggaagctggcccgggcctctttcatcgaggtgaagacatgtacctggccgaaatcccacacgctgtggagcaatggagtcctcgaatctgagatgatcattcctaagatctacggcgggcccatttcccagcataactatagacctggatacttcacccagacagctggcccctggcacctggggaaacttgagctggattttgacctctgcgaaggaaccacagtggttgtggatgagcactgcggcaatcgcggccctagcctgcggaccacgacagtcaccgggaagatcattcatgaatggtgttgcagatcttgtacactgcccccgcttcggttccgcggagaggacggctgctggtacgggatggagatcagacctgtgaaagaaaaggaggaaaacctcgttcggagcatggtgtccgccggaagcggcgaggtcgattctttttccctggggatcctgtgtgcgagcattatgatcgaagaggtgatgagatcccgctggtctcggaagatgctcatgaccggaaccctggctgttttccttctgctcattatgggccaactgacatggaaagacctgatcagactttgcattatggtgggcgccaatgccagcgaccgcatggggatgggaacgacctatctggctctcatggccacatttaagatgagacccatgttcgcggtcggcctgctctttcggcgcctgacctccagagaggtgcttctgctcacaatcgggctgtctctggtggctagcgtcgaacttcccaactccctggaggaactcggagatggcctggccatggggattatgatgctcaaactgcttaccgagttccagcctcaccagctgtggacgacactcctgtctctgacctttatcaagaccacacttagcctggactacgcctggaaaaccacagctatggccctctccatcgttagcctgttcccgctctgtctgtctacgacctcccagaagacaacctggcttcccgtgctgctgggcagctttggctgcaagccttctacaatgttcctcattaccgaaaacaaaatctggggccggaagtcctggcccctgaatgaggggattatggctatcggaattgtgagcatccttctgtcttccctcctgaaaaacgatgtccctctcgccggccccctgatcgccggcgggatgcttattgcctgttatgtgatcagcgggtccagcgctgacctgtctctggagaaggccgctgaagttagctgggagcaagaagccgagcattccgggacgtctcacaatattctcgtggaagtccaggatgacggaaccatgaaaatcaaggatgaggagcgcgacgatacactgaccattcttctgaaagccacactcctggctgtgagcggcgtttaccctatgtccatccccgcgaccctctttgtgtggtatttctggcagaagaagaaacagagatctggcgtcctgtgggacacaccgagccctcccgaagtggagcgggccgtccttgatgacgggatctaccgcattctgcaaagaggactgctcggccggtcccaggtgggggttggagtgttccaggatggcgtctttcatacgatgtggcacgtgacccgcggggctgttctgatgtatcagggaaagagacttgaaccttcttgggccagcgtgaaaaaggacctgatctcctacggcggcgggtggcggttccaaggaagctggaacacaggcgaggaggtccaggtgattgccgtggaacccgggaaaaatccgaagaacgttcagaccacccctggaacatttaagacgcccgagggcgaagtcggggctatcgccctcgacttcaaacctggaacctctggctcccccattgtgaatagagagggcaagatcgtggggctgtacggaaacggcgtcgtgacaaccagcgggacatatgtttctgcgattgctcaagccaaagcctcccaggaaggacccctccctgagatcgaggatgaagtgtttaagaaacgcaatctgaccatcatggaccttcacccgggcagcgggaagacgcggagatacctgcccgctattgtccgcgaggccatcaagcggaaactgagaacactcattctggcgcctacccgcgtggttgcttccgaaatggccgaggcccttaagggcatgcccatccggtatcagaccacagctgtgaaatctgaacataccggaagagagattgtcgatctgatgtgccacgccacattcaccatgcgcctcctgagccctgtgcgggttcccaactacaatatgatcatcatggacgaggctcattttacggatcctgcctccattgcggccagaggctatatcagcacacgggtggggatgggagaagctgccgctattttcatgaccgccacaccgcccggctctgtcgaggcctttcctcagtccaacgctgtgatccaagacgaagaaagagatattcccgaaagaagctggaactctgggtacgactggatcaccgatttccctggaaagacggtgtggtttgtccccagcatcaaatccggcaacgacattgcgaattgtctgcggaagaacgggaagcgcgttatccagctctctagaaaaaccttcgatacagagtatcagaagaccaaaaacaatgactgggactacgtggtgacaaccgatattagcgagatgggcgccaacttccgggctgacagagtcatcgatccgcgccggtgccttaagcctgtgattctgaaagacggacccgaaagagttatcctggccggccccatgcctgtgacagtcgcctccgctgcccagcgccgggggagaattggacgcaatcaaaacaaggagggcgatcagtacgtgtatatggggcagcccctcaataacgacgaagatcacgcgcattggaccgaggctaagatgctgcttgacaatatcaacacgcctgagggaatcattccggccctgtttgaacccgagcgggaaaaatctgccgctatcgatggcgagtacagactccgcggggaagccagaaagacattcgttgagctgatgcggcgcggcgacctgcctgtgtggctcagctataaagtcgcgtccgagggcattcagtacagcgatagacggtggtgctttgacggcgaacgcaataaccaagtgcttgaggaaaatatggatgtcgagatctggaccaaggaaggggagcgcaagaagctgcggcccagatggctggacgcccgcacctattctgaccctctcgctctgcgggagttcaaagaatttgccgctggaagacgctccgtgagcggcgatcttattctggagatcgggaagctcccccagcacctgacactgcgggcccagaacgctctcgacaatcttgttatgctgcacaactccgaacagggaggcaaggcctacagacatgcgatggaggaactgccggataccatcgagacactcatgctgcttgccctgattgctgtgctcacgggcggggtgaccctgttctttctgtctggaaaaggcctcgggaagacaagcatcggacttctgtgtgtcaccgcctcctctgctctgctctggatggccagcgttgagctgcactggattgccgcttccatcattcttgagttctttctgatggtgctcctgatccctgagcccgaccggcaacgcacacctcaggataatcagctggcgtatgtggtcatcggcctccttttcatgattctgaccgtggccgctaacgaaatggggctgctcgagacgaccaaaaaggacctgggaatcggccatgttgccgccgagaaccaccaacacgctacaatgcttgatgtggacctgagacccgccagcgcgtggaccctctacgccgtcgctacaaccgtgattacgcctatgatgcggcatacaatcgaaaataccacagccaacatttctctgaccgctatcgccaatcaggcggccattctgatgggcctcgataaagggtggcccatctccaagatggacatcggagtcccgcttctggctctgggctgctacagccaggtgaaccctctcaccctgacagccgctgttcttatgctggtggcccactatgctattatcgggcccggactccaggccaaggcgacgcgcgaggcccagaaaagaaccgctgccggcattatgaagaatcccacagtcgatgggatcgtggctattgacctggatcctgttgtgtacgacgccaaatttgaaaagcagctgggacagatcatgctccttatcctgtgtacctctcagattctgctcatgcggacaacctgggccctgtgcgagtccatcacgcttgcgacaggcccgctgaccaccctctgggaaggcagccccgggaaattctggaacacaaccattgctgtctctatggccaatatctttcgcggaagctatctggctggcgccgggctggccttctccctcatgaagtctcttggaggcgggagacggggaacaggcgctcaaggcgagacgctgggggagaagtggaaacgccagctgaaccagctcagcaagtccgagttcaatatttacaaaagaagcggaatcatggaggtggaccggtccgaagccaaggagggcctgaaaagaggggaaaccacaaagcatgcggtgtctcgcggaaccgccaaacttcggtggtttgttgagagaaacctggtcaaacctgagggcaaggtgatcgatctcgggtgtggacgcggcggctggagctattactgcgctgggctgaaaaaggtgacagaagtcaaaggatataccaagggcgggcccggacacgaggaacctattcccatggccacgtacggctggaatctggttaaactccattccgggaaggacgtgttctttatgcctccggagaagtgtgatacccttctgtgcgacatcggagaatctagccccaaccctacaattgaggagggccggaccctgagagtgctcaaaatggtcgaaccctggctgcgcggcaatcagttctgtatcaagattcttaacccttacatgccctccgtggttgagacactggaacaaatgcagcggaaacacgggggaatgctcgtgagaaatccgctgtctcgcaacagcacccacgagatgtattgggtctcctgcggcacagggaatatcgtgagcgctgttaacatgacctctcggatgctgctcaacagatttacgatggcccatcgcaagcctacatacgagcgggatgtggacctgggagcgggcaccagacacgtcgccgtggaacccgaggtggctaatcttgatattatcgggcagcgcatcgaaaacattaaaaatgagcataagtccacctggcactatgacgaagataacccctacaagacatgggcctatcacggaagctacgaggtcaaaccttctggctccgctagctctatggttaatggcgtggtgagactgctcacgaagccctgggacgtcatccctatggtgacccaaattgccatgacagataccacaccgttcgggcagcagcgggtttttaaagagaaggtggacacccgcacacccagagctaaacggggaaccacgcagatcatggaagtcaccgccaagtggctgtggggcttcctttccagaaacaagaaacctcggatttgtacacgcgaggaatttaccagaaaggtgcggagcaatgcggccatcggggctgttttcgtggacgagaaccaatggaactccgccaaagaagctgtcgaggatgagcgcttttgggacctggtgcatagagaacgggagctccacaagcagggaaaatgcgccacatgcgtttataacatgatgggcaagcgcgaaaagaaactgggggagttcggcaaggccaaaggaagcagagcgatctggtacatgtggctgggcgctcggtttctcgagttcgaggccctggggttcatgaatgaggatcattggttttctcgcgaaaacagcctttccggagtggagggcgaagggctgcacaagctcggatacattctgagagacatctctaaaattcccggcgggaatatgtatgccgatgacaccgctggctgggatacgcggatcacagaggacgatcttcagaacgaggccaagattaccgacatcatggaacctgagcatgctctgctcgccacaagcatcttcaaactgacctaccagaataaggtcgtgcgcgtccaaagacccgcgaagaacggaacggtgatggatgttatttcccggcgcgaccagagaggctctggacaggtgggaacctatggcctgaacacatttaccaatatggaagtccagctcatccggcaaatggagagcgaagggattttcctgccgtccgagcttgagacacctaacctggccgaaagagtgctcgattggctggagaaacacggagctgaacgccttaagcggatggccatctctggcgacgactgtgtggttaaacccattgatgacagatttgctaccgccctgacagcgctcaatgatatggggaaggtgcgcaaagacatccctcagtgggagcccagcaagggctggaacgattggcagcaggtccctttctgctcccaccattttcaccaactgatcatgaaggacggacgggaaattgtggttccctgtagaaatcaggatgagctggtgggccgcgcccgggtcagccagggggctggatggtctctcagagagaccgcctgcctgggcaaatcctacgctcaaatgtggcagcttatgtatttccatcgccgggacctgagactcgccgctaacgccatctgtagcgcggtgccggtcgattgggtgcctacgtctcgcacaacctggtccattcacgcccaccatcagtggatgaccacagaagacatgctgagcgtttggaatcgggtgtggatcgaggaaaacccctggatggaggataagacccacgtctcctcttgggaagaggtgccctaccttgggaaaagagaggaccagtggtgcggaagcctgattggcctcacagctcgggccacgtgggccaccaatatccaagttgctattaaccaggtgagacgcctgatcgggaatgaaaactatctggactacatgacatccatgaagcggtttaaaaatgagagcgatcctgaaggcgccctctggtga

SEQ ID NO: 18655 - RNA, 9879 nt, synthetic construct
  misc_feature 1..9879: note = derived and/or modified CDS sequence (opt5) from DENV-1__KJ189343__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgacagccctgtttctcgcgcatgccatcgggacctctattacccaaaagggaatcatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagagcaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattaccccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagcccccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtggtcaactggaaaggcagagaactgaagtgtgggtccggaattttcgtgaccaacgaggttcacacgtggacagaacagtataagtttcaggctgatagccctaaacgcctctccgccgcgatcggcaaggcctgggaggagggggtgtgcggcattcggtctgctaccagactggaaaatatcatgtggaaacagattagcaacgagcttaatcatatcctgctcgaaaacgacatgaagttcaccgtcgtggtgggagacgccaatggcatcctggctcaagggaaaaagatgattcgcccgcagcccatggagcacaaatactcctggaagtcttggggaaaggccaaaatcattggcgccgatatccagaacacaacctttattatcgacgggcctgatacgcccgaatgtcctgacaatcagcgggcttggaacatctgggaggtcgaggattatggattcggcatttttacaaccaatatctggctgaagcttagagacagctacacacaaatgtgcgatcaccgcctcatgtccgcggccattaaagacagcaaggctgttcatgccgatatgggctattggatcgaatctgagaaaaacgaaacctggaagctggcccgggcttccttcattgaggtgaagacatgtacctggcccaaaagccacacgctgtggtctaatggggtgctcgaatccgagatgatcatcccgaagatttacggaggccctatcagccagcataactatagacccgggtacttcacccagacagccggaccttggcacctgggcaaacttgagctggactttgatctctgcgaagggaccacagtcgtggttgacgagcactgcggaaatcgcggcccctctctgcggaccacgacagtgaccggcaagattatccatgaatggtgttgcagaagctgtacactgcctccccttcggttccgcggggaggatggatgctggtacggcatggagattagaccggtcaaagaaaaggaggaaaacctcgtgcggtccatggttagcgcggggtctggagaggtggactcctttagcctgggcatcctgtgtgcttccatcatgattgaagaggtcatgagatctcgctggagccggaagatgctcatgatcgggaccctggccgtgttccttctgctcattatgggacaactgacctggaatgacctgatcagactttgcattatggttggcgccaacgcttccgatcgcatgggcatggggacaacgtatctggccctcatggcgacctttaaaatgagacctatgttcgctgtgggactgctctttcggcgcctgacatctagagaggtccttctgctcaccatcggcctgagcctggtggcctccgtggaacttcccaactctctggaggaactcggggacggactggccatgggcattatgatgctcaagctgcttacagagttccagccccaccagctgtggaccacgctcctgagcctgacatttatcaaaaccaccctttccctggattacgcttggaagacaaccgccatggctctcagcatcgtctctctgttccctctctgtctgtccacaacgagccagaaaaccacatggcttccggttctgctggggtcttttggatgcaagcccctcaccatgttcctgattacagaaaataagatctggggccggaaatcctggcctcttaacgagggcattatggccatcgggattgtgagcatcctgctctcttccctgctcaagaatgacgtgcccctggcgggacctcttatcgccggcgggatgctgattgcttgttatgtcatcagcggatccagcgccgatctgtctctcgagaaaaccgctgaagtgagctgggagcaagaagccgagcattccggcacgtctcacaacattctggttgaagtgcaggacgatgggaccatgaagatcaaagacgaggagcgcgatgacacacttaccattctgctcaaggccacactgctcgctgtcagcggagtgtaccccatgtccatccctgcgaccctgtttgtttggtatttctggcagaaaaagaagcagagatctggcgtgctttgggatacacccagcccgcctgaagtcgagcgggccgtgctggacgatggcatctaccgcattctgcaaagagggctcctgggacggtcccaggtcggcgtgggggttttccaggacggagtgtttcatacgatgtggcacgtcacccgcggcgctgtgcttatgtatcaggggaaaagactggaaccctcttgggccagcgttaagaaagacctcatctcctacggaggcggctggcggttccaagggagctggaatacaggagaggaggtgcaggtcattgccgtggaacctggcaagaaccccaaaaatgtgcagaccaccccggggacatttaagacgcctgagggagaagttggcgctatcgccctggatttcaagcccgggacctctggatcccctattgtcaacagagagggcaaaatcgtgggcctctacgggaatggagtggtcacaaccagcggcacatatgtgtctgcgattgctcaagccaaggcctcccaggaagggcccctgcccgagatcgaggacgaagtttttaaaaagcgcaaccttaccatcatggatctgcaccctggaagcggcaaaacgcggagatacctgccggctattgtgcgcgaggccatcaagcggaagctcagaacactgattcttgcgcccacccgcgtcgtggcttccgaaatggccgaggccctgaaagggatgcctatccggtatcagaccacagctgttaagtctgaacataccggcagagagattgtggacctcatgtgccacgccacattcaccatgcgcctgctgagccccgtccgggtgcctaattacaacatgatcatcatggatgaggctcattttacggaccccgcctccattgcggccagaggatatatcagcacacgggttggcatgggggaagctgccgctattttcatgaccgccacacctccgggatctgtggaggcctttccccagtccaatgctgtcatccaagatgaagagcgcgacattcctgaaagaagctggaactctggctacgattggatcaccgacttccccgggaaaacggtgtggtttgtgcctagcatcaagtccggaaatgatattgcgaactgtctccggaaaaacggcaagcgcgtcatccagctttctagaaagaccttcgacacagagtatcagaaaaccaagaataacgactgggattacgttgtgacaaccgacattagcgagatgggggccaatttccgggctgatagagtgatcgacccccgccggtgcctgaaaccggtcattctgaaggatggccctgaaagagtgatcctcgccggacccatgcccgttacagtggcctccgctgcccagcgccggggcagaattgggcgcaaccaaaataaagagggagaccagtacgtctatatgggccagcctctgaacaatgatgaagaccacgcgcattggaccgaggctaagatgcttctggataacatcaatacgcccgaggggatcattcctgccctctttgaaccggagcgggaaaagtctgccgctatcgacggagagtacagactgcgcggcgaagccagaaaaacattcgtggagctgatgcggcgcggggatctccccgtttggcttagctataaggtggcgtccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgcccgcacctattctgatcccctggctcttcgggagtttaaggaattcgccgctgggagacgctccgtcagcggagacctgatcctcgagattggcaaactgcctcagcacctgacactccgggcccagaatgctcttgataacctggccatgctgcacaattccgaacaggggggaaaggcgtacagacatgccatggaggaactccccgacaccatcgagacactgatgcttctggctctcatcgccgtgctgacgggcggcgttaccctgtttttcctctctgggaagggacttggcaaaacaagcattgggctgctgtgtgtgaccgcttcctctgccctcctgtggatggccagcgtggagccgcactggatcgctgcgtccattatccttgaatttttcctgatggtcctcctgattcctgagcccgatcggcaacgcacacctcaggacaaccagctggcctatgttgtgatcggactcctttttatgatcctgaccgtggctgccaacgaaatgggcctgctcgagacgaccaagaaagatctggggattggacatgtcgccgctgagaatcaccaacacgccacaatgcttgacgtggatctgagacccgcgagcgcctggaccctctacgctgttgccacaaccgtgatcacgcctatgatgcggcatacaattgaaaacaccacagctaatatctctctgaccgccattgcgaaccaggccgctatcctgatgggcctcgacaagggctggcccatttccaaaatggatatcggggtcccgcttctggccctgggatgctacagccaggtgaatcctctcaccctgacagctgccgtccttatgctggtggctcactatgccatcattggccccgggctccaggcgaaggccacgcgcgaggctcaaaagagaaccgccgctggaatcatgaaaaaccccacagttgacggcattgtggccatcgatctggaccctgtcgtgtacgacgccaagttcgaaaaacagctggggcagattatgctccttatcctgtgtacctctcagatcctgctcatgcggacaacctgggcgctgtgcgagtccattacgcttgctacaggaccgctgaccaccctctgggaaggcagccccggcaagttttggaatacaaccatcgccgtttctatggctaacattttccgcgggagctatctggccggagccggcctggctttctccctcatgaaatctcttgggggaggcagacgggggacaggagcccaaggcgagacgctgggcgagaagtggaagcgccagctgaatcagctcagcaaatccgaatttaacacctacaagagaagcgggatcatggaggtggatcggtccgaagcgaaagagggactgaagagaggcgaaacaaccaaacatgccgtctctcgcgggacagctaagcttcggtggttcgtggagagaaatctggtgaagcctgagggaaaagttattgacctcggctgtgggcgcggaggctggagctattactgcgccggcctgaagaaagtcaccgaagtgaaggggtatacgaaaggaggccccgggcacgaggaacctatccccatggctacctacggatggaacctggtgaagctccattccggcaaagatgtctttttcatgcctccggagaagtgtgacacacttctgtgcgatatcggggaatctagccccaatcctaccattgaggagggacggacactgagagttctcaagatggtggaaccctggctgcgcggcaaccagttttgtatcaaaattcttaatccttacatgccctccgtggtcgagaccctggaacaaatgcagcggaagcacggcgggatgctcgtgagaaacccgctgtctcgcaatagcacacacgagatgtattgggtttcctgcggaaccggcaacatcgtgagcgccgtcaacatgacgtctcggatgctgctcaatagattcacaatggcgcatcgcaaacctacctttgagcgggacgtggatctgggggccggaaccagacacgttgctgtggaacccgaggtcgccaaccttgacattatcggccagcgcattgaaaatatcaagaacgagcataaatccacatggcactacgatgaagacaatccctataagacgtgggcttaccacgggagctatgaggtgaagccttctggatccgccagctctatggtgaacggcgtcgttagactgctcaccaaaccctgggatgtgatccctatggtgacacaaattgctatgaccgacacaaccccgttcggccagcagcgggtctttaaggagaaagtggacacacgcacccccagagccaagcgggggacgacccagatcatggaagttacagcgaaatggctgtggggattcctttccagaaataagaagcctcggatttgtacccgcgaggaatttacaagaaaagtgcggagcaacgccgctatcggcgccgtcttcgtggatgagaatcaatggaactccgctaaggaagccgttgaggacgagcgcttttgggatctggtgcatagagaacgggagctccacaaacaggggaagtgcgccacctgcgtctacaatatgatgggaaaacgcgaaaagaagctgggcgagttcgggaaagcgaagggcagcagagctatttggtatatgtggctgggagcccggttcctcgaatttgaggccctgggcttcatgaacgaggaccattggttttctcgcgaaaatagcctttccggggtggagggagaaggcctgcacaaactcgggtacatcctgagagatatctctaagattcccggaggcaacatgtacgctgacgatacggccgggtgggacacacggatcaccgaggatgaccttcagaatgaggctaaaattacagatatcatggaacctgagcatgccctgctcgcgaccagcattttcaagctgacgtatcagaacaaagttgtgcgcgtccaaagacccgccaagaacggcaccgtgatggacgtcatctcccggcgcgatcagagaggatctggccaggtggggacatacggactgaatacctttacaaacatggaagttcagctcatccggcaaatggagagcgaaggcattttcctgccgtccgagcttgagacccctaatctggctgaaagagtgctcgactggctggagaagcacggggccgaacgccttaaacggatggctatctctggagacgattgtgtcgtgaagcccattgacgatagatttgccacagcgctgaccgccctcaacgacatgggcaaagtgcgcaaggatatccctcagtgggagcccagcaaagggtggaatgactggcagcaggttcctttctgctcccaccattttcaccaactgattatgaaggatggccgggaaatcgtggtcccctgtagaaaccaggacgagctggtgggacgcgctcgggttagccagggcgccgggtggtctctcagagagacggcttgcctgggaaagtcctatgcccaaatgtggcagcttatgtacttccatcgccgggatctgagactcgctgccaatgcgatctgtagcgccgtgccggtcgactgggtgcctacatctcgcaccacctggtccattcacgctcaccatcagtggatgacaaccgaagatatgctgagcgtctggaaccgggtgtggatcgaggaaaatccctggatggaggacaaaacacacgtttcctcttgggaagaggtgccctatcttggcaagagagaggaccagtggtgcgggagcctgattggactcacggcccgggccacctgggctacaaacatccaagtcgccattaatcaggtgagacgcctgatcggcaacgaaaattacctggattatatgacctccatgaaacggtttaagaacgagagcgaccctgaaggggcgctctggtga

SEQ ID NO: 18656 - RNA, 9879 nt, synthetic construct
  misc_feature 1..9879: note = derived and/or modified CDS sequence (opt5) from DENV-1__KJ189344__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgacagccctgtttctcgcgcatgccatcgggacctctattacccaaaagggaatcatcttcattctgcttatgctggtcacacctagcatggctatgcgctgcgtgggcatcgggaacagagattttgttgagggactctccggcgccacgtgggtggacgtcgtgctggagcacgggagctgtgtgaccacaatggctaagaataaacccaccctggatattgaactcctgaagacagaggtcaccaaccctgccatccttcggaaactgtgcattgaagcgaagatctctaatacgacaaccgactcccgctgtccgacccagggagaggccacactcgttgaagagcaggatgctaacttcgtgtgcagacggacctttgtggaccgcggctggggcaatgggtgtggactgttcggcaaagggagccttctgacatgcgccaagtttaagtgcgtcacgaaactcgagggaaagattgtgcagtacgaaaacctgaaatattctgttatcgtgaccgtccacacaggcgatcaacatcaggtggggaatgagaccacagaacacggaaccatcgctacgattaccccccaggcccctacatccgagatccagctgaccgactacggcgccctcacactggactgtagccccagaaccggccttgatttcaacgaaatggttctgctcacgatgaaggagaaatcttggctggtgcataagcaatggtttcttgacctgcctctcccctggacatccggggctagcacctcccaggagacatggaatcggcaggatctgctggtcaccttcaaaaccgcgcacgccaagaagcaagaagtggtcgtgctcggatctcaggagggcgctatgcacacagccctgacgggggccaccgaaattcagacaagcggaaccacaaccatctttgctggccatcttaaatgccgcctgaagatggacaaactcacgctgaaggggacatcctatgttatgtgtaccggcagcttcaaactggagaaggaagtggccgagacccagcacggaacagtccttgtgcaagttaagtacgagggcaccgatgcgccgtgcaaaattcctttctctacacaggacgaaaagggggtgacgcagaacggaagactcatcaccgctaatcccatcgtcacagataaagagaagcctgtgaacattgaaaccgagcccccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgactctggatgcgtggtcaactggaaaggcagagaactgaagtgtgggtccggaattttcgtgaccaacgaggttcacacgtggacagaacagtataagtttcaggctgatagccctaaacgcctctccgccgcgatcggcaaggcctgggaggagggggtgtgcggcattcggtctgctaccagactggaaaatatcatgtggaaacagattagcaacgagcttaatcatatcctgctcgaaaacgacatgaagttcaccgtcgtggtgggagacgccaatggcatcctggctcaagggaaaaagatgattcgcccgcagcccatggagcacaaatactcctggaagtcttggggaaaggccaaaatcattggcgccgatatccagaacacaacctttattatcgacgggcctgatacgcccgaatgtcctgacaatcagcgggcttggaacatctgggaggtcgaggattatggattcggcatttttacaaccaatatctggctgaagcttagagacagctacacacaaatgtgcgatcaccgcctcatgtccgcggccattaaagacagcaaggctgttcatgccgatatgggctattggatcgaatctgagaaaaacgaaacctggaagctggcccgggcttccttcattgaggtgaagacatgtacctggcccaaaagccacacgctgtggtctaatggggtgctcgaatccgagatgatcatcccgaagatttacggaggccctatcagccagcataactatagacccgggtacttcacccagacagccggaccttggcacctgggcaaacttgagctggactttgatctctgcgaagggaccacagtcgtggttgacgagcactgcggaaatcgcggcccctctctgcggaccacgacagtgaccggcaagattatccatgaatggtgttgcagaagctgtacactgcctccccttcggttccgcggggaggatggatgctggtacggcatggagattagaccggtcaaagaaaaggaggaaaacctcgtgcggtccatggttagcgcggggtctggagaggtggactcctttagcctgggcatcctgtgtgtctccatcatgattgaagaggtgatgagatctcgctggagccggaagatgctcatgaccgggaccctggctgttttccttctgctcgtgatgggacaactgacatggaatgacctgatcagactttgcattatggtcggcgccaacgcctccgatcgcatgggcatggggacgacctatctggctctcatggccacatttaaaatgagacctatgttcgcggtgggactgctctttcggcgcctgacctctagagaggtgcttctgctcacaatcggcctgagcctggtcgcttccgttgaacttcccaactctctggaggaactcggggacggactggccatgggcattatgatgctcaagctgcttaccgagttccagccccaccagctgtggacgacactcctgagcctgacctttatcaaaaccacactttccctggattacgcctggaagaccacagctatggccctcagcattgtgtctctgttccctctctgtctgtccacgaccagccagaaaacaacctggcttccggtgctgctggggtcttttggatgcaagcccctcacaatgttcctgatcaccgaaaataagatctggggccggaaatcctggcctcttaacgagggcattatggctatcgggattgtcagcatcctgctctcttccctgctcaagaatgacgtgcccctggccggacctcttattgcgggcgggatgctgatcgcctgttatgttatcagcggatccagcgctgatctgtctctcgagaaagccgctgaagtgagctgggagcaagaagccgagcattccggcacgtctcacaacattctggtcgaagtgcaggacgatgggaccatgaagatcaaagacgaggagcgcgatgacacacttaccattctgctcaaggccacactgctcgctgttagcggagtgtaccccatgtccatccctgcgaccctgtttgtctggtatttctggcagaaaaagaagcagagatctggcgtgctttgggatacacccagcccgcctgaagtcgagcgggccgtgctggacgatggcatttaccgcatcctgcaaagagggctcctgggacggtcccaggttggcgtgggggtcttccaggacggagtgtttcatacgatgtggcacgttacccgcggcgctgtgcttatgtatcaggggaaaagactggaaccctcttgggccagcgtcaagaaagacctcatctcctacggaggcggctggcggttccaagggagctggaatacaggagaggaggtgcaggtgattgccgttgaacctggcaagaaccccaaaaatgtccagaccaccccggggacatttaagacgcctgagggagaagtgggcgctatcgccctggatttcaagcccgggacctctggatcccctattgtgaacagagagggcaaaatcgtcggcctctacgggaatggagtggttacaaccagcggcacatatgtgtctgcgattgctcaagccaaggcctcccaggaagggcccctgcccgagatcgaggacgaagtctttaaaaagcgcaaccttaccattatggatctgcaccctggaagcggcaaaacgcggagatacctgccggctatcgtgcgcgaggccatcaagcggaagctcagaacactgattcttgcgcccacccgcgttgtggcttccgaaatggccgaggccctgaaagggatgcctatccggtatcagaccacagctgtcaagtctgaacataccggcagagagattgtggacctcatgtgccacgccacattcaccatgcgcctgctgagccccgttcgggtgcctaattacaacatgatcattatggatgaggctcattttacggaccccgcctccatcgcggccagaggatatatcagcacacgggtcggcatgggggaagctgccgctattttcatgaccgccacacctccgggatctgtggaggcctttccccagtccaatgctgtgatccaagatgaagagcgcgacattcctgaaagaagctggaactctggctacgattggatcaccgacttccccgggaaaacggtctggtttgttcctagcattaagtccggaaatgatatcgcgaactgtctccggaaaaacggcaagcgcgtgatccagctttctagaaagaccttcgacacagagtatcagaaaaccaagaataacgactgggattacgtggtcacaaccgacattagcgagatgggggccaatttccgggctgatagagtgatcgacccccgccggtgcctgaaaccggttattctgaaggatggccctgaaagagtgatcctcgccggacccatgcccgtcacagtggcctccgctgcccagcgccggggcagaattgggcgcaaccaaaataaagagggagaccagtacgtttatatgggccagcctctgaacaatgatgaagaccacgcgcattggaccgaggctaagatgcttctggataacatcaatacgcccgaggggattatccctgccctctttgaaccggagcgggaaaagtctgccgctatcgacggagagtacagactgcgcggcgaagccagaaaaacattcgtggagctgatgcggcgcggggatctccccgtctggcttagctataaggtggcgtccgagggctttcagtacagcgacagacggtggtgcttcgatggagaacgcaacaatcaagtcctggaggaaaacatggacgtggagatttggaccaaagaaggcgagagaaagaaactgcggcctagatggctcgacgcccgcacctattctgatcccctggctcttcgggagtttaaggaattcgccgctgggagacgctccgttagcggagacctgatcctcgagattggcaaactgcctcagcacctgacactccgggcccagaatgctcttgataacctggtgatgctgcacaattccgaacaggggggaaaggcctacagacatgcgatggaggaactccccgacaccatcgagacactgatgcttctggccctcattgctgtgctgacgggcggcgtcaccctgtttttcctctctgggaagggacttggcaaaacaagcatcgggctgctgtgtgttaccgcctcctctgctctcctgtggatggccagcgtggagccgcactggatcgccgcttccattatccttgaatttttcctgatggtgctcctgattcctgagcccgatcggcaacgcacacctcaggacaaccagctggcgtatgtcgtgatcggactcctttttatgattctgaccgttgccgctaacgaaatgggcctgctcgagacgaccaagaaagatctggggatcggacatgtggccgccgagaatcaccaacacgctacaatgcttgacgtcgatctgagacccgccagcgcgtggaccctctacgccgtggctacaaccgtcatcacgcctatgatgcggcatacaattgaaaacaccacagccaatatctctctgaccgctattgccaaccaggcggccatcctgatgggcctcgacaagggctggcccatttccaaaatggatatcggggtgccgcttctggctctgggatgctacagccaggttaatcctctcaccctgacagccgctgtgcttatgctggtcgcccactatgctattatcggccccgggctccaggccaaggcgacgcgcgaggcccaaaagagaaccgctgccggaatcatgaaaaaccccacagtggacggcattgttgctatcgatctggaccctgtggtctacgacgccaagttcgaaaaacagctggggcagattatgctccttatcctgtgtacctctcagattctgctcatgcggacaacctgggccctgtgcgagtccatcacgcttgcgacaggaccgctgaccaccctctgggaaggcagccccggcaagttttggaatacaaccatcgctgtgtctatggccaacattttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacacctacaagagaagcgggatcatggaggtggatcggtccgaagccaaagagggactgaagagaggcgaaacaaccaaacatgcggtttctcgcgggacagccaagcttcggtggttcgtcgagagaaatctggtgaagcctgagggaaaagtgattgacctcggctgtgggcgcggaggctggagctattactgcgctggcctgaagaaagtcaccgaagttaaggggtatacgaaaggaggccccgggcacgaggaacctatccccatggccacctacggatggaacctggtgaagctccattccggcaaagatgtgtttttcatgcctccggagaagtgtgacacacttctgtgcgatattggggaatctagccccaatcctaccatcgaggagggacggacactgagagtcctcaagatggtggaaccctggctgcgcggcaaccagttttgtatcaaaattcttaatccttacatgccctccgttgtggaggctctggaacaaatgcagcggaagcacggcgggatgctcgtcagaaacccgctgtctcgcaatagcacccacgagatgtattgggtgtcctgcggaacaggcaacatcgttagcgccgtgaacatgacctctcggatgctgctcaatagattcacgatggcgcatcgcaaacctacatacgagcgggacgtcgatctgggggccggaaccagacacgtggctgtggaacccgaggtcgccaaccttgacattatcggccagcgcattgaaaatatcaagaacgagcataaatccacctggcactatgatgaagacaatccctacaagacatgggcttatcacgggagctacgaggttaagccttctggatccgccagctctatggtgaacggcgtggtcagactgctcacgaaaccctgggatgtgattcctatggttacccaaatcgctatgacagacaccacaccgtttggccagcagcgggtgttcaaggagaaagtcgacacccgcacacccagagccaagcgggggaccacgcagatcatggaagtgaccgcgaaatggctgtggggatttctttccagaaataagaagcctcggatttgtacacgcgaggaattcaccagaaaagttcggagcaacgccgctatcggcgccgtgtttgtcgatgagaatcaatggaactccgctaaggaagccgtggaggacgagcgcttctgggatctggttcatagagaacgggagctccacaaacaggggaagtgcgccacatgcgtgtataatatgatgggaaaacgcgaaaagaagctgggcgagtttgggaaagcgaagggcagcagagctatttggtacatgtggctgggagcccggttcctcgaattcgaggccctgggctttatgaacgaggaccattggttctctcgcgaaaatagcctttccggggtcgagggagaaggcctgcacaaactcgggtacatcctgagagatatttctaagatccccggaggcaacatgtatgctgacgataccgccgggtgggacacgcggatcacagaggatgaccttcagaatgaggctaaaattaccgaaatcatggagcctgaacatgccctgctcgcgacaagcatttttaagctgacctaccagaacaaagtggtccgcgtgcaaagacccgccaagaacggcacggttatggatgtgatctcccggcgcgaccagagaggatctggccaggtcgggacctatggactgaatacattcaccaacatggaggtgcagctcattcggcaaatggaaagcgagggcatctttctgccgtccgagcttgaaacacctaatctggctgagagagtgctcgattggctggaaaagcacggggccgagcgccttaaacggatggctatctctggagacgactgtgttgtgaagcccattgatgacagattcgccaccgcgctgacagccctcaacgatatgggcaaagtccgcaaggacatccctcagtgggaacccagcaaagggtggaatgattggcagcaggtgcctttttgctcccaccatttccaccaactgattatgaaggacggccgggagatcgttgtgccctgtagaaaccaggatgagctggtcggacgcgctcgggtgagccagggcgccgggtggtctctcagagaaaccgcttgcctgggaaagtcctacgcccaaatgtggcagcttatgtattttcatcgccgggacctgagactcgctgccaatgcgatttgtagcgccgtcccggtggattgggttcctacgtctcgcacaacctggtccatccacgctcaccatcagtggatgaccacagaggacatgctgagcgtgtggaaccgggtctggatcgaagagaatccctggatggaagataaaacccacgtgtcctcttgggaggaggttccctaccttggcaagagagaagaccagtggtgcgggagcctgattggactcacagcccgggccacgtgggctaccaacatccaagtggccattaatcaggtcagacgcctgatcggcaacgagaattatctggactacatgacatccatgaaacggttcaagaacgaaagcgatcctgagggggcgctctggtga

SEQ ID NO: 18657 - RNA, 9879 nt, synthetic construct
  misc_feature 1..9879: note = derived and/or modified CDS sequence (opt5) from DENV-1__KJ189346__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagatgagcggaaccacaaccatttttgctggccatcttaaatgccgcctgaagatggacaaactcacactgaaggggacctcctatgttatgtgtacgggcagcttcaaactggagaaggaagtggccgagacacagcacggaaccgtccttgtgcaagttaagtacgagggcaccgatgcgccgtgcaaaatccctttctctacacaggacgaaaagggggtgacccagaacggaagactcatcacagctaatcccattgtcacggataaagagaagcctgtgaacatcgaaaccgagcccccctttggcgagtcctatattgtggttggggccggagaaaaagccctgaagctgagctggttcaagaaaggctctagcatcgggaagatgtttgaggctacagcccggggcgctagacgcatggccattctcggagacaccgcgtgggatttcggctccatcgggggagtctttacatctgtgggcaaactggtgcatcaggtcttcgggaccgcctacggagtgctttttagcggcgtttcctggacgatgaagatcgggattggcatcctgctcacctggctgggactgaatagccggtctacatcccttagcatgacctgtattgctgtgggcatggtcacactctacctgggggtgatggttcaagccgactctggatgcgtgatcaactggaaaggcagagaactgaagtgtgggtccggaattttcgtcaccaacgaggtgcacacatggaccgaacagtataagtttcaggctgatagccctaaacgcctctccgccgcgatcggcaaggcctgggaggagggggtttgcggcattcggtctgctacgagactggaaaatatcatgtggaaacagatcagcaacgagcttaatcatattctgctcgaaaacgacatgaagttcacagtggtcgtgggagacgccaatggcatcctggctcaagggaaaaagatgattcgcccgcagcccatggagcacaaatactcctggaagtcttggggaaaggccaaaatcattggcgccgatatccagaacaccacctttatcattgacgggcctgatacacccgaatgtcctgacaatcagcgggcttggaacatctgggaggtggaggattatggattcggcatttttaccacgaatatctggctgaagcttagagacagctacacacaaatgtgcgatcaccgcctcatgtccgcggccattaaagacagcaaggctgtccatgccgatatgggctattggatcgaatctgagaaaaacgaaacctggaagctggcccgggcttccttcatcgaggttaagacatgtacctggcccaaaagccacacactgtggtctaatggggtgatggaatccgagatgattatcccgaagatttacggaggccctatcagccagcataactatagacccgggtacttcacccagacggccggaccttggcacctcggcaaactggagcttgactttgatctgtgcgaagggaccacagtggtcgtggacgagcactgcggaaatcgcggcccctctctccggaccacaaccgttacgggcaagattatccatgaatggtgttgcagaagctgtacactgcctcccctgcggttccgcggggaggatggatgctggtacggcatggagatcagaccggtgaaagaaaaggaggaaaaccttgtccggtccatggtgagcgcggggtctggagaggttgactcctttagcctcggcattctgtgtgcttccatcatgattgaagaggtgatgagatctcgctggagccggaagatgctgatgaccgggacactcgccgtcttcctgcttctggtgatgggacaactcacctggaatgacctgatcagactgtgcattatggttggcgccaacgcttccgatcgcatgggcatggggaccacatatcttgccctgatggcgacgtttaaaatgagacctatgttcgctgtgggactcctgtttcggcgcctcacctctagagaggtcctgcttctgacaatcggcctcagcctggtggcctccgtggaactgcccaactctcttgaggaactgggggacggactcgccatgggcattatgatgctgaagctcctgaccgagttccagccccaccagctttggacaaccctgctcagcctgacgtttatcaaaacaaccctgtcccttgattacgcttggaagaccacagccatggctctgagcatcgtctctctcttccctctgtgtctctccaccacaagccagaaaacgacctggctgccggttcttctggggtcttttggatgcaagcccctgacaatgttcctcattaccgaaaataagatctggggccggaaatcctggcctctgaacgagggcattatggccatcgggattgtgagcatccttctgtcttccctcctgaagaatgacgtgcccctcgcgggacctctgatcgccggcgggatgcttattgcttgttatgtcatcagcggatccagcgccgatctgtctctggagaaagctgccgaagtgagctgggagcaagaagccgagcattccggcacatctcacaacattctcgttgaagtgcaggacgatgggaccatgaagatcaaagacgaggagcgcgatgacacgctgaccattcttctgaaggctacactcctggcggtcagcggagtgtaccccatgtccatccctgccaccctctttctgtggtatttctggcagaaaaagaagcagagatctggcgttctttgggatacacccagcccgcctgaagtggagcgggctgtcctggacgatggcatctaccgcattctgcaaagagggctcctgggacggtcccaggtgggcgtcggggtgttccaggacggagtttttcataccatgtggcacgtgacacgcggcgccgtccttatgtatcaggggaaaagactggaaccctcttgggccagcgtgaagaaagacctcatctcctacggaggcggctggcggttccaagggagctggaatacgggagaggaggttcaggtgattgctgtcgaacctggcaagaaccccaaaaatgtgcagaccacaccggggacctttaagacccctgagggagaagtgggcgccatcgcgctggatttcaagcccgggacatctggatcccctattgttaacagagagggcaaaatcgtcggcctctacgggaatggagtggtgacgaccagcggcacatatgtctctgctattgcccaagccaaggcttcccaggaagggcccctgcccgagatcgaggacgaagtgtttaaaaagcgcaaccttaccatcatggatctgcaccctggaagcggcaaaacacggagatacctgccggccattgttcgcgaggcgatcaagcggaagctcagaaccctgattcttgctcccacgcgcgtggtcgcctccgaaatggccgaggctctgaaagggatgcctatccggtatcagacaaccgccgtgaagtctgaacataccggcagagagattgttgacctcatgtgccacgctacattcaccatgcgcctgctgagccccgtgcgggtccctaattacaacatgatcatcatggatgaggcccattttacagaccccgcgtccattgccgctagaggatatatcagcacccgggtgggcatgggggaagccgctgccattttcatgacggccacacctccgggatctgttgaggcttttccccagtccaatgcggtgatccaagatgaagagcgcgacattcctgaaagaagctggaactctggctacgattggatcaccgacttccccgggaaaacagtctggtttgtgcctagcatcaagtccggaaatgatattgccaactgtctccggaaaaacggcaagcgcgtgatccagctttctagaaagaccttcgacacggagtatcagaaaaccaagaataacgactgggattacgtcgttacaaccgacattagcgagatgggggctaatttccgggccgatagagtgatcgacccccgccggtgcctgaaaccggtgattctgaaggatggccctgaaagagtcatcctcgccggacccatgcccgtgacagttgcttccgccgcgcagcgccggggcagaattgggcgcaaccaaaataaagagggagaccagtacgtgtatatgggccagcctctgaacaatgatgaagaccacgctcattggaccgaggccaagatgcttctggataacatcaatacacccgaggggatcattcctgccctctttgaaccggagcgggaaaagtctgctgccatcgacggagagtacagactgcgcggcgaagcgagaaaaaccttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatttggacgaaagaaggcgagagaaagaaactgcggcctagatggctcgacgctcgcacatattctgatcccctggcccttcgggagtttaaggaattcgctgccgggagacgctccgtgagcggagacctgatcctcgagattggcaaactgcctcagcacctgacctcccgggctcagaatgccctcgataaccttgtcatgctgcacaattctgaacaggggggaaaggcgtacagacatgccatggaggaactgcccgacaccatcgagacactcatgctgcttgctctgatcgccgtgctcaccggcggcgttacactgtttttcctgagcgggaagggactcggcaaaacgtccattgggcttctgtgtgtgaccgcttctagcgccctgctctggatggcctccgtggagccgcactggatcgctgcgagcattatcctggaatttttccttatggtcctgctcattcctgagcccgatcggcaacgcacacctcaggacaaccagctggcctatgttgtgatcggactgctctttatgatccttaccgtggctgccaacgaaatgggcctgctggagacaaccaagaaagatctcgggattggacatgtcgccgctgagaatcaccaacacgccacgatgctggacgtggatcttagacccgcgtctgcctggaccctgtacgctgttgccacaaccgtgatcacacctatgatgcggcataccattgaaaacacgacagctaatatctccctcaccgccattgcgaaccaggccgctatcctgatgggcctggacaagggctggcccattagcaaaatggatatcggggtcccgctccttgccctgggatgctactctcaggtgaatcctctgacactcaccgctgccgtcctgatgcttgtggctcactatgccatcattggccccgggctgcaggcgaaggccacccgcgaggctcaaaagagaacagccgctggaatcatgaaaaaccccacggttgacggcattgtggccatcgatctcgaccctgtcgtgtacgacgccaagttcgaaaaacagctggggcagattatgctgctcatcctttgtacctcccagatcctgctgatgcggacaacctgggcgctctgcgagagcattacactggctaccggaccgcttacgacactgtgggaaggctctcccggcaagttttggaataccaccatcgccgttagcatggctaacattttccgcgggtcctatctcgccggagccggcctggctttctctctgatgaaaagcctcgggggaggcagacgggggacaggagcccaaggcgagacccttggcgagaagtggaagcgccagctgaatcagctgtccaaaagcgaatttaacacatacaagagatccgggatcatggaggtggatcggtctgaagcgaaagagggactcaagagaggcgaaacgaccaaacatgccgtcagccgcgggacagctaagctgcggtggttcgtggagagaaatcttgtgaagcctgagggaaaagttattgacctgggctgtgggcgcggaggctggtcctattactgcgccggcctcaagaaagtcaccgaagtgaaggggtatacaaaaggaggccccgggcacgaggaacctatccccatggctacctacggatggaacctggccaagctgcattctggcaaagatgtgtttttcatgcctccggagaagtgtgacacgctcctttgcgatatcggggaaagctcccccaatcctaccattgaggagggacggacactgagagtcctgaagatggttgaaccctggctccgcggcaaccagttttgtatcaaaattctgaatccttacatgccctctgtggtggagacccttgaacaaatgcagcggaagcacggcgggatgctggtcagaaacccgctcagccgcaattccacacacgagatgtattgggtgagctgcggaaccggcaacatcgtttctgcggtgaacatgacatcccggatgctgctgaatagattcaccacggcccatcgcaaacctacatacgagcgggacgtcgatctcggggctggaaccagacacgtggccgttgaacccgaggtggctaacctggacattatcggccagcgcattgaaaatatcaagaacgagcataaaagcacctggcactatgatgaagacaatccctacaagacatgggcctatcacgggtcttacgaggtcaagccttccggaagcgcttcttccatggtgaacggcgtggtcagacttctgacgaaaccctgggatgttatccctatggtgacccaaattgccatgacagacaccacaccgtttggccagcagcgggtgttcaaggagaaagtcgacacccgcacacccagagcgaagcgggggaccacgcagatcatggaagtgaccgccaaatggctctggggatttctgagcagaaataagaagcctcggatttgtacacgcgaggaattcaccagaaaagttcggtccaacgctgccatcggcgctgtgtttgtcgatgagaatcaatggaacagcgccaaggaagccgtggaggacgagcgcttctgggatcttgttcatagagaacgggagctgcacaaacaggggaagtgcgcgacatgcgtgtataatatgatgggaaaacgcgaaaagaagctcggcgagtttgggaaagctaagggctctagagccatttggtacatgtggctgggagcccggttcctggaattcgaggctctcggctttatgaacgaggaccattggttcagccgcgaaaattccctgtctggggtcgagggagaaggccttcacaaactggggtacatcctcagagatatcagcaagattcccggaggcaacatgtatgccgacgataccgctgggtgggacacgcggatcacagaggatgacctgcagaatgaggccaaaattaccgaaatcatggagcctgaacatgcgcttctggccacatccatttttaagctcacctaccagaacaaagtggttcgcgtgcaaagacccgctaagaacggcacggtcatggatgtgatctctcggcgcgaccagagaggaagcggccaggtcgggacctatggactgaatacattcaccaacatggaggtgcagctgatccggcaaatggaatccgagggcatttttctcccgtctgagctggaaacacctaatcttgccgagagagttctggattggctcgaaaagcacggggctgagcgcctgaaacggatggccatcagcggagacgactgtgtggtcaagcccattgatgacagattcgcgaccgcccttacagctctgaacgatatgggcaaagtgcgcaaggacatcctccagtgggaaccttccaaagggtggaatgattggcagcaggtgcccttttgcagccaccatttccaccaactgattatgaaggacggccgggagatcgttgtgccttgtagaaaccaggatgagctggtcggacgcgcccgggtgtctcagggcgctgggtggtccctcagagaaaccgcctgcctgggaaagagctacgctcaaatgtggcagcttatgtattttcatcgccgggacctgagactcgccgcgaatgccatctgttctgctgttcccgtggattgggtcccgacgtcccgcacaacctggagcattcacgcccaccatcagtggatgaccacagaggacatgctgtccgtgtggaaccgggtctggatcgaagagaatccttggatggaagataaaacccacgtgtctagctgggaggaggttccctaccttggcaagagagaagaccagtggtgcgggtccctgattggactcacagcccgggctacgtgggccaccaacatccaagtggcgattaatcaggtcagacgcctgatcggcaacgagaattatctggactacatgacaagcatgaaacggttcaagaacgaatctgatcccgagggggctctctggtga

SEQ ID NO: 18658 - RNA, 9879 nt, synthetic construct
  misc_feature 1..9879: note = derived and/or modified CDS sequence (opt5) from DENV-1__KJ189347__SS-prME
  source 1..9879: mol_type = other RNA
agcgtgaccatgctgctgatgctgcttcccaccgccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccgcagatcacagaggctgaacccgacgatgtggactgttggtgcaatgccaccgatacgtgggtgacctatggaacatgttcccagaccggcgagcaccgcagagacaagcggtctgttgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcccgttcaaactggagaaggaagtggccgagacccagcacggaaccgtccttgtgcaagttaagtacgagggcacagatgcgccttgcaaaatccccttcctcacccaggacgaaaagggggtgacacagaacggaagactgatcacggctaatcctattgtcaccgataaagagaagcccgtgaacatcgaaacagagcccccttttggcgagagctatattgtggttggggccggagaaaaagccctgaagctctcttggttcaagaaaggctccagcatcgggaagatgtttgaggctaccgcccggggcgctagacgcatggccattctgggagacacagcgtgggatttcggctctatcgggggagtctttaccagcgtgggcaaacttgtgcatcaggtcttcgggacggcctacggagtgctgttttccggcgtttcttggaccatgaagatcgggattggcatcctcctgacatggctgggacttaatagccggtccaccagcctctctatgacatgtattgctgtgggcatggtcaccctgtacctgggggtgatggttcaagccgactccggatgcgtgatcaactggaaaggcagagaactcaagtgtgggagcggaattttcgtcacaaacgaggtgcacacctggacggaacagtataagtttcaggctgattctccgaaacgcctgtccgccgcgatcggcaaggcctgggaggagggggtttgcggcattcggagcgctacaagacttgaaaatatcatgtggaaacagatctccaacgagctgaatcatattctcctggaaaacgacatgaagttcaccgtggtcgtgggagacgccaatggcatcctggctcaagggaaaaagatgattcgcccccagcctatggagcacaaatactcttggaaaagctggggaaaggccaagatcattggcgccgatatccagaacaccacatttatcattgacgggcccgatacccctgaatgtcccgacaatcagcgggcttggaacatctgggaggtggaggattatggattcggcatttttacgacaaatatctggcttaagctcagagactcctacacccaaatgtgcgatcaccgcctgatgtctgcggccattaaagacagcaaggctgtccatgccgatatgggctattggatcgaatccgagaaaaacgaaacatggaagctggcccgggctagcttcatcgaggttaagacctgtacatggccgaaatctcacaccctctggtccaatggggtgctggaaagcgagatgattatccctaagatttacggaggccccatctctcagcataactatagacctgggtacttcacgcagaccgccggaccctggcaccttggcaaactggagctcgactttgatctgtgcgaagggacaaccgtggtcgtggacgagcactgcggaaatcgcggcccttccctgcggacaaccacggttacaggcaagattatccatgaatggtgttgcagaagctgtacccttcccccgctccggttccgcggggaggatggatgctggtacggcatggagatcagacctgtgaaagaaaaggaggaaaacctggtccggtctatggtgagcgcggggtccggagaggttgacagcttttctctgggcattctctgtgtgtccatcatgattgaagaggtcatgagaagccgctggtcccggaagatgctgatgacagggacccttgctgtgttcctgctcctggttatgggacaactgacctggaatgaccttatcagactgtgcattatggtgggcgccaacgcctctgatcgcatgggcatggggacaacgtatctcgctctgatggccacctttaaaatgagacccatgttcgcggtcggactcctgtttcggcgccttacaagcagagaggtgctgctcctgaccatcggcctgtcccttatggcttctgtggaactgcccaacagcctcgaggaactgggggacggactcgccatgggcattatgatgctgaaacttctgacagagttccagcctcaccagctctggaccacgctgctgtcccttacatttatcaaaaccaccctgtctctcgattacgcctggaagacaaccgctatggccctgagcatcgtctccctcttcccgctgtgtcttagcacaacgtctcagaaaaccacatggctgcccgttctgctcgggtcctttggatgcaagcctctgaccatgttccttattacagaaaataagatctggggccggaaaagctggcccctgaacgagggcattatggctatcgggattgtgtctatcctcctgtccagcctcctgaagaatgacgtgcctcttgccggacccctgatcgcgggcgggatgctgattgcctgttatgtcatctctggatccagcgctgatctctccctggagaaagccgctgaagtgagctgggagcaagaagccgagcattctggcaccagccacaacattcttgttgaagtgcaggacgatgggacgatgaagatcaaagacgaggagcgcgatgacaccctgacaattctcctgaaggccaccctcctggctgtctccggagtgtaccctatgtctatccccgcgacactttttgtttggtatttctggcagaaaaagaagcagagaagcggcgtgctgtgggataccccgtcccctcccgaagtcgagcgggccgtgctggacgatggcatctaccgcattctccaaagagggctgcttggacggtctcaggtcggcgtgggggttttccaggacggagtgtttcatacaatgtggcacgtcacgcgcggcgctgtgctgatgtatcaggggaaaagactcgaacctagctgggcctccgttaagaaagacctgatctcttacggaggcggctggcggttccaagggagctggaataccggagaggaggtgcaggtcattgccgtggaacccggcaagaacccgaaaaatgtgcagacaacccctgggacctttaagacacccgagggagaagttggcgctatcgccctcgatttcaagcctgggacgtccggaagccccattgtcaacagagagggcaaaatcgtgggcctgtacgggaatggagtggtcaccacatctggcacctatgtgtccgcgattgctcaagccaaggccagccaggaagggccccttcctgagatcgaggacgaagtttttaaaaagcgcaacctgacaatcatggatctgcacccgggatctggcaaaacccggagatacctccccgctattgtgcgcgaggccatcaagcggaagctgagaacgcttattctggcgcctacacgcgtcgtggcttccgaaatggccgaggccctcaaagggatgcccatccggtatcagaccaccgctgttaagagcgaacatacaggcagagagattgtggacctgatgtgccacgccaccttcacaatgcgcctgctctcccctgtccgggtgcccaattacaacatgatcatcatggatgaggctcattttaccgaccctgcctctattgcggccagaggatatatcagcacgcgggttggcatgggggaagctgccgctattttcatgacagccaccccgcccggatccgtggaggcctttcctcagagcaatgctgtcatccaagatgaagaacgcgacattcccgaaagatcttggaactccggctacgattggatcacagacttccctgggaaaaccgtgtggtttgtgcccagcatcaagtctggaaatgatattgcgaactgtcttcggaaaaacggcaagcgcgtcatccagctgagcagaaagacgttcgacaccgagtatcagaaaacaaagaataacgactgggattacgttgtgaccacagacatttccgagatgggggccaatttccgggctgatagagtgatcgacccgcgccggtgcctgaaacctgtcattctcaaggatggccccgaaagagtgatcctggccggacccatgcctgttaccgtggcctctgctgcccagcgccggggcagaattgggcgcaaccaaaataaagagggagaccagtacgtctatatgggccagccccttaacaatgatgaagaccacgcgcattggacagaggctaagatgctgctcgataacatcaatacccctgaggggatcattccggccctgtttgaacccgagcgggaaaagagcgccgctatcgacggagagtacagactgcgcggcgaagccagaaaaacgttcgtggagctcatgcggcgcggggatcttcctgtttggctgtcctataaggtggcgtctgagggctttcagtacagcgacagacggtggtgcttcgatggagaacgcaacaatcaagtcctggaggaaaacatggacgtggagatttggacaaaagaaggcgagagaaagaaactccggcccagatggctggacgcccgcacctattccgatcctcttgctctgcgggagtttaaggagttcgccgctgggagacgcagcgtctctggagacctcatcctggagattggcaaactgccccagcacctcacccttcgggcccagaatgctctggataacctggtgatgctccacaattccgaacaagggggaaaggcctacagacatgcgatggaggaactgccggacacaatcgagacccttatgctgctcgccctgatcgctgttctgacaggcggcgtgacgctctttttccttagcgggaagggactgggcaaaacctccattgggctgctctgtgtgacagcctctagcgctctgctttggatggcctccgtcgagcctcactggatcgccgcttctattatcctggaatttttcctcatggttctgctgattcccgagcctgatcggcaacgcacaccccaggacaaccagctcgcgtatgtggtgatcggacttctgtttatgatcctgacagtcgccgctaacgaaatgggcctcctggagaccacgaagaaagatcttgggattggacatgtggccgccgagaatcaccaacacgctaccatgctggacgttgatctcagacctgccagcgcgtggacactgtacgccgtggctaccacagtcatcacccccatgatgcggcatacgattgaaaacacaaccgccaatatctccctgacagctattgccaaccaggcggccatcctcatgggccttgacaagggctggccgattagcaaaatggatatcggggtgcctctgctggctctcggatgctactctcaggtcaatcccctgacccttaccgccgctgtgctgatgctcgttgcccactatgctatcattggccccgggctgcaggccaaggcgacacgcgaggcccaaaagagaacggctgccggaatcatgaaaaaccctaccgtggacggcattgtcgctatcgatctggacccggtggtttacgacgccaagttcgaaaaacagctcgggcagattatgcttctgatcctgtgtacatcccagatcctcctgatgcggaccacatgggccctttgcgagagcattaccctggcgacgggacccctcacaaccctgtgggaaggctctcctggcaagttttggaataccacaatcgctgtgtccatggccaacattttccgcgggagctatctggctggagccggcctcgccttctctcttatgaaaagcctcgggggaggcagacgggggaccggagctcaaggcgagacactgggcgagaagtggaagcgccagctcaatcagctgtccaaatctgaatttaacacgtacaagagaagcgggatcatggaggtcgatcggtccgaagccaaagagggacttaagagaggcgaaaccacaaaacatgcggtgagccgcgggaccgccaagctgcggtggttcgtggagagaaatctcgttaagcccgagggaaaagtcattgacctgggctgtgggcgcggaggctggtcctattactgcgctggcctgaagaaagtgacagaagtgaaggggtataccaaaggaggccctgggcacgaggaacccatccctatggccacgtacggatggaacctcgtcaaacttcattctggcaaagatgtctttttcatgccgcccgagaagtgtgacaccctgctgtgcgatatcggggaaagctcccctaatcccacaattgaggagggacggaccctcagagtgctgaagatggtggaaccttggcttcgcggcaaccagttttgtatcaaaattctgaatccctacatgccgtctgtcgtggagacactcgaacaaatgcagcggaagcacggcgggatgctggttagaaaccctctgagccgcaattccacccacgagatgtattgggtgtcttgcggaacaggcaacatcgtcagcgctgtgaacatgacctcccggatgctcctgaatagattcacgatggcccatcgcaaacccacatacgagcgggacgttgatcttggggcgggaaccagacacgtggccgtcgaacccgaggtggctaacctggacattatcggccagcgcattgaaaatatcaagaacgagcataaaagcacctggcactatgatgaagacaatccttacaagacatgggcctatcacgggtcttacgaggtgagaccctccggaagcgcttcttccatggtcaacggcgttgtgcggctcctgacgaagccttgggatgtgatcccgatggtcacccaaattgccatgacagacaccacaccctttggccagcagcgcgtgttcaaagagaaggttgacaccagaacacctcgggctaaaagagggaccacgcagatcatggaagtgaccgccaagtggctttggggatttctgagccggaataaaaagccccgcatttgtacaagagaggagttcacccggaaggtccgctctaacgcggccatcggcgctgtgtttgttgatgagaatcaatggaactccgccaaagaagctgtggaggacgagagattctgggatctcgtccatcgggaacgcgagctgcacaagcaggggagatgcgccacatgcgtgtataatatgatgggaaaacgggaaaagaaactgggcgagtttgggaaggccaagggcagccgcgcgatttggtacatgtggctcggagctagattcctggagttcgaggcccttggctttatgaacgaggaccattggttctcccgggaaaatagcctgtctggggttgagggagaaggcctccacaaactggggtacatccttcgcgatatcagcaagattcctggaggcaacatgtatgccgacgataccgctgggtgggacacgagaatcacagaggatgacctgcagaatgaggccaaaattaccgaaatcatggagcccgaacatgctctcctggccacatccatttttaagctgacctaccagaacaaagtggtccgggtgcaacgcccggcgaagaacggcacggtcatggatgtgatctctagacgggaccagagaggaagcggccaggttgggacctatggactcaatacattcaccaacatggaggtgcagctgatccgccaaatggaatccgagggcatttttcttccttctgagctggaaacacccaatctcgccgagcgggtcctggattggcttgaaaaacacggggctgagagactgaagcgcatggccatcagcggagacgactgtgtggtgaagcctattgatgaccggttcgctaccgccctcacagcgctgaacgatatgggcaaagttagaaaggacatcccccagtgggaaccttccaaagggtggaatgattggcaacaggtgcccttttgctctcaccatttccaccaactgattatgaaggacggccgcgagatcgtcgtgccgtgtcggaaccaggatgagctcgttggcagagctcgcgtgagccagggagctgggtggtccctgcgggaaaccgcctgccttggaaaaagctacgctcaaatgtggcagctgatgtattttcatagacgcgacctccggctggccgctaatgccatctgttctgcggtccctgtggattgggtccccacgtccagaacaacctggagcattcacgcccaccatcagtggatgaccacagaggacatgctttctgtgtggaaccgggtttggatcgaagagaatccctggatggaagataagacccacgtgtccagctgggaggaggtcccttacctgggcaagagagaagaccagtggtgcgggtccctcattggactgacagctcgcgccacgtgggccaccaacatccaagtggctattaatcaggttcggagactgatcggcaacgagaattatctcgactacatgacatctatgaaacgcttcaagaacgaaagcgatccggagggggccctgtggtga

SEQ ID NO: 18659 - RNA, 9879 nt, synthetic construct
  misc_feature 1..9879: note = derived and/or modified CDS sequence (opt5) from DENV-1__KJ189348__SS-prME
  source 1..9879: mol_type = other RNA
agcgtgaccatgctgctgatgctgcttcccacagccctggctttccacctcacgaccagaggcggggaacctcatatgatcgtctccaagcacgaacggggaaaatctctgctttttaagacaagcgccggcgttaatatgtgcaccctgattgcgatggacctcggggaactgtgtgaagatacaatgacctacaaatgcccccgcatcacagaggctgaacccgacgatgtggactgttggtgcaatgccaccgatacgtgggtgacctatggaacatgttcccaaaccggcgagcatagacgggacaagcgctctgtcgccctggctcctcacgtggggctcggactggagacaagaaccgaaacgtggatgagctccgagggcgcctggaaacaaattcagcgggttgaaacatgggctcttagacatcccggcttcaccgtgatcgccctgtttctcgcgcacgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccagggagaggccaccctcgtggaagaacaagatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcataccggcgatcagcaccaggttgggaatgagacaaccgaacatggaacaatcgctaccattacgccccaagcccctacctccgagatccagctgacagactacggcgccctcaccctggactgtagcccccggacaggccttgatttcaacgaaatggtgctgctcaccatgaaggagaaatcttggctggtccacaagcagtggtttcttgacctgcctctcccctggacgtccggggctagcacatcccaggagacctggaatcgccaagatctgctggtgacattcaaaaccgcgcacgccaagaagcaggaagtcgtggttctcggatctcaggagggcgctatgcataccgccctgacaggggccacggaaattcaaaccagcggaacaaccacaatctttgctggccaccttaaatgcagactgaagatggacaaactcaccctgaaggggacgtcctatgtgatgtgtacaggcagcttcaaactggagaaggaagtcgccgagacccagcatggaaccgtgcttgttcaggtgaagtacgagggcacagatgcgccgtgcaaaattcctttctctacccaggacgaaaagggggtcacacaaaacggacggctcatcacggctaatcccatcgtgaccgataaagagaagcctgtgaacattgaaacagagccgccctttggcgagtcctatatcgttgtcggggccggagaaaaagccctgaagctgagctggttcaagaaaggctctagcattgggaagatgtttgaggctaccgccagaggcgctcgccggatggccatcctcggagacacagcgtgggatttcggctccattgggggagtgtttacctctgtgggcaaactggtccaccaggtgttcgggacggcctacggagttctttttagcggcgtgtcctggaccatgaagatcgggatcggcattctgctcacatggctgggactgaatagcagatctacctccttcagcatgacatgtatcgctgtcggcatggtgaccctttacctcggggttatggtgcaggccgactctggatgcgtcattaactggaaaggccgcgaactgaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgcctcgaaaatattatgtggaaacagatcagcaacgagctgaatcacatccttctggaaaacgacatgaagtttaccgtcgtggtgggagacgccaatggcattctcgctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggctgaagctgcgcgatagctacacccagatgtgcgaccatcggcttatgtccgcggccatcaaagatagcaaggctgttcacgccgacatgggctattggattgaatctgagaaaaatgaaacatggaagctcgccagagcttccttcatcgaggtgaagacctgtacatggcccaaaagccataccctgtggtctaacggggtgctggaatccgagatgatcattccgaagatctacggaggccctattagccagcacaattatcgccccgggtactttacgcaaaccgccggaccttggcacctcggcaaactggagcttgatttcgacctgtgcgaagggacaaccgtcgtggttgatgagcattgcggaaaccggggcccctctctcagaacaaccacggtgacaggcaagatcattcacgaatggtgttgccggagctgtaccctgcctcccctgcgctttagaggggaggacggatgctggtacggcatggagatccggccggtcaaagaaaaggaggaaaatcttgtgagatccatggttagcgcggggtctggagaggtggactccttcagcctcggcatcctgtgtgtctccattatgatcgaagaggtgatgcgctctcggtggagcagaaagatgctgatgacagggaccctcgctgtttttctgcttctgattatgggacagctcacctggaacgatctgatccgcctgtgcattatggtgggcgccaatgcctccgacagaatgggcatggggacaacgtatcttgctctgatggccaccttcaaaatgcggcctatgtttgcggtcggaatcctcttccgcagactgacatctcgggaggtgctcctgcttaccattggcctgagcctcgtggcttccgtcgaactgcccaactctctggaggaacttggggatggactggccatgggcatcatgatgctcaagctgctcacagagtttcagccccatcaactgtggaccacgcttctgagcctcacattcatcaaaaccaccctgtccctggactacgcctggaagacaaccgctatggcccttagcattgtttctctgtttcctctctgtctgtccacaacgagccagaaaaccacatggctcccggtgctgcttgggtctttcggatgcaagcccctgaccatgtttctgatcacagaaaacaagatttggggccgcaaatcctggcctatcaatgagggcattatggctatcgggatcgtgagcattctcctgtcttcccttctgaagaacgatgtccccctcgccggacctctgatcgcgggcgggatgctcattgcctgttatgtgatcagcggatccagcgctgacctgtctcttgagaaagccgctgaagttagctgggagcaggaagccgagcactccggcacctctcataatattctggtggaagtccaggatgacgggacgatgagaatcaaggatgaggagaaagacgataccctgacaatcctcctgaaggccacccttctggctgtgagcggagtttaccccatgtccattcctgcgacactcttcgtgtggtatttctggcagaagaagaagcagcggtctggcgtcctgtgggacacccccagcccgcctgaagtggagcgcgccgtcctcgatgacggcatctaccgcattctgcagcgggggcttctgggacgctcccaggtgggcgttggggtgtttcaagacggagtcttccacacaatgtggcacgtgacgagaggcgctgttctgatgtatcaggggaaacggctcgaaccctcttgggccagcgtgaagaaagatctgatctcctacggaggcggctggagatttcaggggagctggaacaccggagaggaggtccaggtgattgccgtggaacctggcaagaatcccaaaaacgttcaaacaaccccggggaccttcaagacacctgagggagaagtcggcgctatcgcccttgactttaagcccgggacgtctggatcccctattgtgaatcgcgagggcaaaatcgtgggcctgtacgggaacggagtcgtgaccacaagcggcacctatgtttctgcgatcgctcaggccaaggcctcccaggaagggcccctccccgagattgaggatgaagtgttcaaaaagcggaatctgacaatcatggacctccatcctggaagcggcaaaaccagacgctacctgccggctattgtccgggaggccatcaagagaaaacttcgcacgctgattctggcgcccacacgggtggttgcttccgaaatggccgaggccctcaaagggatgcctatcagatatcaaaccaccgctgtgaagtctgaacacacaggccgcgagatcgtcgatctgatgtgccatgccacctttacaatgcggcttctgagccccgtgagagttcctaactacaatatgattatcatggacgaggctcacttcaccgatcccgcctccattgcggcccggggatatatcagcacgcgcgtgggcatgggggaagctgccgctatttttatgacagccacccctccgggatctgtcgaggccttcccccagtccaacgctgtgatccaggacgaagagagagatatccctgaacggagctggaactctggctacgactggattacagattttcccgggaaaaccgtgtggttcgtccctagcatcaagtccggaaacgacattgcgaattgtctccgcaaaaacggcaagagagttatccagctgtctcggaagacgttcgacaccgagtatcagaagacaaagaacaatgattgggactacgtggtgaccacagatattagcgagatgggggccaactttagagctgaccgcgtcatcgatccccggagatgcctgaaaccggtgattctcaaggacggccctgaacgcgttatccttgccggacccatgcccgtgaccgtcgcctccgctgcccagcggagaggccgcatcgggcggaatcagaacaaagagggagatcagtacgtgtatatgggccaacctctgaataacgacgaagatcatgcgcactggacagaggctaagatgctgctcgacaatattaacacccccgaggggatcattcctgccctgttcgaaccggagagagaaaagtctgccgctatcgatggagagtaccgccttagaggcgaagcccggaaaacgtttgttgagctgatgcgcagaggggacctccccgtgtggctgagctataaggtcgcgtccgagggcttccagtacagcgatcggcgctggtgctttgacggagaaagaaataaccaggtgctggaggaaaatatggacgtcgagatttggacaaaagaaggcgagcggaagaaactcagacctcgctggcttgatgcccggacctattctgaccccctggctctgagagagttcaaggaatttgccgctgggcgccggtccgtgagcggagatctcatcctggagatcggcaaacttcctcagcacctgaccctcagagcccaaaacgctctggacaatctggttatgctccataactccgaacaagggggaaaggcctaccggcacgcgatggaggaacttcccgatacaattgagaccctgatgctgctcgccctgatcgctgtgcttacaggcggcgtgacgctgttctttctctctgggaagggactgggcaaaaccagcattgggctgctctgtgtcacagcctcctctgcccttctgtggatggccagcgttgagccgcattggatcgccgcttccattatcctggagttctttctcatggtgctgcttatccctgagcccgaccgccagagaacccctcaggataatcaactggcgtatgtggtcattggactcctgttcatgatcctgacagtggccgctaacgaaatgggcctccttgagaccacgaagcgggacctggggattggacacgttgccgccgagaaccaccagcatgctaccatgctggatgtggacctccgccccgccagcgcgtggacactgtacgccgtcgctaccacagtgatcacccctatgatgagacacacgattgaaaatacaaccgccaacatctctcttacagctattgccaatcaggcggccatcctgatgggcctcgataaaggctggcccatctccaagatggacattggggtcccgctgctggctctcggatgctacagccaagtgaaccctcttaccctgaccgccgctgttctgatgctcgtggcccattatgctatcattggccccgggctgcaggccaaagcgacacgggaggcccagaagcgcacggctgccggaatcatgaagaatcccaccgtcgatggcattgtggctatcgaccttgaccctgttgtgtacgatgccaaatttgaaaagcagctggggcaaatcatgctcctgattctgtgtacatctcagatcctccttatgagaaccacatgggccctgtgcgagtccattaccctggcgacgggaccgctcacaaccctgtgggaaggcagccccggcaaattctggaacaccacaatcgctgtctctatggccaatattttccgggggagctatcttgctggagccggcctggccttttccctcatgaagtctctcgggggaggccgcagagggaccggagctcagggcgagacactgggcgagaaatggaagcggcagctcaaccaacttagcaagcctgagttcaatacgtacaaaagatccgggatcatggaggtggaccgcagcgaagccaaggagggactgaaacggggcgaaaccacaaagcacgcggtgtccagagggaccgccaaactgcgctggtttgttgagcggaacctcgtcaagcccgagggaaaggtgatcgatctgggctgtgggagaggaggctggtcttattactgcgctggccttaaaaaggtgacagaagtcaaagggtataccaagggaggccctgggcatgaggaacccattcctatggccacgtacggatggaatctggttaaactccacagcggcaaggacgtgttctttatgccgcccgagaaatgtgataccctgctgtgcgacatcggggaatcctctcctaaccccacaattgaggagggacgcaccctccgggtgcttaagatggtcgaaccttggctgagaggcaatcagttctgtatcaagattctgaacccctacatgccgagcgtggttgagacactcgaacagatgcagcgcaaacacggcgggatgctggtgcggaatcctctttccagaaactctacccatgagatgtattgggtcagctgcggaacaggcaatatcgtgtccgctgttaacatgaccagccgcatgctgctcaaccggtttacgatggcccacagaaagcccacatacgagcgcgatgtggacctgggggcgggaaccagacatgtcgccgtggaacccgaggtggctaatctggatattatcggccaacggatcgaaaacattaaaaatgagcacaagtctacctggcactatgacgaagataacccttacaaaacatgggcctatcatgggtcctacgaggtcaagcccagcggatctgcttccagcatggttaatggcgtggtgcgcctcctgacgaagccttgggacgtcatcccgatggtgacccagattgccatgacagacaccacacccttcggccagcaaagagtttttaaagagaaggtggatacccggacacctagagctaaacgggggaccacgcagatcatggaagtcaccgccaagtggctttggggattcctgtctcgcaacaaaaagcccagaatttgtacacgggaggaatttacccgcaaggtgagatccaatgcggccatcggcgctgttttcgtggacgagaaccagtggaatagcgccaaagaagctgtcgaggatgagcggttttgggacctcgtgcaccgcgaaagagagctgcataagcaggggaaatgcgccacatgcgtttataacatgatgggaaagcgggagaagaaacttggcgagttcgggaaagccaaaggctcccgcgcgatctggtacatgtggctgggagctagattcctcgaatttgaggccctgggcttcatgaatgaggatcactggtttagccgggaaaactctctgagcggggtggagggagaaggcctccataagctggggtacattcttcgcgacatctccaaaattcctggaggcaatatgtatgccgatgacaccgctgggtgggatacgagaatcacagaggacgatctgcaaaacgaggccaagattaccgacatcatggaacccgagcacgctctcctggccacatctatcttcaaacttacctaccagaataaggtcgtgcgggtccagcgcccggcgaaaaacggcacggtgatggatgttattagcagacgggaccagagaggatccggccaagtggggacctatggactgaacacatttaccaatatggaagtccagctcatccgccagatggagtctgaaggcattttcctgcctagcgagctggagacacccaacctcgccgaacgggtgctgaattggcttgagaagcacggggctgaaagactgaagcgcatggccatctccggagacgattgtgtggttaaacctattgacgatcggtttgctaccgccctcacagcgctgaacgacatgggcaaggtgagaaaagatatcccccagtgggagccttctaaggggtggaatgactggcaacaggtccccttctgcagccatcactttcatcagcttatcatgaaagatggccgcgaaattgtggttccgtgtcggaaccaggacgagctggtgggcagagctcgcgtctcccaaggagctgggtggagcctccgggagaccgcctgcctgggaaagtcttacgctcagatgtggcagctgatgtatttccacagacgcgatctccggctggccgctaatgccatctgttccgcggtgcctgtcgactgggtgcccacgagcagaacaacctggtctattcacgcccatcaccaatggatgaccacagaagatatgctttccgtttggaaccgggtgtggatcgaggaaaatccctggatggaggacaagacccatgtcagctcctgggaagaggtgccttacctgggcaaaagagaggaccagtggtgcgggtctctcattggactgacagctcgcgccacgtgggccaccaacatccaggttgctattaatcaggtgcggagacttatcggcaacgaaaattatctggattacatgacaagcatgaagcgctttaaaaacgagtccgacccggaaggggccctctggtga

SEQ ID NO: 18660 - RNA, 9879 nt, synthetic construct
  misc_feature 1..9879: note = derived and/or modified CDS sequence (opt5) from DENV-1__KJ189368__SS-prME
  source 1..9879: mol_type = other RNA
agcgtgaccatgctgcttatgctgcttcccaccgctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccgcagatcacagaggctgaacccgacgatgtggactgttggtgcaatgccaccgatacgtgggtgacctatggaacatgttcccagaacggcgagcaccgcagagacaagcggtctgtcgccctggctcctcatgtggggctcggactggagacccgcacagaaacctggatgagctccgagggcgcctggaaacagattcagagagttgaaacgtgggcccttcggcaccccggcttcacagtgatcgccctgtttctcgcgcatgccattgggacctctatcacacagaagggaatcattttcatcctgcttatgctggtcacccctagcatggctatgcgctgcgtgggcattgggaatagagattttgttgagggactctccggcgccacctgggtggacgtcgtgctggagcacgggagctgtgtgacaacgatggctaagaacaaacccaccctggatatcgaactcctgaagacagaggtcaccaatcctgccattcttcggaaactgtgcatcgaagcgaagatttctaacacaaccacggactcccgctgtccgacacagggagaggccaccctcgttgaagaacaggatgctaatttcgtgtgcagacggacctttgtggaccgcggctggggcaacgggtgtggactgttcggcaaagggagccttctgacatgcgccaagtttaagtgcgtcaccaaactcgagggaaagatcgtgcagtacgaaaatctgaaatattctgttatcgtgacagtccacacgggcgatcaacatcaggtggggaacgagaccacagaacacggaaccattgctacaatcacaccccaggcccctacgtccgagattcagctgaccgactacggcgccctcacactggactgtagccccagaaccggccttgatttcaatgaaatggttctgctcacaatgaaggagaaatcttggctggtgcataagcaatggtttcttgacctgcctctcccctggacctccggggctagcacgtcccaggagacatggaaccggcaggatctgctggtcaccttcaaaacagcgcacgccaagaagcaagaagtggtcgtgctcggatctcaggagggcgctatgcacaccgccctgaccggggccacagaaatccagacgagcggaaccacaaccatttttgctggccatcttaaatgccgcctgaagatggacaaactcacactgaaggggacctcctatgttatgtgtacgggcccgttcaaactggagaaggaagtggccgagacacagcacggaaccgtccttgtgcaagttaagtacgagggcaccgatgcgccttgcaaaatccccttcagcacacaggacgaaaagggggtgacccagaatggaagactcatcacagctaaccctattgtcacggataaagagaagcccgtgaatatcgaaaccgagcccccttttggcgagtcttatattgtggttggggccggagaaaaagccctgaagctgtcctggttcaagaaaggcagctctatcgggaagatgtttgaggctacagcccggggcgctagacgcatggccattctcggagacaccgcgtgggatttcggcagcatcgggggagtctttacatccgtgggcaaactggtgcatcaggtcttcgggaccgcctacggagtgctcttttctggcgttagctggacgatgaagatcgggattggcatcctgctcacctggctgggactgaactcccggagcacatctctttccatgacctgtattgctgtgggcatggtcacactctacctgggggtgatggttcaagccgacagcggatgcgtgatcaactggaaaggcagagaactgaagtgtgggtctggaattttcgtcaccaatgaggtgcacacatggaccgaacagtataagtttcaggctgattccccgaaacgcctcagcgccgcgatcggcaaggcctgggaggagggggtttgcggcattcggtccgctacgagactggaaaacatcatgtggaaacagatctctaatgagcttaaccatattctgctcgaaaatgacatgaagttcacagtggtcgtgggagacgccaacggcatcctggctcaagggaaaaagatgattcgcccccagcctatggagcacaaatacagctggaagtcctggggaaaggccaaaatcattggcgccgatatccagaataccacctttatcattgacgggcccgatacacctgaatgtcccgacaaccagcgggcttggaatatctgggaggtggaggattatggattcggcatttttaccacgaacatctggctgaaacttagagactcttacacacaaatgtgcgatcaccgcctcatgagcgcggccattaaagactccaaggctgtccatgccgatatgggctattggatcgaaagcgagaaaaatgaaacctggaagctggcccgggcttctttcatcgaggttaagacatgtacctggccgaaatcccacacactgtggagcaacggggtgctcgaatctgagatgattatccctaagatttacggaggccccatctcccagcataattatagacctgggtacttcacccagacggccggaccctggcacctgggcaaacttgagctggactttgatctctgcgaagggaccacagtggtcgtggacgagcactgcggaaaccgcggccctagcctgcggaccacaaccgttacgggcaagattatccatgaatggtgttgcagatcttgtacactgcccccgcttcggttccgcggggaggatggatgctggtacggcatggagatcagacctgtgaaagaaaaggaggaaaatctcgtccggagcatggtgtccgcggggagcggagaggttgactctttttccctgggcattctgtgtgtgagcatcatgattgaagaggtcatgagatcccgctggtctcggaagatgctcatgaccgggacactggctgtgttccttctgctcgttatgggacaactgacctggaacgacctgatcagactttgcattatggtgggcgccaacgccagcgatcgcatgggcatggggaccacatatctggctctcatggccacgtttaaaatgagacccatgttcgcggtcggactgctctttcggcgcctgacctccagagaggtgcttctgctcacaatcggcctgtctctggtggctagcgtcgaacttcccaattccctggaggaactcggggacggactggccatgggcattatgatgctcaagctgcttaccgagttccagcctcaccagctgtggacaaccctcctgtctctgacgtttatcaaaacaacccttagcctggattacgcctggaagaccacagctatggccctctccatcgttagcctgttcccgctctgtctgtctaccacatcccagaaaacgacctggcttcccgtgctgctggggagctttggatgcaagcctctcacaatgttcctgattaccgaaaacaagatctggggccggaaatcttggccccttaatgagggcattatggctatcgggattgtgtccatcctgctcagctctctgctcaagaacgacgtccctctggccggaccccttatcgcgggcgggatgctgattgcctgttatgtgatctccggaagctccgctgatctgagcctcgagaaagccgctgaagtttcttgggagcaagaagccgagcatagcggcacatcccacaatattctggtggaagtccaggacgatgggaccatgaagatcaaagacgaggagcgcgatgacacgcttaccattctgctcaaggccacactgctcgctgtgtctggagtttaccctatgagcatccccgcgaccctgtttgtgtggtatttctggcagaaaaagaagcagagatccggcgtcctttgggatacaccgtctcctcccgaagtggagcgggccgtcctggacgatggcatctaccgcattctgcaaagagggctcctgggacggagccaggtgggcgttggggtgttccaggacggagtctttcataccatgtggcacgtgacacgcggcgctgttcttatgtatcaggggaaaagactggaaccttcctgggcctctgtgaagaaagacctcatcagctacggaggcggctggcggttccaagggtcctggaacacgggagaggaggtccaggtgattgccgtggaacccggcaagaatccgaaaaacgttcagaccacacctgggacctttaagacccccgagggagaagtcggcgctatcgccctggatttcaagcctgggacaagcggatctcccattgtgaatagagagggcaaaatcgtgggcctctacgggaacggagtcgtgacgacctccggcacatatgttagcgcgattgctcaagccaaggcctctcaggaagggcccctgcctgagatcgaggacgaagtgtttaaaaagcgcaatcttaccatcatggatctgcacccgggatccggcaaaacacggagatacctgcccgctattgtccgcgaggccatcaagcggaagctcagaaccctgattcttgcgcctacgcgcgtggttgctagcgaaatggccgaggccctgaaagggatgcccatccggtatcagacaaccgctgtgaagtccgaacataccggcagagagattgtcgacctcatgtgccacgccacattcaccatgcgcctgctgtctcctgtgcgggttcccaactacaatatgatcatcatggatgaggctcattttacagaccctgccagcattgcggccagaggatatatctccacccgggtgggcatgggggaagctgccgctattttcatgacggccacaccgcccggaagcgtcgaggcctttcctcagtctaacgctgtgatccaagatgaagaacgcgacattcccgaaagatcctggaatagcggctacgattggatcaccgacttccctgggaaaacagtgtggtttgtcccctctatcaagagcggaaacgatattgcgaactgtctccggaaaaatggcaagcgcgttatccagctttccagaaagaccttcgacacggagtatcagaaaaccaagaacaatgactgggattacgtggtgacaaccgacatttctgagatgggggccaacttccgggctgatagagtcatcgacccgcgccggtgcctgaaacctgtgattctgaaggatggccccgaaagagttatcctcgccggacccatgcctgtgacagtcgccagcgctgcccagcgccggggcagaattgggcgcaatcaaaacaaagagggagaccagtacgtgtatatgggccagcccctgaataacgatgaagaccacgcgcattggaccgaggctaagatgcttctggataatatcaacacacctgaggggatcattccggccctctttgaacccgagcgggaaaagtccgccgctatcgacggagagtacagactgcgcggcgaagccagaaaaaccttcgttgagctgatgcggcgcggggatctccctgtgtggctttcttataaggtcgcgagcgagggctttcagtactccgacagacggtggtgcttcgatggagaacgcaataaccaagtgctggaggaaaatatggacgtcgagatttggacgaaagaaggcgagagaaagaaactgcggcccagatggctcgacgcccgcacatatagcgatcctctggcccttcgggagtttaaggagttcgccgctgggagacgctctatctccggagacctgattctcgagatcggcaaactgccccagcacctgaccctccgggcccagaacgctcttgataatctggtgatgctgcacaacagcgaacaagggggaaaggcctacagacatgcgatggaggaactcccggacaccatcgagacactgatgcttctggccctcattgctgttctgaccggcggcgtgacactgtttttcctctccgggaagggacttggcaaaacgtctatcgggctgctgtgtgtgaccgccagctccgctctcctgtggatggcctctgtcgagcctcactggattgccgctagcatcattcttgaatttttcctgatggttctcctgatccccgagcctgatcggcaacgcacaccccaggacaaccagctggcgtatgtggtgatcggactcctttttatgattctgaccgtcgccgctaatgaaatgggcctgctcgagacaaccaagaaagatctggggatcggacatgtggccgccgagaaccaccaacacgctacgatgcttgacgttgatctgagacctgcctccgcgtggaccctctacgccgtggctacaaccgtcattacacccatgatgcggcataccatcgaaaatacgacagccaacattagcctgaccgctatcgccaatcaggcggccattctgatgggcctcgacaagggctggccgatctctaaaatggatatcggggtgcctcttctggctctgggatgctactcccaggtcaaccccctcacactgaccgccgctgtgcttatgctggttgcccactatgctattatcggccccgggctccaggccaaggcgacccgcgaggcccaaaagagaacagctgccggaattatgaaaaatcctacggtggacggcatcgtcgctattgatctggacccggtggtttacgacgccaagttcgaaaaacagctggggcagatcatgctccttatcctgtgtaccagccagattctgctcatgcggacaacctgggccctgtgcgagtctatcacacttgcgaccggacccctgacgacactctgggaaggctcccctggcaagttttggaacaccaccattgctgtgagcatggccaatatcttccgcgggtcttatctggctggagccggcctggccttcagcctcatgaaatcccttgggggaggcagacgggggacaggagctcaaggcgagaccctgggcgagaagtggaagcgccagctgaaccagctctctaaaagcgaatttaatacatacaagagatccgggattatggaggtcgatcggagcgaagccaaagagggactgaagagaggcgaaacgaccaaacatgcggtgtcccgcgggacagccaaacttcggtggttcgtggagagaaacctggttaagcccgagggaaaagtcatcgacctcggctgtgggcgcggaggctggtcttattactgcgctggcctgaagaaagtgaccgaagtgaaggggtatacaaaaggaggccctgggcacgaggaacccatccctatggccacctacggatggaatctggtcaagctccatagcggcaaagatgtgtttttcatgccgcccgagaagtgtgacacgcttctgtgcgatattggggaatcctctcctaaccccaccatcgaggagggacggacactgagagttctcaagatggtggaaccttggctgcgcggcaatcagttttgtattaaaatccttaacccctacatgccgagcgtcgtggagaccctggaacaaatgcagcggaagcacggcgggatgctcgttagaaatcctctgtcccgcaactctacacacgagatgtattgggtgagctgcggaaccggcaacattgtctccgctgtgaatatgacaagccggatgctgctcaacagattcaccatggcccatcgcaaacccacgtacgagcgggacgttgatctgggggcgggaacaagacacgtggccgtcgaacccgaggtggctaatcttgacatcattggccagcgcatcgaaaacatcaagaatgagcataaatctacctggcactatgatgaagacaacccttacaagacctgggcctatcacgggtcctacgaggtgaagcccagcggatctgcttccagcatggtcaatggcgttgtgagactgctcacaaaaccttgggatgtgattccgatggtcacgcaaatcgccatgaccgacacaaccccctttggccagcagcgggtgttcaaggagaaagttgacacacgcacccctagagctaagcgggggacaacccagattatggaagtgacggccaaatggctgtggggatttctttctagaaacaagaagccccggatctgtacccgcgaggagttcacaagaaaagtccggtccaatgcggccattggcgctgtgtttgttgatgagaaccaatggaatagcgccaaggaagctgtggaggacgagcgcttctgggatctggtccatagagaacgggagctccacaaacaggggaagtgcgctacctgcgtgtataacatgatgggaaaacgcgaaaagaagctgggcgagtttgggaaagccaagggctccagagcgatctggtacatgtggctgggagctcggttcctcgagttcgaggccctgggctttatgaatgaggaccattggttcagccgcgaaaactctcttagcggggttgagggagaaggcctgcacaaactcgggtacatcctgagagatatttccaagatccctggaggcaatatgtatgccgacgatacagctgggtgggacacccggattacggaggatgaccttcagaacgaggccaaaatcacagaatttatggagcccgaacatgctctgctcgccacctctattttcaagctgacataccagaacaaagtggtccgcgtgcaaagaccggcgaagaatggcaccgtcatggatgtgatcagccggcgcgaccagagaggatccggccaggttgggacgtatggactgaacacctttacaaatatggaggtgcagctcatccggcaaatggaatctgagggcattttcctgcctagcgagcttgaaacccccaacctggccgagagagtctttgattggctcgaaaagcacggggctgagcgcctgaaacggatggccatctccggagacgactgtgtggtgaagcctattgatgacagattcgctacagcccttaccgcgctgaatgatatgggcaaagttcgcaaggacatcccccagtgggaaccttctaaagggtggaacgattggcaacaggtgcccttttgcagccaccatttccaccaactcattatgaaggacggccgggagatcgtcgtgccgtgtagaaatcaggatgagctggttggacgcgcccgggtgtcccagggcgctgggtggagcctgagagaaacagcctgcctcggaaagtcttacgctcaaatgtggcagctgatgtattttcatcgccgggaccttagactggccgctaacgccatctgttccgcggtccctgtggattgggtccccaccagccgcacgacatggtctattcacgcccaccatcagtggatgaccaccgaggacatgctctccgtgtggaatcgggtttggatcgaagagaacccctggatggaagataaaacacacgtgagctcctgggaggaggtcccttacctgggcaagagagaagaccagtggtgcgggtctcttattggactgaccgctcgggccacatgggccacgaatatccaagtggctattaaccaggttagacgcctcatcggcaatgagaactatctggactacatgaccagcatgaaacggttcaagaatgaatccgatccggagggggccctgtggtga

SEQ ID NO: 18661 - RNA, 9879 nt, synthetic construct
  misc_feature 1..9879: note = derived and/or modified CDS sequence (opt5) from DENV-1__KJ189369__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgtgtccatcatgattgaagaggtcatgagatctcgctggagccggaagatgctcatgacagggaccctggctgtgttccttctgctcgttatgggacaactgacctggaatgacctgatcagactttgcattatggtgggcgccaacgcctccgatcgcatgggcatggggacaacgtatctggctctcatggccacctttaaaatgagacctatgttcgcggtcggactgctctttcggcgcctgacatctagagaggtgcttctgctcaccatcggcctgagcctggtggcttccgtcgaacttcccaactctctggaggaactcggggacggactggccatgggcattatgatgctcaagctgcttacagagttccagccccaccagctgtggaccacgctcctgagcctgacatttatcaaaaccaccctttccctggattacgcctggaagacaaccgctatggccctcagcatcgtttctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggctatcgggattgtgagcatcctgctctcttccctgctcaagaatgacgtccccctggccggacctcttatcgcgggcgggatgctgattgcctgttatgtgatcagcggatccagcgctgatctgtctctcgagaaagccgctgaagttagctgggagcaagaagccgagcattccggcacctctcacaacattctggtggaagtccaggacgatgggacgatgaagatcaaagacgaggagcgcgatgacacccttacaattctgctcaaggccaccctgctcgctgtgagcggagtttaccccatgtccatccctgcgacactgtttgtgtggtatttctggcagaaaaagaagcagagatctggcgtcctttgggatacccccagcccgcctgaagtggagcgggccgtcctggacgatggcatctaccgcattctgcaaagagggctcctgggacggtcccaggtgggcgttggggtgttccaggacggagtctttcatacaatgtggcacgtgacgcgcggcgctgttcttatgtatcaggggaaaagactggaaccctcttgggccagcgtgaagaaagacctcatctcctacggaggcggctggcggttccaagggagctggaataccggagaggaggtccaggtgattgccgtggaacctggcaagaaccccaaaaatgttcagacaaccccggggacctttaagacacctgagggagaagtcggcgctatcgccctggatttcaagcccgggacgtctggatcccctattgtgaacagagagggcaaaatcgtgggcctctacgggaatggagtcgtgaccacaagcggcacctatgtttctgcgattgctcaagccaaggcctcccaggaagggcccctgcccgagatcgaggacgaagtgtttaaaaagcgcaaccttacaatcatggatctgcaccctggaagcggcaaaacccggagatacctgccggctattgtccgcgaggccatcaagcggaagctcagaacgctgattcttgcgcccacacgcgtggttgcttccgaaatggccgaggccctgaaagggatgcctatccggtatcagaccaccgctgtgaagtctgaacatacaggcagagagattgtcgacctcatgtgccacgccaccttcacaatgcgcctgctgagccccgtgcgggttcctaattacaacatgatcatcatggatgaggctcattttaccgaccccgcctccattgcggccagaggatatatcagcacgcgggtgggcatgggggaagctgccgctattttcatgacagccacccctccgggatctgtcgaggcctttccccagtccaatgctgtgatccaagatgaagagcgcgacattcctgaaagaagctggaactctggctacgattggatcacagacttccccgggaaaaccgtgtggtttgtccctagcatcaagtccggaaatgatattgcgaactgtctccggaaaaacggcaagcgcgttatccagctttctagaaagacgttcgacaccgagtatcagaaaacaaagaataacgactgggattacgtggtgaccacagacattagcgagatgggggccaatttccgggctgatagagtcatcgacccccgccggtgcctgaaaccggtgattctgaaggatggccctgaaagagttatcctcgccggacccatgcccgtgaccgtcgcctccgctgcccagcgccggggcagaattgggcgcaaccaaaataaagagggagaccagtacgtgtatatgggccagcctctgaacaatgatgaagaccacgcgcattggacagaggctaagatgcttctggataacatcaatacccccgaggggatcattcctgccctctttgaaccggagcgggaaaagaacgccgctatcgacggagagtacagactgcgcggcgaagccagaaaaacgttcgttgagctgatgcggcgcggggatctccccgtgtggctttcttataaggtcgcgagcgagggctttcagtactccgacagacggtggtgcttcgatggagaacgcaataaccaagtgctggaggaaaatatggacgtcgagatttggacaaaagaaggcgagagaaagaaactgcggcctagatggctcgacgcccgcacctatagcgatcccctggctcttcgggagtttaaggaattcgccgctgggagacgctctgtgtccggagacctgatcctcgagattggcaaactgcctcagcacctgaccctccgggcccagaacgctcttgataatctggttatgctgcacaacagcgaacaggggggaaaggcctacagacatgcgatggaggaactccccgacacaatcgagaccctgatgcttctggccctcatcgctgtgctgacaggcggcgtgacgctgtttttcctctccgggaagggacttggcaaaacctctattgggctgctgtgtgtcacagccagctccgctctcctgtggatggcctctgttgagccgcactggatcgccgctagcattatccttgaatttttcctgatggtgctcctgattcctgagcccgatcggcaacgcacccctcaggacaaccagctggcgtatgtggtcatcggactcctttttatgatcctgacagtggccgctaatgaaatgggcctgctcgagaccacgaagaaagatctggggattggacatgttgccgccgagaaccaccaacacgctaccatgcttgacgtggatctgagacccgcctccgcgtggacactctacgccgtcgctaccacagtgatcacccctatgatgcggcatacgattgaaaatacaaccgccaacatcagcctgacagctattgccaatcaggcggccatcctgatgggcctcgacaagggctggcccatttctaaaatggatatcggggtcccgcttctggctctgggatgctactcccaggtgaaccctctcaccctgaccgccgctgttcttatgctggtggcccactatgctatcattggccccgggctccaggccaaggcgacacgcgaggcccaaaagagaacggctgccggaatcatgaaaaatcccaccgtcgacggcattgtggctatcgatctggaccctgttgtgtacgacgccaagttcgaaaaacagctggggcagattatgctccttatcctgtgtacaagccagatcctgctcatgcggaccacatgggccctgtgcgagtctattacccttgcgacgggaccgctgacaaccctctgggaaggctcccccggcaagttttggaacaccacaatcgctgtcagcatggccaatattttccgcgggtcttatctggctggagccggcctggccttcagcctcatgaaatcccttgggggaggcagacgggggaccggagctcaaggcgagacactgggcgagaagtggaagcgccagctgaaccagctctctaaaagcgaatttaatacgtacaagagatccgggatcatggaggtggatcggagcgaagccaaagagggactgaagagaggcgaaaccacaaaacatgcggtgtcccgcgggaccgccaagcttcggtggttcgttgagagaaacctggtcaagcctgagggaaaagtgattgacctcggctgtgggcgcggaggctggtcttattactgcgctggcctgaagaaagtgacagaagtcaaggggtataccaaaggaggccccgggcacgaggaacctatccccatggccacgtacggatggaatctggttaagctccatagcggcaaagatgtgtttttcatgcctccggagaagtgtgacacccttctgtgcgatatcggggaatcctctcccaaccctacaattgaggagggacggaccctgagagtgctcaagatggtcgaaccctggctgcgcggcaatcagttttgtatcaaaattcttaacccttacatgcccagcgtggttgagacactggaacaaatgcagcggaagcacggcgggatgctcgtgagaaatccgctgtcccgcaactctacccacgagatgtattgggtcagctgcggaacaggcaacatcgtgtccgctgttaatatgaccagccggatgctgctcaacagattcacgatggcccatcgcaaacctacatacgagcgggacgtggatctgggggcgggaaccagacacgtcgccgtggaacccgaggtggctaatcttgacattatcggccagcgcattgaaaacatcaagaatgagcataaatctacctggcactatgatgaagacaacccctacaagacatgggcctatcacgggtcctacgaggtcaagcctagcggatctgcttccagcatggttaatggcgtggtgagactgctcacgaaaccctgggatgtcatccctatggtgacccaaattgccatgacagacaccacaccgtttggccagcagcgggttttcaaggagaaagtggacacccgcacacccagagctaagcgggggaccacgcagatcatggaagtcaccgccaaatggctgtggggatttctttctagaaacaagaagcctcggatttgtacacgcgaggaattcaccagaaaagtgcggtccaatgcggccatcggcgctgtttttgtggatgagaaccaatggaatagcgccaaggaagctgtcgaggacgagcgcttctgggatctggtgcatagagaacgggagctccacaaacaggggaagtgcgccacatgcgtttataacatgatgggaaaacgcgaaaagaagctgggcgagtttgggaaagccaagggctccagagcgatttggtacatgtggctgggagctcggttcctcgaattcgaggccctgggctttatgaatgaggaccattggttcagccgcgaaaactctcttagcggggtggagggagaaggcctgcacaaactcgggtacatcctgagagatatctccaagattcccggaggcaatatgtatgccgacgataccgctgggtgggacacgcggatcacagaggatgaccttcagaacgaggccaaaattaccgaaatcatggagcctgaacatgctctgctcgccacatctatttttaagctgacctaccagaacaaagtcgtgcgcgtccaaagacccgcgaagaatggcacggtgatggatgttatcagccggcgcgaccagagaggatccggccaggtggggacctatggactgaacacattcaccaatatggaggtccagctcatccggcaaatggaatctgagggcatttttctgccgagcgagcttgaaacacctaacctggccgagagagtgctcgattggctggaaaagcacggggctgagcgccttaaacggatggccatctccggagacgactgtgtggttaagcccattgatgacagattcgctaccgccctgacagcgctcaatgatatgggcaaagtgcgcaaggacatccctcagtgggaaccctctaaagggtggaacgattggcagcaggtccctttttgcagccaccatttccaccaactgattatgaaggacggccgggagatcgtggttccctgtagaaatcaggatgagctggtgggacgcgcccgggtctcccagggcgctgggtggagcctcagagaaaccgcctgcctgggaaagtcttacgctcaaatgtggcagcttatgtattttcatcgccgggacctgagactcgccgctaacgccatctgttccgcggtgccggtcgattgggtgcctacgagccgcacaacctggtctattcacgcccaccatcagtggatgaccacagaggacatgctgtccgtttggaatcgggtgtggatcgaagagaacccctggatggaagataaaacccacgtcagctcctgggaggaggtgccctaccttggcaagagagaagaccagtggtgcgggtctctgattggactcacagctcgggccacgtgggccaccaatatccaagttgctattaaccaggtgagacgcctgatcggcaatgagaactatctggactacatgacaagcatgaaacggttcaagaatgaatccgatcctgagggggccctctggtga

SEQ ID NO: 18662 - RNA, 9879 nt, synthetic construct
  misc_feature 1..9879: note = derived and/or modified CDS sequence (opt5) from DENV-1__EU482615__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctccattccggcaaagatgtctttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgccgtcaacatgacctctcggatgctgctcaatagattcacgatggcgcatcgcaaacctacatacgagcgggacgtggatctgggggccggaaccagacacgttgctgtggaacccgaggtcgccaaccttgacatcattggccagcgcatcgaaaatatcaagaacgagcataaatccacctggcactatgatgaagacaatccctacaagacatgggcttatcacgggagctacgaggtgaagccttctggatccgccagctctatggtgaacggcgtcgttagactgctcacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctgtggggatttctttccagaaataagaagcctcggatctgtacacgcgaggaattcaccagaaaagtgcggagcaacgccgctattggcgccgtctttgtggatgagaatcaatggaactccgctaaggaagccgttgaggacgagcgcttctgggatctggtgcatagagaacgggagctccacaaacaggggaagtgcgccacatgcgtctataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtggagggagaaggcctgcacaaactcgggtacatcctgagagatatttctaagatccccggaggcaacatgtatgctgacgataccgccgggtgggacacgcggattacagaggatgaccttcagaatgaggctaaaatcaccgatattatggaacctgagcatgccctgctcgcgacaagcatctttaagctgacctaccagaacaaagttgtgcgcgtccaaagacccgccaagaacggcacggtgatggacgtcatctcccggcgcgatcagagaggatctggccaggtggggacctatggactgaatacattcaccaacatggaagttcagctcattcggcaaatggagagcgaaggcatctttctgccgtccgagcttgagacacctaatctggctgaaagagtgctcgactggctggagaagcacggggccgaacgccttaaacggatggctatttctggagacgattgtgtcgtgaagcccatcgacgatagattcgccaccgcgctgacagccctcaacgacatgggcaaagtgcgcaaggatattcctcagtgggagcccagcaaagggtggaatgactggcagcaggttcctttttgctcccaccatttccaccaactgatcatgaaggatggccgggaaatcgtggtcccctgtagaaaccaggacgagctggtgggacgcgctcgggttagccagggcgccgggtggtctctcagagagaccgcttgcctgggaaagtcctacgcccaaatgtggcagcttatgtattttcatcgccgggatctgagactcgctgccaatgcgatttgtagcgccgtgccggtcgactgggtgcctacgtctcgcacaacctggtccatccacgctcaccatcagtggatgaccacagaagatatgctgagcgtctggaaccgggtgtggattgaggaaaatccctggatggaggacaaaacccacgtttcctcttgggaagaggtgccctaccttggcaagagagaggaccagtggtgcgggagcctgatcggactcacagcccgggccacgtgggctaccaacattcaagtcgccatcaatcaggtgagacgcctgattggcaacgaaaattatctggattacatgacatccatgaaacggttcaagagcgagtctgaccctgaaggggcgctctggtga

SEQ ID NO: 18663 - RNA, 9879 nt, synthetic construct
  misc_feature 1..9879: note = derived and/or modified CDS sequence (opt5) from DENV-1__EU482616__SS-prME
  source 1..9879: mol_type = other RNA
agcgtgaccatgctgctcatgctgcttcccacagccctggctttccacctcacgaccagaggcggggagcctcatatgatcgtcaacaagcaggaacggggaaaatccctgctttttaagacatctgccggcgttaatatgtgcaccctgattgcgatggacctcggggagctgtgtgaagatacaatgacctacaaatgcccgcaaatcacagaggctgaacccgacgatgtggactgttggtgcaacgccaccgatacgtgggtgacctatggaacatgtagccagaccggcgagcaccgcagagacaagcggtccgtcgccctggctcctcatgtggggctcggactggagacacgcaccgaaacgtggatgtctagcgagggcgcctggaaacagattcagagagttgaaacatgggctcttcggcaccccggcttcaccgtgatcgccctgtttctcgcgcatgccattgggacatccatcacccaaaagggaatcattttcatcctgcttatgctggtcaccccttctatggctatgcgctgcgtgggcattgggaatagagattttgttgagggactcagcggcgccacatgggtggacgtcgtgctggagcacgggtcctgtgtgacgaccatggctaagaacaaacccacactggatatcgaactcctgaagaccgaggtcacaaatcctgccattcttcggaaactgtgcatcgaagcgaagattagcaacaccacgacagactctcgctgtccgacccagggagaggccaccctcgttgaagagcaggatgctaatttcgtgtgcagacggacatttgtggaccgcggctggggcaacgggtgtggactgttcggcaaagggtcccttctgacctgcgccaagtttaagtgcgtcacaaaactcgagggaaagatcgtgcagtacgaaaatctgaaatatagcgttatcgtgacggtccacaccggcgatcaacatcaggtggggaacgagacaaccgaacacggaacaattgctaccatcacgccccaggcccctacctctgagattcagctgacagactacggcgccctcaccctggactgttcccccagaacaggccttgatttcaatgaaatggttctgctcaccatgaaggagaaaagctggctggtgcataagcaatggtttcttgacctgcctctcccctggacgtctggggcttccacaagccaggagacctggaaccggcaggatctgctggtcacattcaaaaccgcgcacgccaagaagcaagaagtggtcgtgctcggatcccaggagggcgctatgcacaccgccctgacaggggccacggaaatccagacctctggaacaaccacaatttttgctggccatcttaaatgccgcctgaagatggacaaactcaccctgaaggggacgagctatgttatgtgtacaggctccttcaaactggagaaggaagtggccgagacccagcacggaaccgtccttgtgcaagttaagtacgagggcacagatgcgccgtgcaaaatccctttcagcacccaggacgaaaagggggtgacacagaatggaagactcatcacggctaaccccattgtcaccgataaagagaagcctgtgaatatcgaaacagagcccccctttggcgagtcttatattgtggttggggccggagaaaaagccctgaagctgtcctggttcaagaaaggcagctctatcgggaagatgtttgaggctaccgcccggggcgctagacgcatggccattctcggagacacagcgtgggatttcggcagcatcgggggagtctttacctccgtgggcaaactggtgcatcaggtcttcgggacggcctacggagtgcttttttctggcgttagctggaccatgaagatcgggattggcatcctgctcacatggctgggactgaactcccggagcacctctctttccatgacatgtattgctgtgggcatggtcaccctctacctgggggtgatggttcaagccgacagcggatgcgtgatcaactggaaaggcagagaactgaagtgtgggtctggaattttcgtcacaaatgaggtgcacacctggacggaacagtataagtttcaggctgattcccctaaacgcctcagcgccgcgatcggcaaggcctgggaggagggggtttgcggcattcggtccgctacaagactggaaaacatcatgtggaaacagatctctaatgagcttaaccatattctgctcgaaaatgacatgaagttcaccgtggtcgtgggagacgccaacggcatcctggctcaagggaaaaagatgattcgcccgcagcccatggagcacaaatacagctggaagtcctggggaaaggccaaaatcattggcgccgatatccagaataccacatttatcattgacgggcctgatacccccgaatgtcctgacgatcagcgggcttggaacatctgggaggtggaggactatggattcggcatttttacgacaaatatctggctgaagcttagagattcttacacccaaatgtgcgaccaccgcctcatgagcgcggccattaaagattccaaggctgtccatgccgacatgggctattggatcgaaagcgagaaaaacgaaacatggaagctggcccgggcttctttcatcgaggttaagacctgtacatggcccaaatcccacaccctgtggagcaatggggtgctcgaatctgagatgattatcccgaagatttacggaggccctatctcccagcataactatagacccgggtacttcacgcagaccgccggaccttggcacctgggcaaacttgagctggattttgacctctgcgaagggacaaccgtggtcgtggatgagcactgcggaaatcgcggccccagcctgcggacaaccacggttacaggcaagattatccatgaatggtgttgcagatcttgtaccctgcctccccttcggttccgcggggaggacggatgctggtacggcatggagatcagaccggtgaaagaaaaggaggaaaacctcgtccggagcatggtgtccgcggggagcggagaggttgactctttttccctgggcattctgtgtgctagcatcatgattgaagaggtgatgagatcccgctggtctcggaagatgctcatgacagggaccctggccgtcttccttctgctcatcatgggacaactgacctggaatgatctgattagactttgcatcatggtgggcgccaacgctagcgaccgcatgggcatggggacaacgtatctggccctcatggcgacctttaaaatgagacctatgttcgctgttggactgctctttcggcgcctgacatccagagaggtgcttctgctcaccattggcctgtctctggtcgccagcgtggaacttcccaactccctggaggaactcggggatggactggccatgggcatcatgatgctcaagctgcttacagagttccagccccaccagctgtggaccacgctcctgtctctgacatttatcaaaaccacccttagcctggactacgcttggaagacaaccgccatggctctctccattgtgagcctgttccctctctgtctgtctacaacgtcccagaaaaccacatggcttccggtcctgctggggagctttggatgcaagcccctcaccatgttcctgatcacagaaaataagatttggggccggaaatcttggcctcttaacgagggcatcatggccattgggatcgtttccatcctgctcagctctctgctcaagaatgatgtgcccctggcgggacctcttattgccggcgggatgctgatcgcttgttatgtgatttccggaagctccgccgacctgagcctcgagaaagctgccgaagtctcttgggagcaagaagccgagcatagcggcacctcccacaacatcctggtggaagttcaggatgacgggacgatgaagattaaagatgaggagaaggacgatacccttacaatcctgctcaaagctaccctgctcgcggtgtctggagtctaccccatgagcatccctgccacactgtttgtgtggtatttctggcagaagaagaaacagcgctccggcgttctttgggacaccccctctccgcctgaagtggagagagctgtcctggatgacggcatttaccggatcctgcaacgcgggctcctgggaagaagccaggtgggcgtcggggtgttccaggacggagtttttcatacaatgtggcacgtgacgcggggcgccgtccttatgtatcaggggaagcgcctggaaccctcctgggcctctgtgaaaaaggatctcattagctacggaggcggctggagattccaagggtcctggaataccggagaggaggttcaggtgatcgctgtcgaacctggcaaaaaccccaagaatgtgcagacaaccccggggacctttaagacacctgagggagaagtgggcgccattgcgctggacttcaaacccgggacgagcggatctcctatcgttaaccgggagggcaagattgtcggcctctacgggaatggagtggtgaccacatccggcacctatgtcagcgctatcgcccaagccaaagcttctcaggaagggcccctgcccgagatcgaggatgaagtgtttaagaaaagaaaccttacaattatggacctgcaccctggatccggcaagacccgccggtacctgccggccatcgttagagaggcgattaagcgcaaactccggacgctgatccttgctcccacaagagtggtcgccagcgaaatggccgaggctctgaaggggatgcctattcgctatcagaccaccgccgtgaaatccgaacatacaggccgggagatcgttgatctcatgtgccacgctaccttcacaatgagactgctgtctcccgtgcgcgtccctaattacaacatgatcattatggacgaggcccattttaccgatcccgcgagcatcgccgctcggggatatatttccacgagagtgggcatgggggaagccgctgccatcttcatgacagccacccctccgggaagcgttgaggcttttccccagtctaatgcggtgattcaagacgaagagcgggatatccctgaacgctcctggaacagcggctacgactggatcacagatttccccgggaagaccgtctggtttgtgccttctattaaaagcggaaatgacatcgccaactgtctcagaaagaacggcaagcgggtgattcagctttcccgcaaaacgttcgacaccgagtatcagaagacaaaaaataacgattgggactacgtcgttaccacagatatctctgagatgggggctaatttcagagccgaccgggtgattgatcccagacgctgcctgaagccggtgatcctgaaagacggccctgaacgggtcattctcgccggacccatgcccgtgaccgttgctagcgccgcgcagagacgcggccggatcgggagaaaccaaaataaggagggagatcagtacgtgtatatgggccagcctctgaacaatgacgaagatcacgctcattggacagaggccaagatgcttctggacaacatcaatacccccgaggggattatccctgccctctttgaaccggagcgcgaaaaatccgctgccattgatggagagtaccggctgagaggcgaagcgcgcaagacgttcgtcgagctgatgagacggggggacctccccgtgtggctttcttataaagttgccagcgagggctttcagtactccgatcgcagatggtgcttcgacggagaacggaacaatcaagtgctggaggaaaacatggacgtcgagatctggacaaaggaaggcgagcgcaaaaagctgagacctcggtggctcgatgctagaacctatagcgaccccctggcccttcgcgagtttaaagaattcgctgccgggcggagatctgtgtccggagatctgattctcgagatcggcaagctgcctcagcacctgaccctccgcgctcagaatgcccttgacaacctggtcatgctgcacaatagcgaacaggggggaaaggcgtaccggcatgccatggaggaactccccgatacaatcgagaccctgatgcttctggctctcattgccgtgctgacaggcggcgttacgctgtttttcctctccgggaaaggacttggcaagacctctatcgggctgctgtgtgtgacagctagctccgccctcctgtggatggcctctgtggagccgcactggattgctgcgagcatcattcttgaatttttcctgatggtcctcctgatccctgagcccgacagacaacggacccctcaggataaccagctggcctatgttgtgatcggactcctttttatgattctgacagtggctgccaacgaaatgggcctgctcgagaccacgaaaaaggacctggggatcggacatgtcgccgctgagaatcaccaacacgccaccatgcttgatgtggacctgcgccccgcgtccgcctggacactctacgctgttgccaccacagtgattacccctatgatgagacatacgatcgaaaacacaaccgctaatattagcctgacagccatcgcgaaccaggccgctattctgatgggcctcgataaaggctggcccatctctaagatggacatcggggtcccgcttctggccctgggatgctactcccaggtgaatcctctcaccctgaccgctgccgtccttatgctggtggctcactatgccattatcggccccgggctccaggcgaaggccacacgggaggctcaaaaacgcacggccgctggaattatgaagaaccccaccgttgatggcatcgtggccattgacctggaccctgtcgtgtacgatgccaaattcgaaaagcagctggggcagatcatgctccttatcctgtgtacaagccagattctgctcatgagaaccacatgggcgctgtgcgagtctatcacccttgctacgggaccgctgacaaccctctgggaaggctcccccggcaaattttggaataccacaattgccgttagcatggctaacatcttccgggggtcttatctggccggagccggcctggctttcagcctcatgaagtcccttgggggaggccgcagagggaccggagcccaaggcgagacactgggcgagaagtggaaacggcagctgaatcagctctctaagagcgaatttaacacgtacaaacgctccgggattatggaggtggacagaagcgaagcgaaggagggactgaaacggggcgaaaccacaaagcatgccgtctccagagggaccgctaagcttcgctggttcgtggagcggaatctggtgaaacctgagggaaaggttatcgatctcggctgtgggagaggaggctggtcttattactgcgccggcctgaaaaaggtcacagaagtgaaagggtataccaagggaggccccgggcacgaggaacctatccccatggctacgtacggatggaacctggtgaaactccatagcggcaaggacgtctttttcatgcctccggagaagtgtgatacccttctgtgcgacattggggaatcctctcccaatcctacaatcgaggagggacgcaccctgcgggttctcaaaatggtggaaccctggctgagaggcaaccagttttgtattaagatccttaatccttacatgcccagcgtggtcgagacactggaacaaatgcagcgcaaacacggcgggatgctcgtgcggaacccgctgtccagaaattctacccacgagatgtattgggttagctgcggaacaggcaacattgtgtccgccgtcaacatgaccagccgcatgctgctcaatcggttcacgatggcgcatagaaagcctacatacgagcgcgatgtggacctgggggccggaacccggcacgttgctgtggaacccgaggtcgccaaccttgatatcattggccagagaatcgaaaatatcaaaaacgagcataagtctacctggcactatgacgaagataatccctacaagacatgggcttatcacgggtcctacgaggtgaaacctagcggatctgcctccagcatggtgaacggcgtcgttcgcctgctcacgaagccctgggacgtgattcctatggtgacccaaatcgctatgacagacaccacaccgtttggccagcagagagtcttcaaagagaaggtggatacccggacaccccgcgccaaaagagggaccacgcagattatggaagttaccgcgaagtggctgtggggatttctttctcggaataagaaacctagaatctgtacacgggaggaattcacccgcaaggtgagatccaacgccgctattggcgccgtctttgtggacgagaatcaatggaacagcgctaaagaagccgttgaggatgagcggttctgggacctggtgcatcgcgaaagagagctccacaagcaggggaaatgcgccacatgcgtctataatatgatgggaaagcgggaaaagaaactgggcgagtttgggaaggcgaaaggctcccgcgctatctggtacatgtggctgggagccagattcctcgaattcgaggccctgggctttatgaacgaggatcattggttcagccgggaaaattctcttagcggggtggagggagaaggcctgcacaagctcgggtacatcctgcgcgacatttccaaaatccccggaggcaacatgtatgctgatgacaccgccgggtgggatacgagaattacagaggacgatcttcagaatgaggctaagatcaccgacattatggaacctgagcatgccctgctcgcgacatctatctttaaactgacctaccagaacaaggttgtgcgggtccaacgccccgccaagaacggcacggtgatggatgtcatcagcagacgggaccagcgcggatccggccaggtggggacctatggactgaatacattcaccaacatggaagttcagctcattagacaaatggagtctgaaggcatctttctgccgagcgagcttgagacacctaatctggctaaacgggtgctcgactggctggaaaagcacggggccgagagacttaaacgcatggctatttccggagatgactgtgtcgtgaagcccatcgatgaccggttcgccaccgcgctgacagccctcaacgatatgggcaaagtgagaaaggacattcctcagtgggaaccctctaaggggtggaatgattggcagcaggttcctttttgcagccaccatttccaccaactgatcatgaaagacggccgcgagatcgtggtcccctgtcggaaccaggatgaactggtgggaagagctcgcgtttcccagggcgccgggtggagcctccgggagaccgcttgcctgggaaagtcttacgcccaaatgtggcagcttatgtattttcatagacgcgacctgcggctcgctgccaatgcgatttgttccgccgtgccggtcgattgggtgcctacgagcagaacaacctggtctatccacgctcaccatcagtggatgaccacagaggacatgctgtccgtctggaaccgcgtgtggattgaagagaatccctggatggaagacaaaacccacgttagctcctgggaggaagtgccctaccttggcaagcgggaggatcagtggtgcgggtctctgatcggactcacagccagagccacgtgggctaccaacattcaagtcgccatcaatcaggtgcggagactgattggcaacgagaattatctggactacatgacaagcatgaaacgcttcaagaacgaatccgatcctgagggggcgctctggtga

SEQ ID NO: 18664 - RNA, 9879 nt, synthetic construct
  misc_feature 1..9879: note = derived and/or modified CDS sequence (opt5) from DENV-1__EU482618__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctccattccggcaaagatgtctttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgccgtcaacatgacctctcggatgctgctcaatagattcacgatggcgcatcgcaaacctacatacgagcgggacgtggatctgggggccggaaccagacacgttgctgtggaacccgaggtcgccaaccttgacatcattggccagcgcatcgaaaatatcaagaacgagcataaatccacctggcactatgatgaagacaatccctacaagacatgggcttatcacgggagctacgaggtgaagccttctggatccgccagctctatggtgaacggcgtcgttagactgctcacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctgtggggatttctttccagaaataagaagcctcggatctgtacacgcgaggaattcaccagaaaagtgcggagcaacgccgctattggcgccgtctttgtggatgagaatcaatggaactccgctaaggaagccgttgaggacgagcgcttctgggatctggtgcatagagaacgggagctccacaaacaggggaagtgcgccacatgcgtctataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtggagggagaaggcctgcacaaactcgggtacatcctgagagatatttctaagatccccggaggcaacatgtatgctgacgataccgccgggtgggacacgcggattacagaggatgaccttcagaatgaggctaaaatcaccgatattatggaacctgagcatgccctgctcgcgacaagcatctttaagctgacctaccagaacaaagttgtgcgcgtccaaagacccgccaagaacggcacggtgatggacgtcatctcccggcgcgatcagagaggatctggccaggtggggacctatggactgaatacattcaccaacatggaagttcagctcattcggcaaatggagagcgaaggcatctttctgccgtccgagcttgagacacctaatctggctgaaagagtgctcgactggctggagaagcacggggccgaacgccttaaacggatggctatttctggagacgattgtgtcgtgaagcccatcgacgatagattcgccaccgcgctgacagccctcaacgacatgggcaaagtgcgcaaggatattcctcagtgggagcccagcaaagggtggaatgactggcagcaggttcctttttgctcccaccatttccaccaactgatcatgaaggatggccgggaaatcgtggtcccctgtagaaaccaggacgagctggtgggacgcgctcgggttagccagggcgccgggtggtctctcagagagaccgcttgcctgggaaagtcctacgcccaaatgtggcagcttatgtattttcatcgccgggatctgagactcgctgccaatgcgatttgtagcgccgtgccggtcgactgggtgcctacgtctcgcacaacctggtccatccacgctcaccatcagtggatgaccacagaagatatgctgagcgtctggaaccgggtgtggattgaggaaaatccctggatggaggacaaaacccacgtttcctcttgggaagaggtgccctaccttggcaagagagaggaccagtggtgcgggagcctgatcggactcacagcccgggccacgtgggctaccaacattcaagtcgccatcaatcaggtgagacgcctgattggcaacgaaaattatctggattacatgacatccatgaaacggttcaagaacgagagcgaccctgaaggggcgctctggtga

SEQ ID NO: 18665 - RNA, 9879 nt, synthetic construct
  misc_feature 1..9879: note = derived and/or modified CDS sequence (opt5) from DENV-1__EU482619__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctccattccggcaaagatgtctttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgccgtcaacatgacctctcggatgctgctcaatagattcacgatggcgcatcgcaaacctacatacgagcgggacgtggatctgggggccggaaccagacacgttgctgtggaacccgaggtcgccaaccttgacatcattggccagcgcatcgaaaatatcaagaacgagcataaatccacctggcactatgatgaagacaatccctacaagacatgggcttatcacgggagctacgaggtgaagccttctggatccgccagctctatggtgaacggcgtcgttagactgctcacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctgtggggatttctttccagaaataagaagcctcggatctgtacacgcgaggaattcaccagaaaagtgcggagcaacgccgctattggcgccgtctttatcgatgagaatcaatggaactccgctaaggaagccgtggaggacgagcgcttctgggatctggttcatagagaacgggagctccacaaacaggggaagtgcgccacatgcgtgtataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtcgagggagaaggcctgcacaaactcgggtacattctgagagatatctctaagattcccggaggcaacatgtatgctgacgataccgccgggtgggacacgcgggtgacagaggatgaccttcagaatgaggctaaaatcaccgatattatggaacctgagcatgccctgctcgcgacaagcatctttaagctgacctaccagaacaaagttgtgcgcgtccaaagacccgccaagaacggcacggtgatggacgtcatctcccggcgcgatcagagaggatctggccaggtggggacctatggactgaatacattcaccaacatggaagttcagctcattcggcaaatggagagcgaaggcatctttctgccgtccgagcttgagacacctaatctggctgaaagagtgctcgactggctggagaagcacggggccgaacgccttcggagaatggctatttctggagacgattgtgtcgtgaaacccatcgacgatcgcttcgccaccgcgctgacagccctcaacgacatgggcaaggtgcggaaagatattcctcagtgggagcccagcaaggggtggaatgactggcagcaggttcctttttgctcccaccatttccaccaactgatcatgaaagatggcagagaaatcgtggtcccctgtcgcaaccaggacgagctggtgggacgggctagagttagccagggcgccgggtggtctctccgcgagaccgcttgcctgggaaagtcctacgcccaaatgtggcagcttatgtattttcatcggagagatctgcgcctcgctgccaatgcgatttgtagcgccgtgccggtcgactgggtgcctacgtctcggacaacctggtccatccacgctcaccatcagtggatgaccacagaagatatgctgagcgtctggaacagagtgtggattgaggaaaatccctggatggaggacaagacccacgtttcctcttgggaagaggtgccctaccttggcaaacgggaggaccagtggtgcgggagcctgatcggactcacagccagagccacgtgggctaccaacattcaagtcgccatcaatcaggtgcgccggctgattggcaacgaaaattatctggattacatgacatccatgaagagattcaaaaacgagagcgaccctgaaggggcgctctggtga

SEQ ID NO: 18666 - RNA, 9879 nt, synthetic construct
  misc_feature 1..9879: note = derived and/or modified CDS sequence (opt5) from DENV-1__FJ898433__SS-prME
  source 1..9879: mol_type = other RNA
agcgtgaccatgctgctcatgctgcttcccaccgctctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcaccgcagagagaagcggtctgtcgccctggctcctcatgtggggctcggactggaaacacgcaccgagacgtggatgagctccgaaggcgcctggaaacagattcagagagttgagacatgggcccttcggcaccccggcttcaccgtgacagccctgtttctcgcgcatgccatcgggacctctattacccagaagggaatcatcttcattctgcttatgctggtcacacctagcatggctatgcgctgcgtgggcatcgggaacagagactttgttgagggactctccggcgccacgtgggtggatgtcgtgctggaacacgggagctgtgtgaccacaatggctaagaataaacccaccctggacattgagctcctgaagacagaagtcaccaaccctgccatccttcggaaactgtgcattgaggcgaagatctctaatacgacaaccgattcccgctgtccgacccagggagaagccacactcgttgaggagcaggacgctaacttcgtgtgcagacggacctttgtggatcgcggctggggcaatgggtgtggactgttcggcaaagggagccttctgacatgcgccaagtttaagtgcgtcacgaaactcgaaggaaagattgtgcagtacgagaacctgaaatattctgttatcgtgaccgtccacacaggcgaccaacatcaggtggggaatgaaaccacagagcacggaaccatcgctacgattacaccccaggcccctacatccgaaatccagctgaccgattacggcgccctcacactggactgtagccccagaaccggccttgacttcaacgagatggttctgctcacgatgaaggagaaatcttggctggtgcataagcaatggtttcttgatctgcctctcccctggacatccggggctagcacctcccaggaaacatggaatcggcaggacctgctggtcaccttcaaaaccgcgcacgccaagaagcaagaggtggtcgtgctcggatctcaggaaggcgctatgcacacagccctgacgggggccaccgagattcagacaagcggaaccacaaccatctttgctggccatcttaaatgccgcctgaagatggataaactcacgctgaaggggacatcctatgttatgtgtaccggcagcttcaaactggaaaaggaggtggccgagacccagcacggaacagtccttgtgcaagttaagtacgaaggcaccgacgcgccgtgcaaaattcctttctctacacaggatgagaagggggtgacgcagaacggaagactcatcaccgctaatcccatcgtcacagacaaagaaaagcctgtgaacattgagaccgagccgccctttggcgaatcctatatcgtggttggggccggagagaaagccctgaagctgagctggttcaagaaaggctctagcattgggaagatgtttgaagctacagcccggggcgctagacgcatggccatcctcggagataccgcgtgggacttcggctccattgggggagtctttacgtctgtgggcaaactggtgcatcaggtcttcgggaccgcctacggagtgctttttagcggcgtttcctggacaatgaagatcgggatcggcattctgctcacctggctgggactgaatagccggtctacatcccttagcatgacctgtatcgctgtgggcatggtcacactctacctgggggtgatggttcaagccgattctggatgcgtgattaactggaaaggcagagagctgaagtgtgggtccggaatcttcgtcaccaacgaagtgcacacgtggacagagcagtataagtttcaggctgacagccctaaacgcctctccgccgcgattggcaaggcctgggaggaaggggtttgcggcatccggtctgctaccagactggagaatattatgtggaaacagatcagcaacgaacttaatcatatcctgctcgagaacgatatgaagttcaccgtggtcgtgggagacgccaatggcattctggctcaagggaaaaagatgatccgcccgcagcccatggaacacaaatactcctggaagtcttggggaaaggccaaaattatcggcgccgacattcagaacacaacctttatcatcgatgggcctgacacgcccgagtgtcctgataatcagcgggcttggaacatttgggaggtggaagactatggattcggcatctttacaaccaatatttggctgaaacttagagatagctacacacaaatgtgcgaccaccgcctcatgtccgcggccatcaaagatagcaaggctgtccatgccgacatgggctattggattgagtctgagaagaacgagacctggaagctggcccgggcttccttcatcgaagttaagacatgtacctggcccaaaagccacacgctgtggtctaatggggtgctcgagtccgagatgatcattccgaagatctacggaggccctattagccagcataactatagacccgggtacttcacccagacagccggaccttggcacctgggcaaacttgaactggattttgactcttgcgaggggaccacagtggtcgtggatgaacactgcggaaatcgcggccccagcctccggaccacgacagttaccggcaagatcattcatgagtggtgttgcagatcctgtacactgcctcccctgcggttccgcggggaggacggatgctggtacggcatggaaatcagaccggtgaaagagaaggaagagaaccttgtccggagcatggtgtctgcggggtccggagaagttgatagcttttccctcggcatcctgtgtgtgtctattatgatcgaggaggtcatgagaagccgctggtcccggaagatgctgatgaccgggaccctcgctgtgttcctgcttctgattatgggacaactcacatggaaagacctgatcagactgtgcattatggttggcgccaatgcctctgaccgcatgggcatggggacgacctatcttgctctgatggccacatttaagatgagacctatgttcgcggtgggactcctgtttcggcgcctcaccagcagagaagtcctgcttctgacaatcggcctctccctggtggcttctgtggagctgcccaacagccttgaagaactgggggatggactcgccatgggcattatgatgctgaaactcctgaccgagttccacccccatcagctttggacgacactgctctccctgacctttatcaagaccacactgagccttgactacgcctggaaaaccacagctatggccctgtctatcgtctccctcttccctctgtgtctcagcacgacctctcagaagacaacctggctgccggttcttctggggtcctttggatgcaagcccctgacaatgttcctcattaccgagaacaaaatctggggcagaaagagctggcctctgaatgagggcattatggctatcgggattgtgtctatccttctgtccagcctcctgaaaaacgatgtgcccctcgccggacctctgatcgcgggcgggatgcttattgcctgttatgtcatctccggaagctctgctgacctgagcctggaaaaggccgctgaggtgtcctgggaacaggaggccgaacactctggcacgagccataatattctcgttgaggtgcaagatgacgggaccatgaaaatcaaggatgaggaacgcgacgatacactgaccattcttctgaaagccacactcctggctgtctccggagtgtaccccatgtctatccctgcgaccctctttgtttggtatttctggcagaagaagaaacagagaagcggcgtgctgtgggacacaccctccccgcctgaggtcgaacgggccgtgcttgatgacggcatctaccgcattctgcagagagggctgctcggacggtctcaagtcggcgtgggggttttccaggatggagtgtttcacacgatgtggcacgtcacccgcggcgctgtgctgatgtatcaggggaagagacttgagcccagctgggcctccgttaaaaaggacctgatcagctacggaggcggctggcggttccaggggtcttggaacacaggagaggaagtgcaagtcattgccgtggagcctggcaaaaatcccaagaacgtgcagaccaccccggggacatttaagacgcctgaaggagaggttggcgctatcgccctcgacttcaaacccgggacctccggaagccctattgtcaatagagaaggcaagatcgtgggcctgtacgggaacggagtggtcacaacctctggcacatatgtgtccgcgattgctcaggccaaagccagccaagaggggcccctccccgagatcgaagatgaggtttttaagaaacgcaatctgaccatcatggaccttcatcctggatccggcaagacgcggagatacctgccggctattgtgcgcgaagccatcaagcggaaactgagaacactcattctggcgcccacccgcgtcgtggcttctgagatggccgaagcccttaaggggatgcctatccggtatcagaccacagctgttaaaagcgagcacaccggcagagagattgtggatctgatgtgccatgccacattcaccatgcgcctcctgtcccccgtccgggtgcctaactacaatatgatcatcatggacgaagctcactttacggatcccgccagcattgcggccagaggatatatctctacacgggttggcatgggggaggctgccgctattttcatgaccgccacacctccgggatccgtggaagcctttccccagagcaacgctgtcatccaggacgaggaacgcgatattcctgagagatcttggaatagcggctacgactggatcaccgatttccccgggaagacggtgtggtttgtgccttccatcaaatctggaaacgacattgcgaattgtctgcggaagaacggcaagcgcgtcatccaactcagcagaaaaaccttcgatacagagtatcagaagaccaaaaacaatgactgggactacgttgtgacaaccgatatttccgaaatgggggccaacttccgggctgacagagtgatcgatccccgccggtgccttaagccggtcattctgaaagacggccctgagagagtgatcctggccggacccatgcccgttacagtggcctctgctgcccagcgccggggcagaattgggcgcaatcagaacaaggaaggagatcaatacgtctatatgggccagcctctcaataacgacgaggatcatgcgcactggaccgaggctaagatgctgcttgacaatatcaacacgcccgaagggatcattcctgccctgtttgagccggaacgggagaaaagcgccgctatcgatggagaatacagactccgcggcgaggccagaaagacattcgtggagctgatgcggcgcggggacctgcccgtttggctctcctataaagtggcgagcgaaggctttcagtactctgatagacggtggtgcttcgacggagagcgcaataaccaggtccttgaagagaatatggatgtggaaatttggaccaaggagggcgagcgcaagaagctgcggcctagatggctggacgcccgcacctattccgaccccctcgctctgcgggaatttaaagagttcgccgctgggagacgcagcgtctccggagatcttatcctggaaattggcaagctccctcaacacctgacactgcgggcccagaacgctctcgacaatcttgtgatgctgcataactctgagcaagggggaaaggcctacagacacgcgatggaagaactgcccgataccatcgagacactcatgctgcttgccctgatcgctgttctcacgggcggcgtgaccctgtttttcctgagcgggaaaggactcggcaagacatccattgggcttctgtgtgtgaccgcctctagcgctctgctctggatggcctccgtcgaaccgcattggatcgccgctagcattatcctggagtttttccttatggttctgctcattcctgaacccgaccggcagcgcacacctcaagataatcagctggcgtatgtggtgatcggactgctctttatgatccttaccgtcgccgctaacgagatgggcctgctggagacgaccaaaaaggacctcgggattggacacgtggccgccgaaaaccaccagcatgctacaatgctggatgttgaccttagacccgcctctgcgtggaccctgtacgccgtggctacaaccgtcatcacgcctatgatgcggcacacaattgagaataccacagccaacatctccctcaccgctattgccaatcaagcggccatcctgatgggcctggataaaggctggcccattagcaagatggacatcggggtgccgctccttgctctgggatgctactctcaggtcaaccctctgaccctcacagccgctgtgctgatgcttgttgcccattatgctatcattggccccgggctgcaggccaaggcgacgcgcgaagcccagaaaagaaccgctgccggaatcatgaagaatcccacagtggatggcattgtcgctatcgacctcgatcctgtggtttacgacgccaaattcgagaagcaactggggcagattatgctgctcatcctttgtacctcccagatcctgctgatgcggacaacctgggccctctgcgaaagcattacgctggcgacaggaccgcttaccaccctgtgggagggctctcccggcaaattttggaacacaaccatcgctgtgagcatggccaatattttccgcgggtcctatctcgctggagccggcctggccttctctctgatgaaaagcctcgggggaggcagacgggggacaggagctcagggcgagacgcttggcgaaaagtggaaacgccaactgaaccagctgtccaagagcgagtttaatacctacaaaagatccgggatcatggaagtcgaccggtctgaggccaaggaaggactcaaaagaggcgagacaaccaagcacgcggtgagccgcgggacagccaagctgcggtggttcgtggagagaaaccttgttaaacctgaaggaaaggtcattgatctgggctgtgggcgcggaggctggtcctattactgcgctggcctcaaaaaggtgaccgaggtgaaagggtatacgaagggaggccccgggcatgaggaacctatccccatggccacctacggatggaatctggtcaaactgcactctggcaaggacgtgtttttcatgcctccggaaaagtgtgatacactcctttgcgacatcggggagagctcccccaaccctaccattgaggaaggacggacactgagagttctgaaaatggtggagccctggctccgcggcaatcagttttgtatcaagattctgaacccttacatgccctctgtcgtggaaacccttgagcagatgcaacggaaacacggcgggatgctggttagaaatccgctcagccgcaactccacacatgagatgtattgggtgagctgcggaaccggcaatatcgtctctgctgtgaacatgacgtcccggatgctgctgaacagattcacaatggcccaccgcaagcctacctacgaaaaagatgttgacctcggggcgggaacccggcatgtggccgtcgagcccgaagtggctaatctggatattatcggccagagaattgagaacatcaagaatgaacacaagagcacatggcactatgacgaggataacccctacaaaacgtgggcctatcatgggtcttacgaggtgaagccttccggaagcgcttcttccatggtcaatggcgttgtgcgccttctgaccaaaccctgggacgtgatccctatggtcacacagattgccatgaccgatacaaccccgtttggccaacagagagtgttcaaggaaaaagttgacacacggacccccagagctaagagagggacgacccagatcatggaggtgacagccaagtggctctggggatttctgagccggaacaaaaagcctagaatttgtacccgggaagagttcacacgcaaagtcagatccaatgcggccatcggcgctgtgtttgttgacgaaaaccagtggaatagcgccaaggaggctgtggaggatgaacggttctgggaccttgtccaccgcgagagagaactgcataaacaagggaagtgcgctacctgcgtgtataacatgatgggaaagcgggagaaaaagctcggcgaatttgggaaagccaagggctctcgcgcgatttggtacatgtggctgggagctagattcctggagttcgaggccctcggctttatgaatgaagatcactggttcagccgggagaactccctgtctggggttgaaggagagggccttcataaactggggtacatcctccgcgacatcagcaagattcccggaggcaatatgtatgccgatgacacggctgggtgggatacaagaatcaccgaggacgatctgcagaacgaagccaaaattacagacatcatggagcctgaacacgcccttctggccacctccatttttaagctcacgtaccagaataaggtggtccgggtgcagcgccccgcgaaaaacggcaccgtcatggatgtgatctctagacgggaccaacgcggaagcggccaggttgggacatatggactgaacaccttcacaaatatggaggtgcagctgatcagacagatggaatccgagggcatttttctcccgtctgagctggaaacccctaaccttgccgagcgggtcctggattggctcgggaagcacggagctgaaagactgaaacgcatggccatcagcggcgacgactgtgtggtgaagcccattgatgaccggttcgctacagcccttaccgcgctgaatgatatggggaaagttagaaaggacatccctcaatgggagccctccaagggctggaacgattggcaacaggtgcctttttgcagccatcacttccatcagctcattatgaaagacggacgcgaaatcgtcgtgccctgtcggaatcaagatgagctggttggcagagcccgcgtgtctcagggggctggatggtccctgaaggagacggcctgcctcggcaaaagctacgctcagatgtggcaactgatgtattttcaccggagagaccttcgcctggccgctaacgccatctgttctgcggtcccggtggattgggtccctacatcccggaccacctggagcattcacgcccatcaccagtggatgacaaccgaagacatgctctccgtgtggaatagagtttggatcgaggaaaacccctggatggaggataagacacatgtgtctagctgggaagaggtcccctacctggggaaacgcgaggaccagtggtgcggatcccttattggcctgacggctcgggccacctgggccacaaatatccaggtggctattaaccaagttagacggctcatcgggaatgaaaactatctggactacatgaccagcatgaagagattcaagaatgagtctgatcctgaaggcgccctgtggtga

SEQ ID NO: 18667 - RNA, 9879 nt, synthetic construct
  misc_feature 1..9879: note = derived and/or modified CDS sequence (opt5) from DENV-1__FJ547088__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacacaaagttcgaaaaacagctggggcagatcatgctccttatcctgtgtacctctcagattctgctcatgcggacaacctgggccctgtgcgagtccatcacgcttgcgacaggaccgctgaccaccctctgggaaggcagccccggcaagttttggaatacaaccattgctgtttctatggccaacatcttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacatttacaagagaagcgggatcatggaggtggatcggtccgaagccaaagagggactgaagagaggcgaaaccacaaaacatgcggtctctcgcgggaccgccaagcttcggtggttcgtggagagaaatctggtgaagcctgagggaaaagttatcgacctcggctgtgggcgcggaggctggagctattactgcgctggcctgaagaaagtcacagaagtgaaggggtataccaaaggaggccccgggcacgaggaacctattcccatggccacgtacggatggaacctggtgaagctccattccggcaaagatgtctttttcatgcctccggagaagtgtgacacccttctgtgcgatatcggggaatctagccccaatcctacaattgaggagggacggaccctgagagttctcaagatggtggaaccctggctgcgcggcaaccagttttgtatcaaaattcttaatccttacatgccctccgtggtcgagacactggaacaaatgcagcggaagtatggcgggatgctcgtgagaaacccgctgtctcgcaatagcacccacgagatgtactgggtttcctgcggaacaggcaacatcgtgagcgctgtcaacatgacctctcggatgctgctcaatagattcacgatggcccaccgcaaacctacatatgagcgggacgtggatctgggggcgggaaccagacatgttgccgtggaacccgaggtcgctaaccttgacattatcggccagcgcatcgaaaatattaagaacgagcacaaatccacctggcattacgatgaagacaatccctataagacatgggcctaccacgggagctatgaggtgaagccttctggatccgctagctctatggtgaacggcgtcgttagactgctcacgaaaccctgggatgtgatccctatggtgacccaaattgccatgacagacaccacaccgtttggccagcagcgggtcttcaaggagaaagtggacacccgcacacccagagctaagcgggggaccacgcagatcatggaagttaccgccaaatggctgtggggatttctttccagaaataagaagcctcggatttgtacacgcgaggaattcaccagaaaagtgcggagcaacgcggccatcggcgctgtctttgtggatgagaatcaatggaactccgccaaggaagctgttgaggacgagcgcttctgggatctggtgcacagagaacgggagctccataaacaggggaagtgcgccacatgcgtctacaatatgatgggaaaacgcgaaaagaagctgggcgagtttgggaaagccaagggcagcagagcgatctggtacatgtggctgggagctcggttcctcgaattcgaggccctgggctttatgaacgaggaccactggttctctcgcgaaaatagcctttccggggtggagggagaaggcctgcataaactcgggtatattctgagagatatctctaagattcccggaggcaacatgtacgccgacgataccgctgggtgggacacgcggatcacagaggatgaccttcagaatgaggccaaaattaccgatatcatggaacctgagcacgctctgctcgccacaagcatctttaagctgacctatcagaacaaagttgtgcgcgtccaaagacccgcgaagaacggcacggtgatggacgtcatttcccggcgcgatcagagaggatctggccaggtggggacctacggactgaatacattcaccaacatggaagttcagctcatccggcaaatggagagcgaaggcatttttctgccgtccgagcttgagacacctaatctggccgggagagtgctcgactggctggaaaagcatggagctgagcgccttaaacggatggccatctctggcgacgattgtgtcgtgaagcccattgacgatagattcgctaccgccctgacagcgctcaacgacatggggaaagtgcgcaaggatatccctcagtgggaacccagcaaaggctggaatgactggcagcaggttcctttttgctcccaccacttccatcaactgatcatgaaggatggacgggagattgtggtcccctgtagaaaccaggacgaactggtgggccgcgcccgggttagccagggggctggatggtctctcagagagaccgcctgcctgggcaagtcctatgctcaaatgtggcagcttatgtactttcaccgccgggatctgagactcgccgctaatgccatctgtagcgcggtgccggtcgactgggtgcctacgtctcgcacaacctggtccattcatgcccaccaccagtggatgaccacagaggatatgctgagcgtctggaaccgggtgtggatcgaagagaatccctggatggaagacaaaacccatgtttcctcttgggaggaagtgccctatcttgggaagagagaggaccagtggtgcggaagcctgattggcctcacagctcgggccacgtgggccaccaacatccaagtcgctattaatcaggtgagacgcctgatcgggaacgagaattacctggattacatgacatccatgaaacggttcaagaacgaaagcgaccctgagggcgccctctggtga

SEQ ID NO: 18668 - RNA, 9879 nt, synthetic construct
  misc_feature 1..9879: note = derived and/or modified CDS sequence (opt5) from DENV-1__FJ810419__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacatctgagggagaagtgggcgccattgcgctggatttcaagcctgggacgtccggaagccccatcgttaacagagagggcaaaattgtcggcctctacgggaatggagtggtgaccacatctggcacctatgtctccgctatcgcccaagccaaggctagccaggaagggcctctgcccgagatcgaggacgaagtgtttaaaaagcgcaaccttacaattatggatctgcaccccggatccggcaaaacccggagatacctgcctgccatcgttcgcgaggcgattaagcggaagctcagaacgctgatccttgctccgacacgcgtggtcgcctctgaaatggccgaggctctgaaagggatgcccattcggtatcagaccaccgccgtgaagagcgaacatacaggcagagagatcgttgacctcatgtgccacgctaccttcacaatgcgcctgctgtcccctgtgcgggtccccaattacaacatgatcattatggatgaggcccattttaccgaccctgcgagcatcgccgctagaggatatatttctacgcgggtgggcatgggggaagccgctgccatcttcatgacagccaccccccctggatccgttgaggcttttccgcagagcaatgcggtgattcaagatgaagagcgcgacatccccgaaagatcttggaacagcggctacgattggatcacagacttccctgggaaaaccgtctggtttgtgccctccattaagtctggaaatgatatcgccaactgtctccggaaaaacggcaagcgcgtgattcagcttagcagaaagacgttcgacaccgagtatcagaaaacaaagaataacgactgggattacgtcgttaccacagacatctccgagatgggggctaatttccgggccgatagagtgattgaccctcgccggtgcctgaaacccgtgatcctgaaggatggcccggaaagagtcattctcgccggacctatgcccgtgaccgttgcttctgccgcgcagcgccggggcagaatcgggcgcaaccaaaataaagagggagaccagtacgtgtatatgggccagcccctgaacaatgatgaagaccacgctcattggacagaggccaagatgcttctggataacatcaatacccctgaggggattatccccgccctctttgaacctgagcgggaaaagagcgctgccattgacggagagtacagactgcgcggcgaagcgagaaaaacgttcgtcgagctgatgcggcgcggggatctcccggtgtggctttcctataaggttgccagcgagggctttcagtactctgacagacggtggtgcttcgatggagaacgcaacaatcaagtgctggaggaaaacatggacgtcgagatctggacaaaagaaggcgagagaaagaaactgcggcccagatggctcgacgctcgcacctattccgatcctctggcccttcgggagtttaaggaattcgctgccgggagacgcagcgtgtccggagacctgattctcgagatcggcaaactgccccagcacctgaccctccgggctcagaatgcccttgataacctggtcatgctgcacaattctgaacaggggggaaaggcgtacagacatgccatggaggaactccctgacacaatcgagaccctgatgcttctggctctcattgccgtgctgacaggcggcgttacgctgtttttcctcagcgggaagggacttggcaaaacctccatcgggctgctgtgtgtgacagcttctagcgccctcctgtggatggcctccgtggagccccactggattgctgcgagcatcattcttgaatttttcctgatggtcctcctgatcccggagcctgatcggcaacgcaccccccaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacctgcgtctgcctggacactctacgctgttgccaccacagtgattacccccatgatgcggcatacgatcgaaaacacaaccgctaatatttccctgacagccatcgcgaaccaggccgctattctgatgggcctcgacaagggctggcctatcagcaaaatggatatcggggtcccccttctggccctgggatgctactctcaggtgaatccgctcaccctgaccgctgccgtccttatgctggtggctcactatgccattatcggccctgggctccaggcgaaggccacacgcgaggctcaaaagagaacggccgctggaattatgaaaaaccccaccgttgacggcatcgtggccattgatctggaccccgtcgtgtacgacgccaagttcgaaaaacagctggggcagatcatgctccttatcctgtgtacatcccagattctgctcatgcggaccacatgggcgctgtgcgagagcatcacccttgctacgggacctctgacaaccctctgggaaggctctccgggcaagttttggaataccacaattgccgttagcatggctaacatcttccgcgggtcctatctggccggagccggcctggctttctctctcatgaaaagccttgggggaggcagacgggggaccggagcccaaggcgagacactgggcgagaagtggaagcgccagctgaatcagctctccaaaagcgaatttaacacgtacaagagatccgggattatggaggtggatcggtctgaagcgaaagagggactgaagagaggcgaaaccacaaaacatgccgtcagccgcgggaccgctaagcttcggtggttcgtggagagaaatctggtgaagcccgagggaaaagttatcgacctcggctgtgggcgcggaggctggtcctattactgcgccggcctgaagaaagtcacagaagtgaaggggtataccaaaggaggccctgggcacgaggaacccatccctatggctacgtacggatggaacctggtgaagctctactctggcaaagatgtctttttcatgccccctgagaagtgtgacacccttctgtgcgatattggggaaagctccccgaatcccacaatcgaggagggacggaccctgagagttctcaagatggtggaaccttggctgcgcggcaaccagttttgtattaaaatccttaatccctatatgccttctgtggtcgagacactggaacaaatgcagcggaagcatggcgggatgctcgtgagaaaccccctgagccgcaattccacccacgagatgtactgggttagctgcggaacaggcaacattgtgtctgccgtcaacatgacctcccggatgctgctcaatagattcacgatggcgcaccgcaaaccgacatatgagcgggacgtggatctgggggccggaaccagacatgttgctgtggaacctgaggtcgccaaccttgacatcattggccagcgcatcgaaaatatcaagaacgagcacaaaagcacctggcattacgatgaagacaatccctataagacatgggcttaccacgggtcttatgaggtgaagccctccggaagcgcctcttccatggtgaacggcgtcgttagactgctcacgaaaccttgggatgtgattcccatggtgacccaaatcgctatgacagacaccacaccttttggccagcagcgggtcttcaaggagaaagtggacacccgcacaccgagagccaagcgggggaccacgcagattatggaagttaccgcgaaatggctgtggggatttcttagcagaaataagaagccccggatctgtacacgcgaggaattcaccagaaaagtgcggtccaacgccgctattggcgccgtctttgtggatgagaatcaatggaacagcgctaaggaagccgttgaggacgagcgcttctgggatctggtgcacagagaacgggagctccataaacaggggaagtgcgccacatgcgtctacaatatgatgggaaaacgcgaaaagaagctgggcgagtttgggaaagcgaagggctctagagctatctggtacatgtggctgggagcccggttcctcgaattcgaggccctgggctttatgaacgaggaccactggttcagccgcgaaaattccctttctggggtggagggagaaggcctgcataaactcgggtatatcctgagagatattagcaagatccctggaggcaacatgtacgctgacgataccgccgggtgggacacgcggattacagaggatgaccttcagaatgaggctaaaatcaccgatattatggaacccgagcacgccctgctcgcgacatccatctttaagctgacctatcagaacaaagttgtgcgcgtccaaagacctgccaagaacggcacggtgatggacgtcatctctcggcgcgatcagagaggaagcggccaggtggggacctacggactgaatacattcaccaacatggaagttcagctcattcggcaaatggagtccgaaggcatctttctgccctctgagcttgagacaccgaatctggctgaaagagtgctcgactggctggagaagcatggggccgaacgccttaaacggatggctattagcggagacgattgtgtcgtgaagcctatcgacgatagattcgccaccgcgctgacagccctcaacgacatgggcaaagtgcgcaaggatattccccagtgggagccttccaaagggtggaatgactggcagcaggttcccttttgcagccaccacttccatcaactgatcatgaaggatggccgggaaatcgtggtcccttgtagaaaccaggacgagctggtgggacgcgctcgggtttctcagggcgccgggtggtccctcagagagaccgcttgcctgggaaagagctatgcccaaatgtggcagcttatgtactttcaccgccgggatctgagactcgctgccaatgcgatttgttctgccgtgcccgtcgactgggtgccgacgtcccgcacaacctggagcatccatgctcaccaccagtggatgaccacagaagatatgctgtccgtctggaaccgggtgtggattgaggaaaatccttggatggaggacaaaacccatgtttctagctgggaagaggtgccctatcttggcaagagagaggaccagtggtgcgggtccctgatcggactcacagcccgggccacgtgggctaccaacattcaagtcgccatcaatcaggtgagacgcctgattggcaacgaaaattacctggattacatgacaagcatgaaacggttcaagaacgagtctgaccccgaaggggcgctctggtga

SEQ ID NO: 18669 - RNA, 9879 nt, synthetic construct
  misc_feature 1..9879: note = derived and/or modified CDS sequence (opt5) from DENV-1__FJ547068__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggccgcctccgtcgaacttcccaactctctggaggaactcggggacggactggctatgggcatcatgatgctcaagctgcttacagagttccagccccaccagctgtggaccacgctcctgagcctgacatttatcaaaaccaccctttccctggattacgcctggaagacaaccgctatggccctcagcattgtgtctctgttccctctctgtctgtccacaacgagccagaaaaccacatggcttccggtgctgctggggtcttttggatgcaagcccctcaccatgttcctgatcacagaaaataagatttggggccggaaatcctggcctcttaacgagggcatcatggcgattgggatcgtcagcatcctgctctcttccctgctcaagaatgacgttcccctggccggacctcttattgctggcgggatgctgatcgcctgttatgtgattagcggatccagcgctgatctgtctctcgagaaagccgccgaagtgagctgggagcaagaagctgagcattccggcacctctcacaacatcctggtcgaagtgcaggacgatgggacgatgaagattaaagacgaggagcgcgatgacacccttacaatcctgctcaaggcgaccctgctcgccgttagcggagtgtaccccatgtccatccctgctacactgtttgtctggtatttctggcagaaaaagaagcagagatctggcgtgctttgggatacccccagcccgcctgaagttgagcgggccgtgctggacgatggcatttaccgcatcctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggctagcgtcaagaaagacctcatttcctacggaggcggctggcggttccaagggagctggaataccggagaggaggtgcaggttatcgccgtggaacctggcaagaaccccaaaaatgtccagacaaccccggggacctttaagacacctgagggagaagtgggcgcgattgctctggatttcaagcccgggacgtctggatcccctatcgtgaacagagagggcaaaattgttggcctctacgggaatggagtcgtgaccacaagcggcacctatgtgtctgccatcgcccaagctaaggcctcccaggaagggcccctgcccgagatcgaggacgaagtctttaaaaagcgcaaccttacaattatggatctgcaccctggaagcggcaaaacccggagatacctgccggcgatcgtgcgcgaggctattaagcggaagctcagaacgctgatccttgcccccacacgcgttgtggcctccgaaatggctgaggccctgaaagggatgcctattcggtatcagaccaccgctgtcaagtctgaacatacaggcagagagatcgtggacctcatgtgccacgccaccttcacaatgcgcctgctgagccccgttcgggtgcctaattacaacatgatcattatggatgaggcgcattttaccgaccccgcctccatcgctgccagaggatatattagcacgcgggtcggcatgggggaagctgccgccatcttcatgacagctacccctccgggatctgtggaggcgtttccccagtccaatgccgttattcaagatgaagagcgcgacatccctgaaagaagctggaactctggctacgattggatcacagacttccccgggaaaaccgtgtggtttgtccctagcattaagtccggaaatgatatcgctaactgtctccggaaaaacggcaagcgcgtgattcagctttctagaaagacgttcgacaccgagtatcagaaaacaaagaataacgactgggattacgtggtcaccacagacatcagcgagatgggggccaatttccgggccgatagagttattgacccccgccggtgcctgaaaccggtgatcctgaaggatggccctgaaagagtgattctcgctggacccatgcccgtcaccgtggcctccgcggctcagcgccggggcagaatcgggcgcaaccaaaataaagagggagaccagtacgtttatatgggccagcctctgaacaatgatgaagaccacgcccattggacagaggccaagatgcttctggataacatcaatacccccgaggggattatccctgctctctttgaaccggagcgggaaaagtctgccgcgattgacggagagtacagactgcgcggcgaagccagaaaaacgttcgtggagctgatgcggcgcggggatctccccgtctggcttagctataaggtggcttccgagggctttcagtacagcgacagacggtggtgcttcgatggagaacgcaacaatcaagttctggaggaaaacatggacgtggagatctggacaaaagaaggcgagagaaagaaactgcggcctagatggctcgacgcccgcacctattctgatcccctggctcttcgggagtttaaggaattcgccgctgggagacgctccgtcagcggagacctgattctcgagatcggcaaactgcctcagcacctgaccctccgggcccagaatgcgcttgataacctggtgatgctgcacaattccgaacaggggggaaaggcctacagacatgctatggaggaactccccgacacaatcgagaccctgatgcttctggccctcattgctgtcctgacaggcggcgtgacgctgtttttcctctctgggaagggacttggcaaaaccagcatcgggctgctgtgtgttacagcctcctctgccctcctgtggatggctagcgtggagccgcactggattgcggcctccatcattcttgaatttttcctgatggtgctcctgatccctgagcccgatcggcaacgcacccctcaggacaaccagctggcttatgtcgttatcggactcctttttatgattctgacagtggccgccaacgaaatgggcctgctcgagaccacgaagaaagatctggggatcggacatgtggctgccgagaatcaccaacacgcgaccatgcttgacgtcgatctgagacccgccagcgcttggacactctacgccgtggctaccacagttattacccctatgatgcggcatacgatcgaaaacacaaccgccaatatttctctgacagcgatcgccaaccaggctgccattctgatgggcctcgacaagggctggcccatctccaaaatggatatcggggtgccgcttctggctctgggatgctacagccaggtcaatcctctcaccctgaccgccgctgtgcttatgctggtcgcccactatgcgattatcggccccgggctccaggccaaggctacacgcgaggcccaaaagagaacggctgccggaattatgaaaaaccccaccgtggacggcatcgttgccattgatctggaccctgtggtctacgacgcgaagttcgaaaaacagctggggcagatcatgctccttatcctgtgtacatctcagattctgctcatgcggaccacatgggctctgtgcgagtccatcacccttgccacgggaccgctgacaaccctctgggaaggcagccccggcaagttttggaataccacaattgctgtgtctatggccaacatcttccgcgggagctatctggccggagctggcctggccttctccctcatgaaatctcttgggggaggcagacgggggaccggagcgcaaggcgagacactgggcgagaagtggaagcgccagctgaatcagctcagcaaatccgaatttaacacgtacaagagaagcgggattatggaggttgatcggtccgaagccaaagagggactgaagagaggcgaaaccacaaaacatgctgtgtctcgcgggaccgccaagcttcggtggttcgtcgagagaaatctggtgaagcctgagggaaaagtgatcgacctcggctgtgggcgcggaggctggagctattactgcgctggcctgaagaaagttacagaagtcaaggggtataccaaaggaggccccgggcacgaggaacctatccccatggccacgtacggatggaacctggtgaagctccattccggcaaagatgtgtttttcatgcctccggagaagtgtgacacccttctgtgcgatattggggaatctagccccaatcctacaatcgaggagggacggaccctgagagtcctcaagatggttgaaccctggctgcgcggcaaccagttttgtattaaaatccttaatccttacatgccctccgtggtggagacactggaacaaatgcagcggaagcacggcgggatgctcgtcagaaacccgctgtctcgcaatagcacccacgagatgtattgggtgtcctgcggaacaggcaacattgttagcgcggtgaacatgacctctcggatgctgctcaatagattcacgatggcccatcgcaaacctacatacgagcgggacgtcgatctgggggctggaaccagacacgtggccgttgaacccgaggtggctaaccttgacatcattggccagcgcatcgaaaatatcaagaacgagcataaatccacctggcactatgatgaagacaatccctacaagacatgggcctatcacgggagctacgaggtcaagccttctggatccgctagctctatggtgaacggcgtggtcagactgctcacgaaaccctgggatgttattcctatggtgacccaaatcgccatgacagacaccacaccgtttggccagcagcgggtgttcaaggagaaagtcgacacccgcacacccagagcgaagcgggggaccacgcagattatggaagtgaccgccaaatggctgtggggatttctttccagaaataagaagcctcggatctgtacacgcgaggaattcaccagaaaagttcggagcaacgctgccattggcgctgtgtttgtcgatgagaatcaatggaactccgccaaggaagccgtggaggacgagcgcttctgggatctggttcatagagaacgggagctccacaaacaggggaagtgcgcgacatgcgtgtataatatgatgggaaaacgcgaaaagaagctgggcgagtttgggaaagctaagggcagcagagccatctggtacatgtggctgggagcccggttcctcgaattcgaggctctgggctttatgaacgaggaccattggttctctcgcgaaaatagcctttccggggtcgagggagaaggcctgcacaaactcgggtacatcctgagagatatttctaagatccccggaggcaacatgtatgccgacgataccgctgggtgggacacgcggattacagaggatgaccttcagaatgaggccaaaatcaccgatattatggaacctgagcatgcgctgctcgccacaagcatctttaagctgacctaccagaacaaagtggttcgcgtgcaaagacccgctaagaacggcacggtcatggacgtgatctcccggcgcgatcagagaggatctggccaggtcgggacctatggactgaatacattcaccaacatggaagtgcagctcattcggcaaatggagagcgaaggcatctttctgccgtccgagcttgagacacctaatctggccgaaagagttctcgactggctggagaagcacggggctgaacgccttaaacggatggccatttctggagacgattgtgtggtcaagcccatcgacgatagattcgcgaccgccctgacagctctcaacgacatgggcaaagtgcgcaaggatattcctcagtgggagcccagcaaagggtggaatgactggcagcaggtgcctttttgctcccaccatttccaccaactgatcatgaaggatggccgggaaatcgttgtgccctgtagaaaccaggacgagctggtcggacgcgcccgggtgagccagggcgctgggtggtctctcagagagaccgcctgcctgggaaagtcctacgctcaaatgtggcagcttatgtattttcatcgccgggatctgagactcgccgcgaatgccatttgtagcgctgttccggtggactgggtccctacgtctcgcacaacctggtccatccacgcccaccatcagtggatgaccacagaagatatgctgagcgtgtggaaccgggtctggattgaggaaaatccctggatggaggacaaaacccacgtgtcctcttgggaagaggttccctaccttggcaagagagaggaccagtggtgcgggagcctgatcggactcacagcccgggctacgtgggccaccaacattcaagtggcgatcaatcaggtcagacgcctgattggcaacgaaaattatctggattacatgacatccatgaaacggttcaagaacgagagcgaccctgaaggggctctctggtga

SEQ ID NO: 18670 - RNA, 9879 nt, synthetic construct
  misc_feature 1..9879: note = derived and/or modified CDS sequence (opt5) from DENV-1__FJ562104__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacacaaagttcgaaaaacagctggggcagatcatgctccttatcctgtgtacctctcagattctgctcatgcggacaacctgggccctgtgcgagtccatcacgcttgcgacaggaccgctgaccaccctctgggaaggcagccccggcaagttttggaatacaaccattgctgtttctatggccaacatcttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacatttacaagagaagcgggatcatggaggtggatcggtccgaagccaaagagggactgaagagaggcgaaaccacaaaacatgcggtctctcgcgggaccgccaagcttcggtggttcgtggagagaaatctggtgaagcctgagggaaaagttatcgacctcggctgtgggcgcggaggctggagctattactgcgctggcctgaagaaagtcacagaagtgaaggggtataccaaaggaggccccgggcacgaggaacctattcccatggccacgtacggatggaacctggtgaagctccattccggcaaagatgtctttttcatgcctccggagaagtgtgacacccttctgtgcgatatcggggaatctagccccaatcctacaattgaggagggacggaccctgagagttctcaagatggtggaaccctggctgcgcggcaaccagttttgtatcaaaattcttaatccttacatgccctccgtggtcgagacactggaacaaatgcagcggaagtatggcgggatgctcgtgagaaacccgctgtctcgcaatagcacccacgagatgtactgggtttcctgcggaacaggcaacatcgtgagcgctgtcaacatgacctctcggatgctgctcaatagattcacgatggcccaccgcaaacctacatatgagcgggacgtggatctgggggcgggaaccagacatgttgccgtggaacccgaggtcgctaaccttgacattatcggccagcgcatcgaaaatattaagaacgagcacaaatccacctggcattacgatgaagacaatccctataagacatgggcctaccacgggagctatgaggtgaagccttctggatccgctagctctatggtgaacggcgtcgttagactgctcacgaaaccctgggatgtgatccctatggtgacccaaattgccatgacagacaccacaccgtttggccagcagcgggtcttcaaggagaaagtggacacccgcacacccagagctaagcgggggaccacgcagatcatggaagttaccgccaaatggctgtggggatttctttccagaaataagaagcctcggatttgtacacgcgaggaattcaccagaaaagtgcggagcaacgcggccatcggcgctgtctttgtggatgagaatcaatggaactccgccaaggaagctgttgaggacgagcgcttctgggatctggtgcacagagaacgggagctccataaacaggggaagtgcgccacatgcgtctacaatatgatgggaaaacgcgaaaagaagctgggcgagtttgggaaagccaagggcagcagagcgatctggtacatgtggctgggagctcggttcctcgaattcgaggccctgggctttatgaacgaggaccactggttctctcgcgaaaatagcctttccggggtggagggagaaggcctgcataaactcgggtatattctgagagatatctctaagattcccggaggcaacatgtacgccgacgataccgctgggtgggacacgcggatcacagaggatgaccttcagaatgaggccaaaattaccgatatcatggaacctgagcacgctctgctcgccacaagcatctttaagctgacctatcagaacaaagttgtgcgcgtccaaagacccgcgaagaacggcacggtgatggacgtcatttcccggcgcgatcagagaggatctggccaggtggggacctacggactgaatacattcaccaacatggaagttcagctcatccggcaaatggagagcgaaggcatttttctgccgtccgagcttgagacacctaatctggccgaaagagtgctcgactggctggagaagcatggggctgaacgccttaaacggatggccatctctggagacgattgtgtcgtgaagcccattgacgatagattcgctaccgccctgacagcgctcaacgacatgggcaaagtgcgcaaggatatccctcagtgggagcccagcaaagggtggaatgactggcagcaggttcctttttgctcccaccacttccatcaactgatcatgaaggatggccgggaaattgtggtcccctgtagaaaccaggacgagctggtgggacgcgcccgggttagccagggcgctgggtggtctctcagagagaccgcctgcctgggaaagtcctatgctcaaatgtggcagcttatgtactttcaccgccgggatctgagactcgccgctaatgccatctgtagcgcggtgccggtcgactgggtgcctacgtctcgcacaacctggtccattcatgcccaccaccagtggatgaccacagaagatatgctgagcgtctggaaccgggtgtggatcgaggaaaatccctggatggaggacaaaacccatgtttcctcttgggaagaggtgccctatcttggcaagagagaggaccagtggtgcgggagcctgattggactcacagctcgggccacgtgggccaccaacatccaagtcgctattaatcaggtgagacgcctgatcggcaacgaaaattacctggattacatgacatccatgaaacggttcaagaacgagagcgaccctgaaggggccctctggtga

SEQ ID NO: 18671 - RNA, 9879 nt, synthetic construct
  misc_feature 1..9879: note = derived and/or modified CDS sequence (opt5) from DENV-1__GQ199857__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattatctctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggccatcgggatcgtcagcattctgctctcttccctgctcaagaatgacgttcccctggcgggacctcttatcgccggcgggatgctgattgcttgttatgtgatcagcggatccagcgccgatctgtctctcgagaaagctgccgaagtgagctgggagcaagaagccgagcattccggcacctctcacaacattctggtcgaagtgcaggacgatgggacgatgaagatcaaagacgaggagcgcgatgacacccttacaatcctgctcaaggctaccctgctcgcggttagcggagtgtaccccatgtccattcctgccacactgtttgtctggtatttctggcagaaaaagaagcagagatctggcgtgctttgggatacccccagcccgcctgaagttgagcgggctgtgctggacgatggcatctaccgcattctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatctcctacggaggcggctggcggttccaagggagctggaataccggagaggaggtgcaggttattgctgtggaacctggcaagaaccccaaaaatgtccagacaaccccggggacctttaagacacctgagggagaagtgggcgccatcgcgctggatttcaagcccgggacgtctggatcccctattgtgaacagagagggcaaaatcgttggcctctacgggaatggagtcgtgaccacaagcggcacctatgtgtctgctatcgcccaagccaaggcttcccaggaagggcccctgcccgagattgaggacgaagtctttaaaaagcgcaaccttacaatcatggatctgcaccctggaagcggcaaaacccggagatacctgccggccattgtgcgcgaggcgatcaagcggaagctcagaacgctgattcttgctcccacacgcgttgtggcctccgaaatggccgaggctctgaaagggatgcctatccggtatcagaccaccgccgtcaagtctgaacatacaggcagagagatcgtggacctcatgtgccacgctaccttcacaatgcgcctgctgagccccgttcgggtgcctaattacaacatgattatcatggatgaggcccattttaccgaccccgcgtccattgccgctagaggatatatcagcacgcgggtcggcatgggggaagccgctgccattttcatgacagccacccctccgggatctgtggaggcttttccccagtccaatgcggttatccaagatgaagagcgcgacatccctgaaagaagctggaactctggctacgattggattacagacttccccgggaaaaccgtgtggtttgtccctagcatcaagtccggaaatgatattgccaactgtctccggaaaaacggcaagcgcgtgatccagctttctagaaagacgttcgacaccgagtatcagaaaacaaagaataacgactgggattacgtggtcaccacagacattagcgagatgggggctaatttccgggccgatagagttatcgacccccgccggtgcctgaaaccggtgattctgaaggatggccctgaaagagtgatcctcgccggacccatgcccgtcaccgtggcttccgccgcgcagcgccggggcagaatcgggcgcaaccaaaataaagagggagaccagtacgtttatatgggccagcctctgaacaatgatgaagaccacgctcattggacagaggccaagatgcttctggataacattaatacccccgaggggatcattcctgccctctttgaaccggagcgggaaaagtctgctgccatcgacggagagtacagactgcgcggcgaagcgagaaaaacgttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatttggacaaaagaaggcgagagaaagaaactgcggcctagatggctcgacgctcgcacctattctgatcccctggcccttcgggagtttaaggaattcgctgccgggagacgctccgtcagcggagacctgatcctcgagatcggcaaactgcctcagcacctgaccctccgggctcagaatgcccttgataacctggtgatgctgcacaattccgaacaggggggaaaggcgtacagacatgccatggaggaactccccgacacaattgagaccctgatgcttctggctctcatcgccgtcctgacaggcggcgtgacgctgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgatccctgagcccgatcggcaacgcacccctcaggacaaccagctggcctatgtcgttattggactcctttttatgatcctgacagtggctgccaacgaaatgggcctgctcgagaccacgaagaaagatctggggattggacatgtggccgctgagaatcaccaacacgccaccatgcttgacgtcgatctgagacccgcgagcgcctggacactctacgctgtggccaccacagttatcacccctatgatgcggcatacgattgaaaacacaaccgctaatatctctctgacagccattgcgaaccaggccgctatcctgatgggcctcgacaagggctggcccatctccaaaatggatattggggtgccgcttctggccctgggatgctacagccaggtcaatcctctcaccctgaccgctgccgtgcttatgctggtcgctcactatgccatcattggccccgggctccaggcgaaggccacacgcgaggctcaaaagagaacggccgctggaatcatgaaaaaccccaccgtggacggcattgttgccatcgatctggaccctgtggtctacgacacaaagttcgaaaaacagctggggcagatcatgctccttattctgtgtacctctcagatcctgctcatgcggacaacctgggccctgtgcgagtccattacgcttgcgacaggaccgctgaccaccctctgggaaggcagccccggcaagttttggaatacaaccatcgctgtgtctatggccaacattttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacatctacaagagaagcgggatcatggaggttgatcggtccgaagccaaagagggactgaagagaggcgaaaccacaaaacatgcggtgtctcgcgggaccgccaagcttcggtggttcgtcgagagaaatctggtgaagcctgagggaaaagtgattgacctcggctgtgggcgcggaggctggagctattactgcgctggcctgaagaaagttacagaagtcaaggggtataccaaaggaggccccgggcacgaggaacctatccccatggccacgtacggatggaacctggtgaagctccattccggcaaagatgtgtttttcatgcctccggagaagtgtgacacccttctgtgcgatattggggaatctagccccaatcctacaatcgaggagggacggaccctgagagtcctcaagatggttgaaccctggctgcgcggcaaccagttttgtattaaaatccttaatccttacatgccctccgtggtggagacactggaacaaatgcagcggaagtatggcgggatgctcgtcagaaacccgctgtctcgcaatagcacccacgagatgtactgggtgtcctgcggaacaggcaacattgttagcgctgtgaacatgacctctcggatgctgctcaatagattcacgatggcccaccgcaaacctacatatgagcgggacgtcgatctgggggcgggaaccagacatgtggccgttgaacccgaggtggctaaccttgacatcatcggccagcgcattgaaaatatcaagaacgagcacaaatccacctggcattacgatgaagacaatccctataagacatgggcctaccacgggagctatgaggtcaagccttctggatccgctagctctatggtgaacggcgtggtcagactgctcacgaaaccctgggatgttattcctatggtgacccaaatcgccatgacagacaccacaccgtttggccagcagcgggtgttcaaggagaaagtcgacacccgcacacccagagctaagcgggggaccacgcagattatggaagtgaccgccaaatggctgtggggatttctttccagaaataagaagcctcggatctgtacacgcgaggaattcaccagaaaagttcggagcaacgcggccatcggcgctgtgtttattgatgagaatcaatggaactccgccaaggaagctgtcgaggacgagcgcttctgggatctggtgcacagagaacgggagctccataaacaggggaagtgcgccacatgcgtttacaatatgatgggaaaacgcgaaaagaagctgggcgagtttgggaaagccaagggcagcagagcgatctggtacatgtggctgggagctcggttcctcgaattcgaggccctgggctttatgaacgaggaccactggttctctcgcgaaaatagcctttccggggtggagggagaaggcctgcataaactcgggtatattctgagagatatctctaagattcccggaggcaacatgtacgccgacgataccgctgggtgggacacgcggatcacagaggatgaccttcagaatgaggccaaaatcaccgatattatggaacctgagcacgctctgctcgccacaagcatctttaagctgacctatcagaacaaagtcgtgcgcgttcaaagacccgcgaagaacggcacggtgatggacgtcatttcccggcgcgatcagagaggatctggccaggtggggacctacggactgaatacattcaccaacatggaagtccagctcatccggcaaatggagagcgaaggcatttttctgccgtccgagcttgagacacctaatctggccgaaagagtgctcgactggctggagaagcatggggctgaacgccttaaacggatggccatctctggagacgattgtgttgtgaagcccatcgacgatagattcgctaccgccctgacagcgctcaacgacatgggcaaagtccgcaaggatattcctcagtgggagcccagcaaagggtggaatgactggcagcaggtgcctttttgctcccaccacttccatcaactgatcatgaaggatggccgggaaattgtggttccctgtagaaaccaggacgagctggtgggacgcgcccgggtcagccagggcgctgggtggtctctcagagagaccgcctgcctgggaaagtcctatgctcaaatgtggcagcttatgtactttcaccgccgggatctgagactcgccgctaatgccatctgtagcgcggtgccggttgactgggtgcctacgtctcgcacaacctggtccattcatgcccaccaccagtggatgaccacagaagatatgctgagcgtctggaaccgggtgtggatcgaggaaaatccctggatggaggacaaaacccatgtctcctcttgggaagaggtgccctatcttggcaagagagaggaccagtggtgcgggagcctgattggactcacagctcgggccacgtgggccaccaacatccaagttgctatcaatcaggtgagacgcctgattggcaacgaaaattacctggattacatgacatccatgaaacggttcaagaacgagagcgaccctgaaggggccctctggtga

SEQ ID NO: 18672 - RNA, 9879 nt, synthetic construct
  misc_feature 1..9879: note = derived and/or modified CDS sequence (opt5) from DENV-1__GQ199858__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattatctctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggccatcgggatcgtcagcattctgctctcttccctgctcaagaatgacgttcccctggcgggacctcttatcgccggcgggatgctgattgcttgttatgtgatcagcggatccagcgccgatctgtctctcgagaaagctgccgaagtgagctgggagcaagaagccgagcattccggcacctctcacaacattctggtcgaagtgcaggacgatgggacgatgaagatcaaagacgaggagcgcgatgacacccttacaatcctgctcaaggctaccctgctcgcggttagcggagtgtaccccatgtccattcctgccacactgtttgtctggtatttctggcagaaaaagaagcagagatctggcgtgctttgggatacccccagcccgcctgaagttgagcgggctgtgctggacgatggcatctaccgcattctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatctcctacggaggcggctggcggttccaagggagctggaataccggagaggaggtgcaggttattgctgtggaacctggcaagaaccccaaaaatgtccagacaaccccggggacctttaagacacctgagggagaagtgggcgccatcgcgctggatttcaagcccgggacgtctggatcccctattgtgaacagagagggcaaaatcgttggcctctacgggaatggagtcgtgaccacaagcggcacctatgtgtctgctatcgcccaagccaaggcttcccaggaagggcccctgcccgagattgaggacgaagtctttaaaaagcgcaaccttacaatcatggatctgcaccctggaagcggcaaaacccggagatacctgccggccattgtgcgcgaggcgatcaagcggaagctcagaacgctgattcttgctcccacacgcgttgtggcctccgaaatggccgaggctctgaaagggatgcctatccggtatcagaccaccgccgtcaagtctgaacatacaggcagagagatcgtggacctcatgtgccacgctaccttcacaatgcgcctgctgagccccgttcgggtgcctaattacaacatgattatcatggatgaggcccattttaccgaccccgcgtccattgccgctagaggatatatcagcacgcgggtcggcatgggggaagccgctgccattttcatgacagccacccctccgggatctgtggaggcttttccccagtccaatgcggttatccaagatgaagagcgcgacatccctgaaagaagctggaactctggctacgattggattacagacttccccgggaaaaccgtgtggtttgtccctagcatcaagtccggaaatgatattgccaactgtctccggaaaaacggcaagcgcgtgatccagctttctagaaagacgttcgacaccgagtatcagaaaacaaagaataacgactgggattacgtggtcaccacagacattagcgagatgggggctaatttccgggccgatagagttatcgacccccgccggtgcctgaaaccggtgattctgaaggatggccctgaaagagtgatcctcgccggacccatgcccgtcaccgtggcttccgccgcgcagcgccggggcagaatcgggcgcaaccaaaataaagagggagaccagtacgtttatatgggccagcctctgaacaatgatgaagaccacgctcattggacagaggccaagatgcttctggataacattaatacccccgaggggatcattcctgccctctttgaaccggagcgggaaaagtctgctgccatcgacggagagtacagactgcgcggcgaagcgagaaaaacgttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatttggacaaaagaaggcgagagaaagaaactgcggcctagatggctcgacgctcgcacctattctgatcccctggcccttcgggagtttaaggaattcgctgccgggagacgctccgtcagcggagacctgatcctcgagatcggcaaactgcctcagcacctgaccctccgggctcagaatgcccttgataacctggtgatgctgcacaattccgaacaggggggaaaggcgtacagacatgccatggaggaactccccgacacaattgagaccctgatgcttctggctctcatcgccgtcctgacaggcggcgtgacgctgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgatccctgagcccgatcggcaacgcacccctcaggacaaccagctggcctatgtcgttattggactcctttttatgatcctgacagtggctgccaacgaaatgggcctgctcgagaccacgaagaaagatctggggattggacatgtggccgctgagaatcaccaacacgccaccatgcttgacgtcgatctgagacccgcgagcgcctggacactctacgctgtggccaccacagttatcacccctatgatgcggcatacgattgaaaacacaaccgctaatatctctctgacagccattgcgaaccaggccgctatcctgatgggcctcgacaagggctggcccatctccaaaatggatattggggtgccgcttctggccctgggatgctacagccaggtcaatcctctcaccctgaccgctgccgtgcttatgctggtcgctcactatgccatcattggccccgggctccaggcgaaggccacacgcgaggctcaaaagagaacggccgctggaatcatgaaaaaccccaccgtggacggcattgttgccatcgatctggaccctgtggtctacgacacaaagttcgaaaaacagctggggcagatcatgctccttattctgtgtacctctcagatcctgctcatgcggacaacctgggccctgtgcgagtccattacgcttgcgacaggaccgctgaccaccctctgggaaggcagccccggcaagttttggaatacaaccatcgctgtgtctatggccaacattttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacatctacaagagaagcgggatcatggaggttgatcggtccgaagccaaagagggactgaagagaggcgaaaccacaaaacatgcggtgtctcgcgggaccgccaagcttcggtggttcgtcgagagaaatctggtgaagcctgagggaaaagtgattgacctcggctgtgggcgcggaggctggagctattactgcgctggcctgaagaaagttacagaagtcaaggggtataccaaaggaggcctggggcacgaggaacccatccctatggccacgtacggatggaacctcgtgaagcttcattccggcaaagatgtgtttttcatgccccctgagaagtgtgacaccctgctgtgcgatattggggaatctagcccgaatcccacaatcgaggagggacggaccctcagagtcctgaagatggttgaaccttggcttcgcggcaaccagttttgtattaaaatcctgaatccctacatgccttccgtggtggagacactcgaacaaatgcagcggaagtatggcgggatgctggtcagaaaccccctgtctcgcaatagcacccacgagatgtactgggtgtcctgcggaacaggcaacattgttagcgctgtgaacatgacctctcggatgctcctgaatagattcacgatggcccaccgcaaaccgacatatgagcgggacgtcgatcttggggcgggaaccagacatgtggccgttgaacctgaggtggctaacctggacatcatcggccagcgcattgaaaatatcaagaacgagcacaaatccacctggcattacgatgaagacaatccctataagacatgggcctaccacgggagctatgaggtcaagccctctggatccgctagctctatggtgaacggcgtggtcagactcctgacgaaaccttgggatgttattcccatggtgacccaaatcgccatgacagacaccacaccttttggccagcagcgggtgttcaaggagaaagtcgacacccgcacaccgagagctaagcgggggaccacgcagattatggaagtgaccgccaaatggctttggggatttctgtccagaaataagaagccccggatctgtacacgcgaggaattcaccagaaaagttcggagcaacgcggccatcggcgctgtgtttgtcgatgagaatcaatggaactccgccaaggaagctgtggaggacgagcgcttctgggatctcgttcacagagaacgggagctgcataaacaggggaagtgcgccacatgcgtgtacaatatgatgggaaaacgcgaaaagaagctgggcgagtttgggaaagccaagggcagcagagcgatttggtacatgtggctcggagctcggttcctggaattcgaggcccttggctttatgaacgaggaccactggttctctcgcgaaaatagcctgtccggggtcgagggagaaggcctccataaactggggtatatccttagagatatttctaagatccctggaggcaacatgtacgccgacgataccgctgggtgggacacgcggattacagaggatgacctgcagaatgaggccaaaatcaccgatatcatggaacccgagcacgctctcctggccacaagcatttttaagctgacctatcagaacaaagtggttcgcgtgcaaagacctgcgaagaacggcacggtcatggacgtgatctcccggcgcgatcagagaggatctggccaggtcgggacctacggactcaatacattcaccaacatggaagtgcagctgattcggcaaatggagagcgaaggcatctttcttccctccgagctggagacaccgaatctcgccgaaagagttctggactggcttgagaagcatggggctgaacgcctgaaacggatggccatttctggagacgattgtgtggtcaagcctatcgacgatagattcgctaccgccctcacagcgctgaacgacatgggcaaagtgcgcaaggatatcccccagtgggagcctagcaaagggtggaatgactggcagcaggtgcccttttgctcccaccacttccatcaactgattatgaaggatggccgggaaatcgttgtgccttgtagaaaccaggacgagctcgtcggacgcgcccgggtgagccagggcgctgggtggtctctgagagagaccgcctgccttggaaagtcctatgctcaaatgtggcagctgatgtactttcaccgccgggatctcagactggccgctaatgccatttgtagcgcggttcccgtggactgggtcccgacgtctcgcacaacctggtccatccatgcccaccaccagtggatgaccacagaagatatgcttagcgtgtggaaccgggtctggattgaggaaaatccttggatggaggacaaaacccatgtgtcctcttgggaagaggttccctatctgggcaagagagaggaccagtggtgcgggagcctcatcggactgacagctcgggccacgtgggccaccaacattcaagtggctatcaatcaggtcagacgcctgatcggcaacgaaaattacctcgattacatgacatccatgaaacggttcaagaacgagagcgaccccgaaggggccctgtggtga

SEQ ID NO: 18673 - RNA, 9879 nt, synthetic construct
  misc_feature 1..9879: note = derived and/or modified CDS sequence (opt5) from DENV-1__GQ199859__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctgacacttgactgtagcccccggaccggcctggattttaacgaaatggtgctcctgacgatgaaggagaaatcttggcttgtccacaagcagtggttcctggacctccctctgccctggacatccggggccagcacctcccaggagacatggaatcgccaagatctgctcgtgacctttaaaaccgctcacgcgaagaagcaggaagtcgtggttctgggatctcaggagggcgccatgcatacagctcttacgggggccaccgaaattcaaacaagcggaaccacaaccatcttcgccggccacctgaaatgcagactcaagatggacaaactgacgctgaaggggacatcctatgtgatgtgtaccggcagctttaaacttgagaaggaagtcgctgagacccagcatggaacagtgctcgttcaggtgaagtacgagggcaccgatgccccgtgcaaaattcctttctctacacaggacgaaaagggggtcacgcaaaacggacggctgatcaccgcgaatcccatcgtgacagataaagagaagcctgtgaacattgaaaccgagccccccttcggcgagtcctatatcgttgtcggggctggagaaaaagccctgaagctcagctggtttaagaaaggctctagcattgggaagatgttcgaggccacagctagaggcgcccgccggatggctatcctgggagacaccgcctgggattttggctccattgggggagtgttcacgtctgtgggcaaacttgtccaccaggtgtttgggaccgcgtacggagttctgttcagcggcgtgtcctggacaatgaagatcgggatcggcattctcctgacctggctgggacttaatagcagatctacatccctcagcatgacctgtatcgccgtcggcatggtgacactgtacctgggggttatggtgcaggctgactctggatgcgtcattaactggaaaggccgcgaactcaagtgtgggtccggaatctttgtgaccaacgaggttcatacgtggacagaacagtataagttccaagccgatagccctaaacggctgtccgctgccattggcaaggcgtgggaggagggggtgtgcggcatcagatctgccacccgccttgaaaatattatgtggaaacagatcagcaacgagctgaatcacatcctcctggaaaacgacatgaagtttaccgtcgtggtgggagacgctaatggcattctggcccaggggaaaaagatgatccggccgcagcccatggagcacaaatactcctggaagtcttggggaaaggctaaaattatcggcgccgatattcaaaacacaaccttcatcatcgacgggcctgatacgcccgaatgtcctgacgatcagagagcctggaatatttgggaggtcgaggactatggatttggcatcttcacaaccaacatttggcttaagctccgcgatagctacacacagatgtgcgaccatcggctgatgtccgctgcgatcaaagatagcaaggccgttcacgctgacatgggctattggattgaatctgagaaaaatgaaacctggaagctggccagagcctcctttatcgaggtgaagacatgtacctggcccaaaagccatacgctctggtctaacggggtgctggaatccgagatgatcattccgaagatctacggaggccctattagccagcacaattatcgccccgggtacttcacccaaacagctggaccttggcaccttggcaaactggagctcgatttcgacctgtgcgaagggaccacagtcgtggttgatgagcattgcggaaaccggggcccctctctgagaaccacgacagtgaccggcaagatcattcacgaatggtgttgccggagctgtacacttcctcccctccgctttagaggggaggacggatgctggtacggcatggagatccggccggtcaaagaaaaggaggaaaatctggtgagatccatggttagcgccgggtctggagaggtggactccttcagcctgggcatcctctgtgtctccattatgatcgaagaggtgatgcgctctcggtggagcagaaagatgctgatgaccgggacccttgcggtttttctgctcctgattatgggacagctgacatggaacgatcttatccgcctgtgcattatggtgggcgctaatgcctccgacagaatgggcatggggacgacctatctcgccctgatggctacattcaaaatgcggcctatgtttgccgtcggaatcctcttccgcagactgacctctcgggaggtgcttctgctcacaattggcctgagcctggtggcgtccgtcgaacttcccaactctctggaggaactcggggatggactggctatgggcatcatgatgctcaagctgcttaccgagtttcagccccatcaactgtggacgacactcctgagcctgaccttcatcaaaaccacactttccctggactacgcctggaagaccacagccatggctctcagcattgtttctctgtttcctctctgtctgtccacgaccagccagaaaacaacctggcttccggtgctgctggggtctttcggatgcaagcccctcacaatgtatctgatcaccgaaaacaagatttggggccgcaaatcctggcctatcaatgagggcattatggccatcgggatcgtgagcattcttctgtcttccctcctgaagaacgatgtccccctcgctggacctctgatcgccggcgggatgcttattgcgtgttacgtgatcagcggatccagcgccgacctgtctctggagaaagctgccgaagttagctgggagcaggaagctgagcactccggcacgtctcataatattctcgtggaagtccaggatgacgggaccatgagaatcaaggatgaggagaaagacgatacactgaccatccttctgaaggccacactcctggccgtgagcggagtttatcccatgtccattcctgctaccctctttgtgtggtacttctggcaaaaaaagaagcagcggtctggcgtcctgtgggacacacccagcccgcctgaagtggagcgcgcggtccttgatgacggcatctatagaattctgcagcgggggctgctcggacgctcccaggtgggcgttggggtgtttcaagacggagtcttccacacgatgtggcacgtgaccagaggcgccgttctgatgtaccaggggaaacggcttgaaccctcttgggctagcgtgaagaaagatctgatctcctacggaggcggctggagattccaggggagctggaacacaggagaggaggtccaggtgattgccgtggaacctggcaagaatcccaaaaacgttcaaaccaccccggggacatttaagacgcctgagggagaagtcggcgccatcgctctcgacttcaagcccgggacctctggatcccctattgtgaatcgcgagggcaaaatcgtgggcctgtatgggaacggagtcgtgacaaccagcggcacatacgtttctgccatcgcgcaggctaaggcctcccaggaagggcccctccccgagattgaggatgaagtgtttaaaaagcggaatctgaccatcatggaccttcatcctggaagcggcaaaacgagacgctatctgccggccattgtccgggaggctatcaagagaaagctgcgcacactcattctggcccccacccgggtggttgcgtccgaaatggctgaggcccttaaagggatgcctatcagataccaaaccacagccgtgaagtctgaacacaccggccgcgagatcgtcgatctgatgtgccatgctacattcaccatgcggctcctgagccccgtgagagttcctaactataatatgattatcatggacgaggcccactttacggatcccgcttccattgccgcgcggggatacatcagcacacgcgtgggcatgggggaagccgctgccattttcatgaccgctacacctccgggatctgtcgaggcctttccccagtccaacgccgtgatccaggacgaagagagagatatccctgaacggagctggaattctggctatgactggattaccgatttccccgggaaaacggtgtggtttgtccctagcatcaagtccggaaacgacattgctaattgtctgcgcaaaaacggcaagagagttatccagctctctcggaagaccttcgacacagagtaccaaaaaaccaagaacaatgattgggactacgtggtgacaaccgatattagcgagatgggggcgaactttagagccgaccgcgtcatcgatccccggagatgccttaaaccggtgattctgaaggacggccctgaacgcgttatcctggctggacccatgcccgtgacagtcgcctccgccgctcagcggagaggccgcatcgggcggaatcagaacaaagagggagatcagtatgtgtacatgggccaacctctcaataacgacgaagatcatgcccactggaccgaggcgaagatgctgcttgacaatattaacacgcccgaggggatcattcctgctctgttcgaaccggagagagaaaagtctgccgccatcgatggagagtatcgcctcagaggcgaagctcggaaaacattcgttgagctgatgcgcagaggggacctgcccgtgtggctcagctacaaggtcgcctccgagggctttcagtatagcgatcggcgctggtgcttcgacggagaaagaaataaccaggtgcttgaggaaaatatggacgtcgagatttggaccaaagaaggcgagcggaagaaactgagacctcgctggctggatgcgcggacctactctgaccccctcgccctgagagagtttaaggaattcgctgccgggcgccggtccgtgagcggagatcttatcctggagatcggcaaactccctcagcacctgacactgagagctcaaaacgccctcgacaatcttgttatgctgcataactccgaacaggggggaaaggcttatcggcacgccatggaggaactgcccgataccattgagacactcatgctgcttgcgctgatcgccgtgctcacgggcggcgtgaccctgtttttcctgtctgggaagggactcggcaaaacaagcattgggcttctgtgtgtcaccgcttcctctgccctgctctggatggctagcgttgagccgcattggatcgccgcctccattatcctggaatttttccttatggtgctgctcatccctgagcccgaccgccagagaacacctcaggataatcaactggcttacgtggtcattggactgctctttatgatccttaccgtggcggccaacgaaatgggcctgctggagacgaccaagcgggacctcgggattggacacgttgctgccgagaaccaccagcatgccacaatgctggatgtggaccttcgccccgctagcgcctggaccctgtacgcggtcgccacaaccgtgatcacgcctatgatgagacacacaattgaaaataccacagctaacatctctctcaccgccattgctaatcaggccgcgatcctgatgggcctggataaaggctggcccatctccaagatggacattggggtcccgctccttgccctgggatgctatagccaagtgaaccctctgaccctcacagctgccgttctgatgcttgtggctcattacgccatcattggccccgggctgcaggctaaagccacgcgggaggcgcagaagcgcaccgccgctggaatcatgaagaatcccacagtcgatggcattgtggccatcgacctcgaccctgttgtgtatgatgctaaattcgaaaagcagctggggcaaatcatgctgctcattctttgtacctctcagatcctgctgatgagaacaacctgggccctctgcgagtccattacgctggccacaggaccgcttaccaccctgtgggaaggcagccccggcaaattttggaacacaaccatcgcggtctctatggctaatattttccgggggagctacctcgccggagctggcctggccttttccctgatgaagtctctcgggggaggccgcagagggacaggagcccagggcgagacgcttggcgagaaatggaagcggcagctgaaccaactgagcaagcctgaattcaatacctataaaagatccgggatcatggaggtggaccgcagcgaagctaaggagggactcaaacggggcgaaacaaccaagcacgccgtgtccagagggacagcgaaactgcgctggttcgttgagcggaaccttgtcaagcccgagggaaaggtgatcgatctgggctgtgggagaggaggctggtcttactattgcgccggcctcaaaaaggtgaccgaagtcaaagggtacacgaagggaggccctgggcatgaggaacccattcctatggctacctacggatggaatctggttaaactgcacagcggcaaggacgtgtttttcatgccgcccgagaaatgtgatacactcctttgcgacatcggggaatcctctcctaaccccaccattgaggagggacgcacactgcgggtgctgaagatggtcgaaccttggctcagaggcaatcagttttgtatcaagattctgaacccctatatgccgagcgtggttgagacccttgaacagatgcagcgcaaacacggcgggatgctggtgcggaatcctctctccagaaactctacacatgagatgtactgggtcagctgcggaaccggcaatatcgtgtccgccgttaacatgacgagccgcatgctgctgaaccggttcacaatggctcacagaaagcccacctatgagcgcgatgtggacctcggggccggaaccagacatgtcgcggtggaacccgaggtggccaatctggatattatcggccaacggatcgaaaacattaaaaatgagcacaagtctacatggcactacgacgaagataacccttataaaacgtgggcttaccatgggtcctatgaggtcaagcccagcggatctgcctccagcatggttaatggcgtggtgcgccttctgaccaagccttgggacgtcatcccgatggtgacacagattgctatgaccgacacaaccccctttggccagcaaagagttttcaaagagaaggtggatacacggacccctagagccaaacgggggacgacccagatcatggaagtcacagctaagtggctctggggatttctgtctcgcaacaaaaagcccagaatttgtacccgggaggaattcacacgcaaggtgagatccaatgccgcgatcggcgccgtttttgtggacgagaaccagtggaatagcgctaaagaagccgtcgaggatgagcggttctgggaccttgtgcaccgcgaaagagagctgcataagcaggggaaatgcgctacctgcgtttacaacatgatgggaaagcgggaaaaaaagctcggcgagtttgggaaggccaaaggctcccgcgccatctggtacatgtggctgggagcgagattcctggaatttgaggctctcggcttcatgaatgaggatcactggttcagccgggaaaactctctgagcggggtggagggagaaggccttcataagctggggtatattctccgcgacatctccaaaattcctggaggcaatatgtacgccgatgacacggccgggtgggatacaagaatcaccgaggacgatctgcaaaacgaggctaagattacagacatcatggaacccgagcacgcccttctggctacctctatctttaaactcacgtatcagaataaggtcgtgcgggtccagcgcccggccaaaaacggcaccgtgatggatgttattagcagacgggaccagagaggatccggccaagtggggacatacggactgaacaccttcacaaatatggaagtccagctgatccgccagatggagtctgaaggcatttttctccctagcgagctggagacccccaaccttgcggaacgggtgctggactggctcgagaagcacggggccgaaagactgaagcgcatggctatctccggagatgactgtgtggttaaacctattgatgaccggttcgccacagctcttaccgccctgaatgatatgggcaaggtgagaaaagacatcccccagtgggagccttctaaggggtggaacgattggcaacaggtccccttttgcagccatcacttccatcagctcatcatgaaagacggccgcgaaattgtggttccgtgtcggaatcaggatgagctggtgggaagagcgcgcgtctcccaaggcgccgggtggagcctgcgggagacggcttgcctcggaaagtcttatgcccagatgtggcagctgatgtactttcacagacgcgaccttcggctggctgccaacgctatctgttccgccgtgcctgtcgattgggtgcccacaagcagaaccacctggtctattcacgcgcatcaccaatggatgacaaccgaagacatgctctccgtttggaatcgggtgtggatcgaggaaaacccctggatggaggacaagacacatgtcagctcctgggaagaggtgccttatctgggcaaaagagaggatcagtggtgcgggtctcttattggactgacggcccgcgctacctgggccacaaatatccaggttgccattaaccaggtgcggagactcatcggcaatgaaaactacctggactacatgaccagcatgaagcgcttcaaaaatgagtccgatccggaaggggctctgtggtga

SEQ ID NO: 18674 - RNA, 9879 nt, synthetic construct
  misc_feature 1..9879: note = derived and/or modified CDS sequence (opt5) from DENV-1__JF937645__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacactggtggaccgcggctggggcaatgggtgtggactttttggcaaagggagcctgctcacctgcgccaagttcaagtgcgtcacaaaactggagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctcacagactacggcgccctgacccttgactgtagccccagaacaggcctggattttaacgaaatggttctcctgaccatgaaggagaaatcttggcttgtgcataagcaatggttcctggacctccctctgccctggacgtccggggctagcacatcccaggagacctggaatcggcaggatctgctcgtcacatttaaaaccgcgcacgccaagaagcaagaagtggtcgtgctgggatctcaggagggcgctatgcacaccgcccttacaggggccacggaaatccagaccagcggaacaaccacaattttcgctggccatctgaaatgccgcctcaagatggacaaactgaccctgaaggggacgtcctatgttatgtgtacaggcagctttaaacttgagaaggaagtggccgagacccagcacggaaccgtcctcgtgcaagttaagtacgagggcacagatgcgccgtgcaaaatccctttctctacccaggacgaaaagggggtgacacagaacggaagactgatcacggctaatcccattgtcaccgataaagagaagcctgtgaacatcgaaacagagccccccttcggcgagtcctatattgtggttggggccggagaaaaagccctgaagctcagctggtttaagaaaggctctagcatcgggaagatgttcgaggctaccgcccggggcgctagacgcatggccattctgggagacacagcgtgggattttggctccatcgggggagtcttcacctctgtgggcaaacttgtgcatcaggtctttgggacggcctacggagtgctgttcagcggcgtttcctggaccatgaagatcgggattggcatcctcctgacatggctgggacttaatagccggtctacctccctcagcatgacatgtattgctgtgggcatggtcaccctgtacctgggggtgatggttcaagccgactctggatgcgtgatcaactggaaaggcagagaactcaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagacttgaaaatatcatgtggaaacagatcagcaacgagctgaatcatattctcctggaaaacgacatgaagtttaccgtggtcgtgggagacgccaatggcatcctggctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacaatcagcgggcttggaacatctgggaggtggaggattatggatttggcattttcacgacaaatatctggcttaagctcagagacagctacacccaaatgtgcgatcaccgcctgatgtccgcggccattaaagacagcaaggctgtccatgccgatatgggctattggatcgaatctgagaaaaacgaaacatggaagctggcccgggcttcctttatcgaggttaagacctgtacatggcccaaaagccacaccctctggtctaatggggtgctggaatccgagatgattatcccgaagatttacggaggccctatcagccagcataactatagacccgggtacttcacgcagaccgccggaccttggcaccttggcaaactggagctcgacttcgatctgtgcgaagggacaaccgtggtcgtggacgagcactgcggaaatcgcggcccctctctgcggacaaccacggttacaggcaagattatccatgaatggtgttgcagaagctgtacccttcctcccctccggtttcgcggggaggatggatgctggtacggcatggagatcagaccggtgaaagaaaaggaggaaaacctggtccggtccatggtgagcgcggggtctggagaggttgactccttcagcctgggcattctctgtgcttccatcatgattgaagaggtgatgagatctcgctggagccggaagatgctgatgacagggacccttgccgtctttctgctcctgatcatgggacaactgacctggaatgaccttattagactgtgcatcatggtgggcgccaacgcttccgatcgcatgggcatggggacaacgtatctcgccctgatggcgaccttcaaaatgagacctatgtttgctgttggactcctgttccggcgccttacatctagagaggtgctgctcctgaccattggcctgagccttgtcgcctccgtggaactgcccaactctctcgaggaactgggggacggactcgccatgggcatcatgatgctgaagcttctgacagagtttcagccccaccagctctggaccacgctgctgagccttacattcatcaaaaccaccctgtccctcgattacgcttggaagacaaccgccatggctctgagcattgtgtctctctttcctctgtgtctttccacaacgagccagaaaaccacatggctgccggtcctgctcgggtctttcggatgcaagcccctgaccatgtttcttatcacagaaaataagatttggggccggaaatcctggcctctgaacgagggcatcatggccattgggatcgttagcatcctcctgtcttccctcctgaagaatgacgtgccccttgcgggacctctgattgccggcgggatgctgatcgcttgttatgtgattagcggatccagcgccgatctctctctggagaaagctgccgaagtcagctgggagcaagaagccgagcattccggcacctctcacaacatccttgtggaagttcaggacgatgggacgatgaagattaaagacgaggagcgcgatgacaccctgacaatcctcctgaaggctaccctcctggcggtgagcggagtctaccccatgtccatccctgccacacttttcgtgtggtatttttggcagaaaaagaagcagagatctggcgttctgtgggatacccccagcccgcctgaagtggagcgggctgtcctggacgatggcatttaccgcatcctccaaagagggctgcttggacggtcccaggtgggcgtcggggtgttccaggacggagttttccatacaatgtggcacgtgacgcgcggcgccgtcctgatgtatcaggggaaaagactcgaaccctcttgggccagcgtgaagaaagacctgatttcctacggaggcggctggcggtttcaagggagctggaataccggagaggaggttcaggtgatcgctgtcgaacctggcaagaaccccaaaaatgtgcagacaaccccggggaccttcaagacacctgagggagaagtgggcgccattgcgctcgattttaagcccgggacgtctggatcccctatcgttaacagagagggcaaaattgtcggcctgtacgggaatggagtggtgaccacaagcggcacctatgtctctgctatcgcccaagccaaggcttcccaggaagggccccttcccgagatcgaggacgaagtgttcaaaaagcgcaacctgacaattatggatctgcaccctggaagcggcaaaacccggagatacctcccggccatcgttcgcgaggcgattaagcggaagctgagaacgcttatcctggctcccacacgcgtggtcgcctccgaaatggccgaggctctcaaagggatgcctattcggtatcagaccaccgccgtgaagtctgaacatacaggcagagagatcgttgacctgatgtgccacgctacctttacaatgcgcctgctcagccccgtgcgggtccctaattacaacatgatcattatggatgaggcccatttcaccgaccccgcgtccatcgccgctagaggatatattagcacgcgggtgggcatgggggaagccgctgccatctttatgacagccacccctccgggatctgttgaggctttcccccagtccaatgcggtgattcaagatgaagagcgcgacatccctgaaagaagctggaactctggctacgattggatcacagactttcccgggaaaaccgtctggttcgtgcctagcattaagtccggaaatgatatcgccaactgtcttcggaaaaacggcaagcgcgtgattcagctgtctagaaagacgtttgacaccgagtatcagaaaacaaagaataacgactgggattacgtcgttaccacagacatcagcgagatgggggctaatttccgggccgatagagtgattgacccccgccggtgcctgaaaccggtgatcctcaaggatggccctgaaagagtcattctggccggacccatgcccgtgaccgttgcttccgccgcgcagcgccggggcagaatcgggcgcaaccaaaataaagagggagaccagtacgtgtatatgggccagcctcttaacaatgatgaagaccacgctcattggacagaggccaagatgctgctcgataacatcaatacccccgaggggattatccctgccctgttcgaaccggagcgggaaaagtctgctgccattgacggagagtacagactgcgcggcgaagcgagaaaaacgtttgtcgagctcatgcggcgcggggatcttcccgtgtggctgagctataaggttgcctccgagggcttccagtacagcgacagacggtggtgctttgatggagaacgcaacaatcaagtgctggaggaaaacatggacgtcgagatctggacaaaagaaggcgagagaaagaaactccggcctagatggctggacgctcgcacctattctgatccccttgccctgcgggagttcaaggaatttgctgccgggagacgctccgtgagcggagacctcattctggagatcggcaaactgcctcagcacctcacccttcgggctcagaatgccctggataacctggtcatgctccacaattccgaacaggggggaaaggcgtacagacatgccatggaggaactgcccgacacaatcgagacccttatgctgctcgctctgattgccgtgctgacaggcggcgttacgctcttctttctttctgggaagggactgggcaaaaccagcatcgggctgctctgtgtgacagcttcctctgccctgctttggatggccagcgtggagccgcactggattgctgcgtccatcattctggaattctttctcatggtcctgctgatccctgagcccgatcggcaacgcacccctcaggacaaccagctcgcctatgttgtgatcggacttctgttcatgattctgacagtggctgccaacgaaatgggcctcctggagaccacgaagaaagatcttgggatcggacatgtcgccgctgagaatcaccaacacgccaccatgctggacgtggatctcagacccgcgagcgcctggacactgtacgctgttgccaccacagtgattacccctatgatgcggcatacgatcgaaaacacaaccgctaatatttctctgacagccatcgcgaaccaggccgctattctcatgggccttgacaagggctggcccatctccaaaatggatatcggggtcccgctgctggccctcggatgctacagccaggtgaatcctctgacccttaccgctgccgtcctgatgctcgtggctcactatgccattatcggccccgggctgcaggcgaaggccacacgcgaggctcaaaagagaacggccgctggaattatgaaaaaccccaccgttgacggcatcgtggccattgatctggaccctgtcgtgtacgacgccaagtttgaaaaacagctcgggcagatcatgcttctgatcctgtgtacatctcagattctcctgatgcggaccacatgggcgctttgcgagtccatcaccctggctacgggaccgctcacaaccctgtgggaaggcagccccggcaagttctggaataccacaattgccgtttctatggctaacatctttcgcgggagctatctggccggagccggcctcgctttctcccttatgaaatctctggggggaggcagacgggggaccggagcccaaggcgagacactgggcgagaagtggaagcgccagctcaatcagctgagcaaatccgaattcaacacgtacaagagaagcgggattatggaggtggatcggtccgaagcgaaagagggacttaagagaggcgaaaccacaaaacatgccgtctctcgcgggaccgctaagctgcggtggtttgtggagagaaatctcgtgaagcctgagggaaaagttatcgacctgggctgtgggcgcggaggctggagctattactgcgccggcctgaagaaagtcacagaagtgaaggggtataccaaaggaggccccgggcacgaggaacctatccccatggctacgtacggatggaacctcgtgaagcttcattccggcaaagatgtcttctttatgcctccggagaagtgtgacaccctgctgtgcgatattggggaatctagccccaatcctacaatcgaggagggacggaccctcagagttctgaagatggtggaaccctggcttcgcggcaaccagttctgtattaaaatcctgaatccttacatgccctccgtggtcgagacactcgaacaaatgcagcggaagcacggcgggatgctggtgagaaacccgctgtctcgcaatagcacccacgagatgtattgggtttcctgcggaacaggcaacattgtgagcgccgtcaacatgacctctcggatgctcctgaatagatttacgatggcgcatcgcaaacctacatacgagcgggacgtggatcttggggccggaaccagacacgttgctgtggaacccgaggtcgccaacctggacatcattggccagcgcatcgaaaatatcaagaacgagcataaatccacctggcactatgatgaagacaatccctacaagacatgggcttatcacgggagctacgaggtgaagccttctggatccgccagctctatggtgaacggcgtcgttagactcctgacgaaaccctgggatgtgattcctatggtgacccaaatcgctatgacagacaccacaccgttcggccagcagcgggtctttaaggagaaagtggacacccgcacacccagagccaagcgggggaccacgcagattatggaagttaccgcgaaatggctttggggattcctgtccagaaataagaagcctcggatctgtacacgcgaggaatttaccagaaaagtgcggagcaacgccgctattggcgccgtcttcgtggatgagaatcaatggaactccgctaaggaagccgttgaggacgagcgcttttgggatctcgtgcatagagaacgggagctgcacaaacaggggaagtgcgccacatgcgtctataatatgatgggaaaacgcgaaaagaagctgggcgagttcgggaaagcgaagggcagcagagctatctggtacatgtggctcggagcccggtttctggaattcgaggcccttggcttcatgaacgaggaccattggttttctcgcgaaaatagcctgtccggggtggagggagaaggcctccacaaactggggtacatccttagagatatttctaagatccccggaggcaacatgtatgctgacgataccgccgggtgggacacgcggattacagaggatgacctgcagaatgaggctaaaatcaccgatattatggaacctgagcatgccctcctggcgacaagcatcttcaagctgacctaccagaacaaagttgtgcgcgtccaaagacccgccaagaacggcacggtgatggacgtcatctcccggcgcgatcagagaggatctggccaggtggggacctatggactcaatacatttaccaacatggaagttcagctgattcggcaaatggagagcgaaggcatcttccttccgtccgagctggagacacctaatctcgctgaaagagtgctggactggcttgagaagcacggggccgaacgcctgaaacggatggctatttctggagacgattgtgtcgtgaagcccatcgacgatagatttgccaccgcgctcacagccctgaacgacatgggcaaagtgcgcaaggatattcctcagtgggagcccagcaaagggtggaatgactggcagcaggttcctttctgctcccaccattttcaccaactgatcatgaaggatggccgggaaatcgtggtcccctgtagaaaccaggacgagctcgtgggacgcgctcgggttagccagggcgccgggtggtctctgagagagaccgcttgccttggaaagtcctacgcccaaatgtggcagctgatgtatttccatcgccgggatctcagactggctgccaatgcgatttgtagcgccgtgccggtcgactgggtgcctacgtctcgcacaacctggtccatccacgctcaccatcagtggatgaccacagaagatatgcttagcgtctggaaccgggtgtggattgaggaaaatccctggatggaggacaaaacccacgtttcctcttgggaagaggtgccctacctgggcaagagagaggaccagtggtgcgggagcctcatcggactgacagcccgggccacgtgggctaccaacattcaagtcgccatcaatcaggtgagacgcctgattggcaacgaaaattatctcgattacatgacatccatgaaacggtttaagaacgagagcgaccctgaaggggcgctgtggtga

SEQ ID NO: 18675 - RNA, 9879 nt, synthetic construct
  misc_feature 1..9879: note = derived and/or modified CDS sequence (opt5) from DENV-1__FJ850114__SS-prME
  source 1..9879: mol_type = other RNA
agcgtgaccatgctgcttatgctgcttcccacagctctggctttccacctcacgaccagaggcggggaacctcatatgatcgtgtccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacatctcctgccattcttcggaaactgtgcatcgaagcgaagatttccaacaccacgacagacagccgctgtccgacccagggagaggccaccctcgttgaagaacaggatgctaatttcgtgtgcagacggacatttgtggaccgcggctggggcaacgggtgtggactgttcggcaaagggtctcttctgacctgcgccaagtttaagtgcgtcacaaaactcgagggaaagatcgtgcagtacgaaaatctgaaatattccgttatcgtgacggtccacaccggcgatcaacatcaggtggggaacgagacaaccgaacacggaacaattgctaccatcacgccccaggcccctaccagcgagattcagctgacagactacggcgccctcaccctggactgttctcccagaacaggccttgatttcaatgaaatggttctgctcaccatgaaggagaaatcctggctggtgcataagcaatggtttcttgacctgcctctcccctggacgagcggggcttccacatctcaggagacctggaaccggcaggatctgctggtcacattcaaaaccgcgcacgccaagaagcaagaagtggtcgtgctcggaagccaggagggcgctatgcacaccgccctgacaggggccacggaaatccagacctccggaacaaccacaatttttgctggccatcttaaatgccgcctgaagatggacaaactcaccctgaaggggacgagctatgttatgtgtacaggctctttcaaactggagaaggaagtggccgagacccagcacggaaccgtccttgtgcaagttaagtacgagggcacagatgcgccgtgcaaaatccctttctccacccaggacgaaaagggggtgacacagaatggaagactcatcacggctaaccccattgtcaccgataaagagaagcctgtgaatatcgaaacagagccgccctttggcgagagctatattgtggttggggccggagaaaaagccctgaagctgtcttggttcaagaaaggcagctccatcgggaagatgtttgaggctaccgcccggggcgctagacgcatggccattctcggagacacagcgtgggatttcggctctatcgggggagtctttaccagcgtgggcaaactggtgcatcaggtcttcgggacggcctacggagtgctcttttccggcgttagctggaccatgaagatcgggattggcatcctgctcacatggctgggactgaactctcggtccaccagcctttctatgacatgtattgctgtgggcatggtcaccctctacctgggggtgatggttcaagccgactccggatgcgtgatcaattggaaaggcagagaactgaagtgtgggagcggaattttcgtcacaaacgaggtgcacacctggacggaacagtataagtttcaggctgattcccctaaacgcctctctgccgcgatcggcaaggcctgggaggagggggtttgcggcattcggagcgctacaagactggaaaacatcatgtggaaacagatctccaatgagcttaaccatattctgctcgaaaatgacatgaagttcaccgtggtcgtgggagacgccaacggcatcctggctcaagggaaaaagatgattcgcccgcagcccatggagcacaaatactcttggaaaagctggggaaaggccaagatcattggcgccgatatccagaataccacatttatcattgacgggcctgatacccccgaatgtcctgacaaccagcgggcttggaatatctgggaggtggaggattatggattcggcatttttacgacaaacatctggctgaaacttagagactcctacacccaaatgtgcgatcaccgcctcatgagcgcggccattaaagactctaaggctgtccatgccgatatgggctattggatcgaatccgagaaaaatgaaacatggaagctggcccgggctagcttcatcgaggttaagacctgtacatggcccaaatctcacaccctgtggtccaacggggtgctcgaaagcgagatgattatcccgaagacgtacggaggccctatttctcagcataattatagacccgggtacttcacccagacagccggaccttggcacctgggcaaacttgagctggactttgatctctgcgaagggaccacagtggtcgtggacgagcactgcggaaaccgcggccccagcctgcggaccacgacagttaccggcaagatcattcatgaatggtgttgcagatcctgtacactgcctccccttcggttccgcggggaggatggatgctggtacggcatggagatcagaccggtgaaagaaaaggaggaaaatctcgtccggagcatggtgtctgcggggtccggagaggttgacagcttttccctgggcatcctgtgtgcttctattatgatcgaagaggtgatgagaagccgctggtcccggaagatgctcatgaccgggaccctggccgtcttccttctgctcattatgggacaactgacatggaacgacctgatcagactttgcattatggtgggcgccaatgcttctgatcgcatgggcatggggacgacctatctggccctcatggcgacatttaaaatgagacctatgttcgctgttggactgctctttcggcgcctgaccagcagagaggtgcttctgctcacaatcggcctgtccctggtcgcctctgtggaacttcccaacagcctggaggaactcggggacggactggccatgggcattatgatgctcaagctgcttaccgagttccagccccaccagctgtggacgacactcctgtccctgacctttatcaaaaccacacttagcctggattacgcttggaagaccacagccatggctctctctatcgtgtccctgttccctctctgtctgagcacgacctctcagaaaacaacctggcttccggtcctgctggggtcctttggatgcaagcccctcacaatgttcctgattaccgaaaacaagatctggggccggaaaagctggcctcttaatgagggcattatggccatcgggattgtttctatcctgctctccagcctgctcaagaacgacgtgcccctggcgggacctcttatcgccggcgggatgctgattgcttgttatgtgatctccggaagctctgccgatctgagcctcgagaaagctgccgaagtctcctgggagcaagaagccgagcattctggcacgagccacaatattctggtggaagttcaggacgatgggaccatgaagatcaaagacgaggagcgcgatgacacacttaccattctgctcaaggctacactgctcgcggtgtccggagtctaccccatgtctatccctgccaccctgtttgtgtggtatttctggcagaaaaagaagcagagaagcggcgttctttgggatacaccctccccgcctgaagtggagcgggctgtcctggacgatggcatctaccgcattctgcaaagagggctcctgggacggtctcaggtgggcgtcggggtgttccaggacggagtttttcatacgatgtggcacgtgacccgcggcgccgtccttatgtatcaggggaaaagactggaacccagctgggcctccgtgaagaaagacctcatcagctacggaggcggctggcggttccaagggtcttggaacacaggagaggaggttcaggtgattgctgtcgaacctggcaagaatcccaaaaacgtgcagaccaccccggggacatttaagacgcctgagggagaagtgggcgccatcgcgctggatttcaagcccgggacctccggaagccctattgttaatagagagggcaaaatcgtcggcctctacgggaacggagtggtgacaacctctggcacatatgtctccgctattgcccaagccaaggctagccaggaagggcccctgcccgagatcgaggacgaagtgtttaaaaagcgcaatcttaccatcatggatctgcaccctggatccggcaaaacgcggagatacctgccggccattgttcgcgaggcgatcaagcggaagctcagaacactgattcttgctcccacccgcgtggtcgcctctgaaatggccgaggctctgaaagggatgcctatccggtatcagaccacagccgtcaagagcgaacataccggcagagagattgttgacctcatgtgccacgctacattcaccatgcgcctgctgtcccccgtgcgggtccctaactacaatatgatcatcatggatgaggcccattttacggaccccgcgagcattgccgctagaggatatatctctacacgggtgggcatgggggaagccgctgccattttcatgaccgccacacctccgggatccgttgaggcttttccccagagcaacgcggtgatccaagatgaagaacgcgacattcctgaaagatcttggaatagcggctacgattggatcaccgacttccccgggaaaacggtctggtttgtgccttccatcaagtctggaaacgatattgccaattgtctccggaaaaacggcaagcgcgtgatccagcttagcagaaagaccttcgacacagagtatcagaaaaccaagaacaatgactgggattacgtcgttacaaccgacatttccgagatgggggctaacttccgggccgatagagtgatcgacccccgccggtgcctgaaaccggtgattctgaaggatggccctgaaagagtcatcctcgccggacccatgcccgtgacagttgcttctgccgcgcagcgccggggcagaattgggcgcaatcaaaacaaagagggagaccagtacgtgtatatgggccagcctctgaataacgatgaagaccacgctcattggaccgaggccaagatgcttctggataatatcaacacgcccgaggggatcattcctgccctctttgaaccggagcgggaaaagagcgctgccatcgacggagagtacagactgcgcggcgaagcgagaaaaacattcgtcgagctgatgcggcgcggggatctccccgtgtggctttcctataaggttgccagcgagggctttcagtactctgacagacggtggtgcttcgatggagaacgcaataaccaagtgctggaggaaaatatggacgtcgagatttggaccaaagaaggcgagagaaagaaactgcggcctagatggctcgacgctcgcacctattccgatcccctggcccttcgggagtttaaggagttcgctgccgggagacgcagcgtgtccggagacctgatcctcgagattggcaaactgcctcagcacctgacactccgggctcagaacgcccttgataatctggtcatgctgcacaactctgaacaagggggaaaggcgtacagacatgccatggaggaactccccgacaccatcgagacactgatgcttctggctctcatcgccgtgctgacgggcggcgttaccctgtttttcctcagcgggaagggacttggcaaaacatccattgggctgctgtgtgtgaccgcttctagcgccctcctgtggatggcctccgtggagccgcactggatcgctgcgagcattatccttgaatttttcctgatggtcctcctgattcctgagcccgatcggcaacgcacacctcaggacaatcagctggcctatgttgtgatcggactcctttttatgatcctgaccgtggctgccaacgaaatgggcctgctcgagacgaccaagaaagatctggggattggacatgtcgccgctgagaaccaccaacacgccacaatgcttgacgtggatctgagacccgcgtctgcctggaccctctacgctgttgccacaaccgtgatcacgcctatgatgcggcatacaattgaaaataccacagctaacatctccctgaccgccattgcgaatcaggccgctatcctgatgggcctcgacaagggctggcccattagcaaaatggatatcggggtcccgcttctggccctgggatgctactctcaggtgaaccctctcaccctgacagctgccgtccttatgctggtggctcactatgccatcattggccccgggctccaggcgaaggccacgcgcgaggctcaaaagagaaccgccgctggaatcatgaaaaatcccacagttgacggcattgtggccatcgatctggaccctgtcgtgtacgacgccaagttcgaaaaacagctggggcagattatgctccttatcctgtgtacctcccagatcctgctcatgcggacaacctgggcgctgtgcgagagcattacgcttgctacaggaccgctgaccaccctctgggaaggctctcccggcaagttttggaacacaaccatcgccgttagcatggctaatattttccgcgggtcctatctggccggagccggcctggctttctctctcatgaaaagccttgggggaggcagacgggggacaggagcccaaggcgagacgctgggcgagaagtggaagcgccagctgaaccagctctccaaaagcgaatttaatacctacaagagatccgggatcatggaggtggatcggtctgaagcgaaagagggactgaagagaggcgaaacaaccaaacatgccgtcagccgcgggacagctaaacttcggtggttcgtggagagaaacctggtgaagcctgagggaaaagttattgacctcggctgtgggcgcggaggctggtcctattactgcgccggcctgaagaaagtcaccgaagtgaaggggtatacgaaaggaggccccgggcacgaggaacctatccccatggctacctacggatggaatctggtgaagctccattctggcaaagatgtctttttcatgcctccggagaagtgtgacacacttctgtgcgatatcggggaaagctcccccaaccctaccattgaggagggacggacactgagagttctcaagatggtggaaccctggctgcgcggcaatcagttttgtatcaaaattcttaacccttacatgccctctgtggtcgagatcctggaacaaatgcagcggaagcacggcgggatgctcgtgagaaatccgctgagccgcaactccacccacgagatgtattgggttagctgcggaacaggcaatattgtgtctgccgtcaacatgacctcccggatgctgctcaacagattcacgatggcgcatcgcaaacctacatacgagcgggacgtggatctgggggccggaaccagacacgttgctgtggaacccgaggtcgccaatcttgacatcattggccagcgcatcgaaaacatcaagaatgagcataaaagcacctggcactatgatgaagacaacccctacaagacatgggcttatcacgggtcttacgaggtgaagccttccggaagcgcctcttccatggtgaatggcgtcgttagactgctcacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctgtggggatttcttagcagaaacaagaagcctcggatctgtacacgcgaggagttcaccagaaaagtgcggtccaatgccgctattggcgccgtctttgtggatgagaaccaatggaatagcgctaaggaagccgttgaggacgagcgcttctgggatctggtgcatagagaacgggagctccacaaacaggggaagtgcgccacatgcgtctataacatgatgggaaaacgcgaaaagaagctgggcgagtttgggaaagcgaagggctctagagctatctggtacatgtggctgggagcccggttcctcgagttcgaggccctgggctttatgaatgaggaccattggttcagccgcgaaaactccctttctggggtggagggagaaggcctgcacaaactcgggtacatcctgagagatattagcaagatccccggaggcaatatgtatgctgacgataccgccgggtgggacacgcggattacagaggatgaccttcagaacgaggctaaaatcaccgatattatggaacctgagcatgccctgctcgcgacatccatctttaagctgacctaccagaataaagttgtgcgcgtccaaagacccgccaagaacggcacggtgatggacgtcatctctcggcgcgatcagagaggaagcggccaggtggggacctatggactgaacacattcaccaatatggaagttcagctcattcggcaaatggagtccgaaggcatctttctgccgtctgagcttgagacacctaacctggctgaaagagtgctcgactggctggagaagcacggggccgaacgccttaaacggatggctattagcggagacgattgtgtcgtgaagcccatcgacgatagattcgccaccgcgctgacagccctcaatgacatgggcaaagtgcgcaaggatattcctcagtgggagccctccaaagggtggaacgactggcagcaggttcctttttgcagccaccatttccaccaactgatcatgaaggatggccgggaaatcgtggtcccctgtagaaatcaggacgagctggtgggacgcgctcgggtttctcagggcgccgggtggtccctcagagagaccgcttgcctgggaaagagctacgcccaaatgtggcagcttatgtattttcatcgccgggatctgagactcgctgccaacgcgatttgttctgccgtgccggtcgactgggtgcctacgtcccgcacaacctggagcatccacgctcaccatcagtggatgaccacagaagatatgctgtccgtctggaatcgggtgtggattgaggaaaacccctggatggaggacaaaacccacgtttctagctgggaagaggtgccctaccttggcaagagagaggaccagtggtgcgggtccctgatcggactcacagcccgggccacgtgggctaccaatattcaagtcgccatcaaccaggtgagacgcctgattggcaatgaaaactatctggattacatgatcagcatgaaacggttcaagaatgagtctgaccctgaaggggcgctctggtga

SEQ ID NO: 18676 - RNA, 9879 nt, synthetic construct
  misc_feature 1..9879: note = derived and/or modified CDS sequence (opt5) from DENV-1__JN819402__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatgaccaacatcttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacacctacaagagaagcgggattatggaggtggatcggtccgaagccaaagagggactgaagagaggcgaaacaaccaaacatgcggtctctcgcgggacagccaagcttcggtggttcgtggagagaaatctggtgaagcctgagggaaaagttatcgacctcggctgtgggcgcggaggctggagctattactgcgctggcctgaagaaagtcaccgaagtgaaggggtatacgaaaggaggccccgggcacgaggaacctatccccatggccacctacggatggaacctggtgaagctccattccggcaaagatgtctttttcatgcctccggagaagtgtgacacacttctgtgcgatattggggaatctagccccaatcctaccatcgaggagggacggacactgagagttctcaagatggtggaaccctggctgcgcggcaaccagttttgtattaaaatccttaatccttacatgccctccgtggtcgagaccctggaacaaatgcagcggaagcacggcgggatgctcgtgagaaacccgctgtctcgcaatagcacacacgagatgtattgggtttcctgcggaaccggcaacattgtgagcgctgtcaacatgacgtctcggatgctgctcaatagattcacaatggcccatcgcaaacctacctacgagcgggacgtggatctgggggcgggaaccagacacgttgccgtggaacccgaggtcgctaaccttgacatcattggccagcgcatcgaaaatatcaagaacgagcataaatccacatggcactatgatgaagacaatccctacaagacgtgggcctatcacgggagctacgaggtgaagccttctggatccgctagctctatggtgaacggcgtcgttagactgctcaccaaaccctgggatgtgattcctatggtgacacaaatcgccatgaccgacacaaccccgtttggccagcagcgggtcttcaaggagaaagtggacacacgcacccccagagctaagcgggggacgacccagattatggaagttacagccaaatggctgtggggatttctttccagaaataagaagcctcggatctgtacccgcgaggaattcacaagaaaagtgcggagcaacgcggccattggcgctgtctttgtggatgagaatcaatggaactccgccaaggaagctgttgaggacgagcgcttctgggatctggtgcatagagaacgggagctccacaaacaggggaagtgcgccacctgcgtctataatatgatgggaaaacgcgaaaagaagctgggcgagtttgggaaagccaagggcagcagagcgatctggtacatgtggctgggagctcggttcctcgaattcgaggccctgggctttatgaacgaggaccattggttctctcgcgaaaatagcctttccggggtggagggagaaggcctgcacaaactcgggtacatcctgagagatatttctaagatccccggaggcaacatgtatgccgacgatacggctgggtgggacacacggattaccgaggatgaccttcagaatgaggccaaaatcacagatattatggaacctgagcatgctctgctcgccaccagcatctttaagctgacgtaccagaacaaagttgtgcgcgtccaaagacccgcgaagaacggcaccgtgatggacgtcatctcccggcgcgatcagagaggatctggccaggtggggacatatggactgaataccttcacaaacatggaagttcagctcattcggctgatggagagcgaaggcatctttcttccgtccgagctggagacccctaatctcgccgaaagagtgctggactggcttgagaagcacggggctgaacgcctgaaacggatggccatttctggagacgattgtgtcgtgaagcccatcgacgatagattcgctacagccctcaccgcgctgaacgacatgggcaaagtgcgcaaggatattcctcaatgggagcccagcaaagggtggaatgactggcagcaggttcctttttgctcccaccatttccaccagctgatcatgaaggatggccgggaaatcgtggtcccctgtagaaaccaagacgagctcgtgggacgcgcccgggttagccagggcgctgggtggtctctgagagagacggcctgccttggaaagtcctacgctcagatgtggcaactgatgtattttcatcgccgggatctcagactggccgctaatgccatttgtagcgcggtgccggtcgactgggtgcctacatctcgcaccacctggtccatccacgcccaccatcagtggatgacaaccgaagatatgcttagcgtctggaaccgggtgtggattgaggaaaatccctggatggaggacaaaacacacgtttcctcttgggaagaggtgccctacctgggcaagagagaggaccagtggtgcgggagcctcatcggactgacggctcgggccacctgggccacaaacattcaggtcgctatcaatcaagtgagacgcctgattggcaacgaaaattatctcgattacatgacctccatgaaacggttcaagagcgagtctgaccctgaaggggccctgtggtga

SEQ ID NO: 18677 - RNA, 9879 nt, synthetic construct
  misc_feature 1..9879: note = derived and/or modified CDS sequence (opt5) from DENV-1__FJ850113__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgctggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggtgctcagcattgtctctctgttccctctctgtctgtccacaacgagccagaaaaccacatggcttccggttctgctggggtcttttggatgcaagcccctcaccatgttcctgatcacagaaaataagatttggggccggaaatcctggcctcttaacgagggcatcatggctattgggatcgtgagcatcctgctctcttccctgctcaagaatgacgtgcccctggccggacctcttattgcgggcgggatgctgatcgcctgttatgtcattagcggatccagcgctgatctgtctctcgagaaagccgctgaagtgagctgggagcaagaagccgagcattccggcacctctcacaacatcctggttgaagtgcaggacgatgggacgatgaagattaaagacgaggagcgcgatgacacccttacaatcctgctcaaggccaccctgctcgctgtcagcggagtgtaccccatgtccatccctgcgacactgtttgtttggtatttctggcagaaaaagaagcagagatctggcgtgctttgggatacccccagcccgcctgaagtcgagcgggccgtgctggacgatggcatttaccgcatcctgcaaagagggctcctgggacggtcccaggtcggcgtgggggttttccaggacggagtgtttcatacaatgtggcacgtcacgcgcggcgctgtgcttatgtatcaggggaaaagactggaaccctcttgggccagcgttaagaaagacctcatttcctacggaggcggctggcggttccaagggagctggaataccggagaggaggtgcaggtcatcgccgtggaacctggcaagaaccccaaaaatgtgcagacaaccccggggacctttaagacacctgagggagaagttggcgctattgccctggatttcaagcccgggacgtctggatcccctatcgtcaacagagagggcaaaattgtgggcctctacgggaatggagtggtcaccacaagcggcacctatgtgtctgcgatcgctcaagccaaggcctcccaggaagggcccctgcccgagatcgaggacgaagtttttaaaaagcgcaaccttacaattatggatctgcaccctggaagcggcaaaacccggagatacctgccggctatcgtgcgcgaggccattaagcggaagctcagaacgctgatccttgcgcccacacgcgtcgtggcttccgaaatggccgaggccctgaaagggatgcctattcggtatcagaccaccgctgttaagtctgaacatacaggcagagagatcgtggacctcatgtgccacgccaccttcacaatgcgcctgctgagccccgtccgggtgcctaattacaacatgatcattatggatgaggctcattttaccgaccccgcctccatcgcggccagaggatatattagcacgcgggttggcatgggggaagctgccgctatcttcatgacagccacccctccgggatctgtggaggcctttccccagtccaatgctgtcattcaagatgaagaacgcgacatccctgaaagaagctggaactctggctacgattggatcacagacttccccgggaaaaccgtgtggtttgtgcctagcattaagtccggaaatgatatcgcgaactgtctccggaaaaacggcaagcgcgtcattcagctttctagaaagacgttcgacaccgagtatcagaaaacaaagaataacgactgggattacgttgtgaccacagacatcagcgagatgggggccaatttccgggctgatagagtgattgacccccgccggtgcctgaaaccggtcatcctgaaggatggccctgaaagagtgattctcgccggacccatgcccgttaccgtggcctccgctgcccagcgccggggcagaatcgggcgcaaccaaaataaagagggagaccagtacgtctatatgggccagcctctgaacaatgatgaagaccacgcgcattggacagaggctaagatgcttctggataacatcaatacccccgaggggattatccctgccctctttgaaccggagcgggaaaagtctgccgctattgacggagagtacagactgcgcggcgaagccagaaaaacgttcgtggagctgatgcggcgcggggatctccccgtttggcttagctataaggtggcgtccgagggctttcagtacagcgacagacggtggtgcttcgatggagaacgcaacaatcaagtcctggaggaaaacatggacgtggagatctggacaaaagaaggcgagagaaagaaactgcggcctagatggctcgacgcccgcacctattctgatcccctggcccttcgggagtttaaggagttcgccgctgggagacgctccgtcagcggagacctgattctcgagatcggcaaactgcctcagcacctgaccctccgggcccagaatgctcttgataacctggtgatgctgcacaattccgaacaagggggaaaggcctacagacatgcgatggaggaactccccgacacaatcgagaccctgatgcttctggccctcattgctgttctgacaggcggcgtgacgctgtttttcctctctgggaagggacttggcaaaaccagcatcgggctgctgtgtgtgacagcctcctctgctctcctgtggatggccagcgtcgagccgcactggattgccgcttccatcattcttgaatttttcctgatggttctcctgatccctgagcccgatcggcaacgcacccctcaggacaaccagctggcgtatgtggtgatcggactcctttttatgattctgacagtcgccgctaacgaaatgggcctgctcgagaccacgaagaaagatctggggatcggacatgtggccgccgagaatcaccaacacgctaccatgcttgacgttgatctgagacccgccagcgcgtggacactctacgccgtggctaccacagtcattacccctatgatgcggcatacgatcgaaaacacaaccgccaatatttctctgacagctatcgccaaccaggcggccattctgatgggcctcgacaagggctggcccatctccaaaatggatatcggggtgccgcttctggctctgggatgctacagccaggtcaatcctctcaccctgaccgccgctgtgcttatgctggttgcccactatgctattatcggccccgggctccaggccaaggcgacacgcgaggcccaaaagagaacggctgccggaattatgaaaaaccccaccgtggacggcatcgtcgctattgatctggaccctgtggtttacgacgccaagttcgaaaaacagctggggcagatcatgctccttatcctgtgtacatctcagattctgctcatgcggaccacatgggccctgtgcgagtccatcacccttgcgacgggaccgctgacaaccctctgggaaggcagccccggcaagttttggaataccacaattgctgtgtctatggccaacatcttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggattatggaggtcgatcggtccgaagccaaagagggactgaagagaggcgaaaccacaaaacatgcggtgtctcgcgggaccgccaaacttcggtggttcgtggagagaaatctggttaagcctgagggaaaagtcatcgacctcggctgtgggcgcggaggctggagctattactgcgctggcctgaagaaagtgacagaagtgaaggggtataccaaaggaggccccgggcacgaggaacctatccccatggccacgtacggatggaacctggtcaagctccattccggcaaagatgtgtttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtcgtggagacactggaacaaatgcagcggaagcacggcgggatgctcgttagaaacccgctgtctcgcaatagcacccacgagatgtattgggtgtcctgcggaacaggcaacattgtcagcgctgtgaacatgacctctcggatgctgctcaatagattcacgatggcccatcgcaaacctacatacgagcgggacgttgatctgggggcgggaaccagacacgtggccgtcgaacccgaggtggctaaccttgacatcattggccagcgcatcgaaaatatcaagaacgagcataaatccacctggcactatgatgaagacaatccctacaagacatgggcctatcacgggagctacgaggtgaagccttctggatccgctagctctatggtcaacggcgttgtgagactgctcacgaaaccctgggatgtgattcctatggtcacccaaatcgccatgacagacaccacaccgtttggccagcagcgggtgttcaaggagaaagttgacacccgcacacccagagctaagcgggggaccacgcagattatggaagtgaccgccaaatggctgtggggatttctttccagaaataagaagcctcggatctgtacacgcgaggagttcaccagaaaagtccggagcaacgcggccattggcgctgtgtttgttgatgagaatcaatggaactccgccaaggaagctgtggaggacgagcgcttctgggatctggtccatagagaacgggagctccacaaacaggggaagtgcgccacatgcgtgtataatatgatgggaaaacgcgaaaagaagctgggcgagtttgggaaagccaagggcagcagagcgatctggtacatgtggctgggagctcggttcctcgagttcgaggccctgggctttatgaacgaggaccattggttctctcgcgaaaatagcctttccggggttgagggagaaggcctgcacaaactcgggtacatcctgagagatatttctaagatccccggaggcaacatgtatgccgacgataccgctgggtgggacacgcggattacagaggatgaccttcagaatgaggccaaaatcaccgatattatggaacctgagcatgctctgctcgccacaagcatctttaagctgacctaccagaacaaagtggtccgcgtgcaaagacccgcgaagaacggcacggtcatggacgtgatctcccggcgcgatcagagaggatctggccaggttgggacctatggactgaatacattcaccaacatggaagtgcagctcattcggctgatggagagcgaaggcatctttcttccgtccgagctggagacacctaatctcgccgaaagagtcctggactggcttgagaagcacggggctgaacgcctgaaacggatggccatttctggagacgattgtgtggtgaagcccatcgacgatagattcgctaccgccctcacagcgctgaacgacatgggcaaagttcgcaaggatattcctcaatgggagcccagcaaagggtggaatgactggcaacaggtgcctttttgctcccaccatttccaccagctgatcatgaaggatggccgggaaatcgtcgtgccctgtagaaaccaagacgagctcgttggacgcgcccgggtgagccagggcgctgggtggtctctgagagagaccgcctgccttggaaagtcctacgctcagatgtggcaactgatgtattttcatcgccgggatctcagactggccgctaatgccatttgtagcgcggtcccggtggactgggtccctacgtctcgcacaacctggtccatccacgcccaccatcagtggatgaccacagaagatatgcttagcgtgtggaaccgggtttggattgaggaaaatccctggatggaggacaaaacccacgtgtcctcttgggaagaggtcccctacctgggcaagagagaggaccagtggtgcgggagcctcatcggactgacagctcgggccacgtgggccaccaacattcaggtggctatcaatcaagttagacgcctgattggcaacgaaaattatctcgattacatgacatccatgaaacggttcaagagcgagtctgaccctgaaggggccctgtggtga

SEQ ID NO: 18678 - RNA, 9879 nt, synthetic construct
  misc_feature 1..9879: note = derived and/or modified CDS sequence (opt5) from DENV-1__JF937635__SS-prME
  source 1..9879: mol_type = other RNA
agcgtgaccatgctgctcatgctgatgcccacagcccttgctttccacctgacgaccagaggcggggagcctcatatgatcgtctccaagcacgaacggggaaaagccctcctgtttaagacatctaccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccagacaggcgagcatagacgggacaagcgctccgtcgccctggctcctcacgtggggctgggactcgagaccagaacggaaacatggatgtctagcgagggcgcctggaaacaaattcagcgggttgaaacctgggctctgcgccatcccggcttcacagtgatcgccctttttctggcgcacgccattgggacctccatcacccagaagggaatcattttcatcctcctgatgcttgtcacaccttctatggctatgagatgcgtgggcattgggaaccgggattttgttgagggactgagcggcgccacgtgggtggacgtcgtgctcgagcacgggtcctgtgtgaccacaatggctaagaataaacccaccctggatatcgaactgctcaagacagaggtcaccaaccctgccgttctgcgcaaactttgcattgaagcgaagatcagcaatacgacaaccgactctagatgtccgacccagggagaggccacactggtggaagagcaagatgctaacttcgtgtgccggcgcacctttgtcgacagaggctggggcaatgggtgtggactcttcggcaaagggtccctgcttacatgcgccaagtttaagtgcgtgacgaaactggagggaaagattgttcagtacgaaaacctcaaatatagcgtgatcgtcaccgtgcatacaggcgatcagcaccaggttgggaatgagaccacagaacatggaaccatcgctacgattaccccccaagcccctacatctgagatccagctgaccgactacggcgccctgacactcgactgttccccccggaccggcctggatttcaacgaaatggtgcttctgacgatgaaggagaaaagctggctcgtccacaagcagtggtttctggaccttcctctgccctggacatctggggcttccaccagccaggagacatggaatcgccaagatctcctggtgaccttcaaaaccgcgcacgccaagaagcaggaagtcgtggttctgggatcccaggagggcgctatgcatacagccctcacgggggccaccgaaattcaaacatctggaaccacaaccatctttgctggccacctgaaatgcagacttaagatggacaaactgacgctcaaggggacaagctatgtgatgtgtaccggctccttcaaactggagaaggaagtcgccgagacccagcatggaacagtgctggttcaggtgaagtacgagggcaccgatgcgccgtgcaaaattcctttcagcacacaggacgaaaagggggtcacgcaaaacggacggcttatcaccgctaatcccatcgtgacagataaagagaagcctgtgaacattgaaaccgagcccccctttggcgagtcttatatcgttgtcggggccggagaaaaagccctcaagctgtcctggttcaagaaaggcagctctattgggaagatgtttgaggctacagccagaggcgctcgccggatggccatcctgggagacaccgcgtgggatttcggcagcattgggggagtgtttacgtccgtgggcaaactcgtccaccaggtgttcgggaccgcctacggagttctgttttctggcgtgagctggacaatgaagatcgggatcggcattcttctgacctggctcggactgaattccagaagcacatctctgtccatgacctgtatcgctgtcggcatggtgacactttacctcggggttatggtgcaggccgacagcggatgcgtcattaactggaaaggccgcgaactgaagtgtgggtctggaatcttcgtgaccaacgaggttcatacgtggacagaacagtataagtttcaagctgattcccctaaacggctgagcgccgcgattggcaaggcctgggaggagggggtgtgcggcatcagatccgctacccgcctcgaaaatattatgtggaaacagatctctaacgagctgaatcacatccttctggaaaacgacatgaagttcaccgtcgtggtgggagacgccaatggcattctcgctcaggggaaaaagatgatccggccgcagcccatggagcacaaatacagctggaagtcctggggaaaggccaaaattatcggcgccgatattcaaaacacaacctttatcatcgacgggcctgatacgcccgaatgtcctgacgatcagagagcttggaatatttgggaggtcgaggactatggattcggcatctttacaaccaacatttggctgaagctgcgcgattcttacacacagatgtgcgaccatcggcttatgagcgcggccatcaaagattccaaggctgttcacgccgacatgggctattggattgaaagcgagaaaaatgaaacctggaagctcgccagagcttctttcatcgaggtgaagacatgtacctggcccaaatcccatacgctgtggagcaacggggtgctggaatctgagatgatcattccgaagatctacggaggccctatttcccagcacaattatcgccccgggtacttcacccaaacagccggaccttggcacctcggcaaactggagcttgattttgacctgtgcgaagggaccacagtcgtggttgatgagcattgcggaaaccggggccccagcctcagaaccacgacagtgaccggcaagatcattcacgaatggtgttgccggtcttgtacactgcctcccctgcgcttcagaggggaggacggatgctggtacggcatggagatccggccggtcaaagaaaaggaggaaaatcttgtgagaagcatggtttccgcggggagcggagaggtggactctttttccctcggcatcctgtgtgtcagcattatgatcgaagaggtgatgcgctcccggtggtctagaaagatgctgatgaccgggaccctcgctgttttcctgcttctgattatgggacagctcacatggaacgatctgatccgcctgtgcattatggtgggcgccaatgccagcgacagaatgggcatggggacgacctatcttgctctgatggccacatttaaaatgcggcctatgttcgcggtcggaatcctctttcgcagactgacctcccgggaggtgctcctgcttacaattggcctgtctctcgtggctagcgtcgaactgcccaactccctggaggaacttggggatggactggccatgggcatcatgatgctcaagctgctcaccgagttccagccccatcaactgtggacgacacttctgtctctcacctttatcaaaaccacactgagcctggactacgcctggaagaccacagctatggccctttccattgttagcctgttccctctctgtctgtctacgacctcccagaaaacaacctggctcccggtgctgcttgggagctttggatgcaagcccctgacaatgttcctgatcaccgaaaacaagatttggggccgcaaatcttggcctatcaatgagggcattatggctatcgggatcgtgtccattctcctgagctctcttctgaagaacgatgtccccctcgccggacctctgatcgcgggcgggatgctcattgcctgttatgtgatctccggaagctccgctgacctgagccttgagaaagccgctgaagtttcttgggagcaggaagccgagcacagcggcacgtcccataatattctggtggaagtccaggatgacgggaccatgagaatcaaggatgaggagaaagacgatacactgaccatcctcctgaaggccacacttctggctgtgtctggagtttaccccatgagcattcctgcgaccctctttgtgtggtatttctggcaaaaaaagaagcagcggtccggcgtcctgtgggacacaccctctccgcctgaagtggagcgcgccgtcctcgatgacggcatctacagaattctgcagcgggggcttctgggacgcagccaggtgggcgttggggtgttccaagacggagtctttcacacgatgtggcacgtgaccagaggcgctgttctgatgtatcaggggaaacggctcgaaccctcctgggcctctgtgaagaaagatctgatcagctacggaggcggctggagattccaggggtcctggaacacaggagaggaggtccaggtgattgccgtggaacctggcaagaatcccaaaaacgttcaaaccaccccggggacatttaagacgagcgagggagaagtcggcgctatcgcccttgacttcaagcctgggacctctggatcccccattgtgaatcgcgagggcaaaatcgtgggcctgtacgggaacggagtcgtgacaaccagcggcacatatgtttctgcgatcgctcaggccaagacctcccaggaagggcctccccccgagattgaggatgaagtgtttaaaaagcggaatctcacgatcatggacctgcatcctggaagcggcaaaacaagacgctacctcccggccattgtccgggaggctatcaagagaaagctgcgcacccttattctggcccccacccgggtggttgcgtccgaaatggctgaggccctgaaagggatgcctatcagatatcaaacaaccgccgtgaagtctgaacacacaggccgcgagatcgtcgatctcatgtgccatgctaccttcacgatgcggctgcttagccccgtgagagttcctaactacaatatgattatcatggacgaggcccactttacagatcccgcttccattgccgcgcggggatatatcagcacccgcgtgggcatgggggaagccgctgccattttcatgacagctacccctccgggatctgtcgaggcctttccccagtccaacgccgtgatccaggacgaagagagagatatccctgaacggagctggaattctggctacgactggattacggatttccccgggaaaaccgtgtggtttgtccctagcatcaagtccggaaacgacattgctaattgtctgcgcaaaaacggcaagagagttatccagctctctcggaagacattcgacaccgagtatcaaaaaacaaagaacaatgattgggactacgtggtgaccacagatattagcgagatgggggcgaacttcagagccgaccgcgtcatcgatccccggagatgcctgaaaccggtgattctgaaggacggccctgaacgcgttatcctcgctggacccatgcccgtgaccgtcgcctccgccgctcagcggagaggccgcatcgggcggaatcagaacaaagagggagatcagtacgtgtatatgggccaacctcttaataacgacgaagatcatgcccactggacggaggcgaagatgctgctggacaatattaacacacccgaggggatcattcctgctctctttgaaccggagagagaaaagtctgccgccatcgatggagagtaccgcctgagaggcgaagctcggaaaaccttcgttgagcttatgcgcagaggggacctgcccgtgtggctcagctataaggtcgcctccgagggctttcagtacagcgatcggcgctggtgcttcgacggagaaagaaataaccaggtgctggaggaaaatatggacgtcgagatttggaccaaagaaggcgagcggaagaaactgagacctcgctggctcgatgcgcggacatattctgacccccttgccctgagagagtttaaggaattcgctgccgggcgccggtccgtgagcggagatctgatcctcgagatcggcaaactgcctcagcaccttaccctgagagctcaaaacgccctcgacaatctggttatgctgcataactccgaacaggggggaaaggcttaccggcacgccatggaggaactccccgatacaattgagacgcttatgctgctggcgctcatcgccgtgctgaccggcggcgtgacactttttttcctgtctgggaagggactcggcaaaaccagcattgggctgctgtgtgtcacagcttcctctgccctcctttggatggctagcgttgagccgcattggatcgccgcctccattatcctggaatttttcctgatggtgctcctgatccctgagcccgaccgccagagaacccctcaggataatcaacttgcttatgtggtcattggactgctctttatgatcctgacggtggcggccaacgaaatgggcctgctcgagaccacaaagcgggaccttgggattggacacgttgctgccgagaaccaccagcatgccaccatgctggatgtggacctgcgccccgctagcgcctggacactctacgcggtcgccaccacggtgatcacacctatgatgagacacaccattgaaaatacaaccgctaacatctctctgaccgccattgctaatcaggccgcgatccttatgggcctggataaaggctggcccatctccaagatggacattggggtcccgctcctggccctgggatgctacagccaagtgaaccctctcacacttacggctgccgttctgatgctggtggctcattatgccatcattggccccgggctccaggctaaagccacccgggaggcgcagaagcgcacagccgctggaatcatgaagaatcccaccgtcgatggcattgtggccatcgacctggaccctgttgtgtacgatgctaaattcgaaaagcagcttgggcaaatcatgctgctcattctgtgtacatctcagatcctgctcatgagaaccacgtgggccctttgcgagtccattacactggccaccggaccgctgaccacactctgggaaggcagccccggcaaattttggaacaccacaatcgcggtctctatggctaatattttccgggggagctatctggccggagctggccttgccttctccctgatgaagtctctcgggggaggccgcagagggacgggagcccagggcgagaccctgggcgagaaatggaagcggcagctgaaccaactcagcaagcctgaatttaatacatacaaaagatccgggatcatggaggtggaccgcagcgaagctaaggagggacttaaacggggcgaaaccacaaagcacgccgtgtccagagggaccgcgaaactgcgctggttcgttgagcggaacctggtcaagcccgagggaaaggtgatcgatctcggctgtgggagaggaggctggtcttattactgcgccggcctgaaaaaggtgacggaagtcaaagggtataccaagggaggccctgggcatgaggaacccattcctatggctacatacggatggaatcttgttaaactgcacagcggcaaggacgtgtttttcatgccgcccgagaaatgtgataccctcctgtgcgacatcggggaatcctctcctaaccccacaattgaggagggacgcaccctgcgggtgctcaagatggtcgaaccttggcttagaggcaatcagttttgtatcaagattctgaacccctacatgccgagcgtggttgagacactggaacagatgcagcgcaaacacggcgggatgctcgtgcggaatcctctgtccagaaactctacccatgagatgtattgggtcagctgcggaacgggcaatatcgtgtccgccgttaacatgacaagccgcatgcttctgaaccggttcaccatggctcacagaaagcccacctacgagcgcgatgtggacctcggggccggaacaagacatgtcgcggtggaacccgaggtggccaatctggatattatcggccaacggatcgaaaacattaaaaatgagcacaagtctacgtggcactatgacgaagataacccttacaaaacctgggcttatcatgggtcctacgaggtcaagcccagcggatctgcctccagcatggttaatggcgtggtgcgcctgctcacaaagccttgggacgtcatcccgatggtgacccagattgctatgacagacaccacaccctttggccagcaaagagttttcaaagagaaggtggatacccggacgcctagagccaaacgggggaccacacagatcatggaagtcaccgctaagtggctgtggggatttctttctcgcaacaaaaagcccagaatttgtacacgggaggaattcacccgcaaggtgagatccaatgccgcgatcggcgccgtttttgtggacgagaaccagtggaatagcgctaaagaagccgtcgaggatgagcggttctgggacctggtgcaccgcgaaagagagctccataagcaggggaaatgcgctacgtgcgtttataacatgatgggaaagcgggaaaaaaagctgggcgagtttgggaaggccaaaggctcccgcgccatctggtacatgtggcttggagcgagattcctggaattcgaggctctcggctttatgaatgaggatcactggttcagccgggaaaactctctgagcggggtggagggagaaggcctgcataagctcgggtacattctgcgcgacatctccaaaattcctggaggcaatatgtatgccgatgacacagccgggtgggataccagaatcacagaggacgatcttcaaaacgaggctaagattaccgacatcatggaacccgagcacgccctgctcgctacgtctatctttaaactgacctaccagaataaggtcgtgcgggtccagcgcccggccaaaaacggcacagtgatggatgttattagcagacgggaccagagaggatccggccaagtggggacctatggacttaacacattcaccaatatggaagtccagctgatccgccagatggagtctgaaggcatttttctccctagcgagctggagacacccaacctggcggaacgggtgctcgactggctggagaagcacggggccgaaagacttaagcgcatggctatctccggagatgactgtgtggttaaacctattgatgaccggttcgccaccgctctgacggccctcaatgatatgggcaaggtgagaaaagacatcccccagtgggagccttctaaggggtggaacgattggcaacaggtccccttttgcagccatcacttccatcagctgatcatgaaagacggccgcgaaattgtggttccgtgtcggaatcaggatgagcttgtgggaagagcgcgcgtctcccaaggcgccgggtggagcctgcgggagacagcttgcctcggaaagtcttacgcccagatgtggcagctgatgtattttcacagacgcgacctgcggctcgctgccaacgctatctgttccgccgtgcctgtcgattgggtgcccaccagcagaaccacatggtctattcacgcgcatcaccaatggatgaccacagaagacatgctgtccgtttggaatcgggtgtggatcgaggaaaacccctggatggaggacaagacgcatgtcagctcctgggaagaggtgccttaccttggcaaaagagaggatcagtggtgcgggtctctgattggactcaccgcccgcgctacatgggccaccaatatccaggttgccattaaccaggtgcggagactgatcggcaatgaaaactatcttgactacatgacaagcatgaagcgcttcaaaaatgagtccgatccggaaggggctctgtggtga

SEQ ID NO: 18679 - RNA, 9879 nt, synthetic construct
  misc_feature 1..9879: note = derived and/or modified CDS sequence (opt5) from DENV-1__FJ024483__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtactacacgcagaccgccggaccttggcacctgggcaaacttgagctggacttcgatctctgcgaagggacaaccgtggtcgtggacgagcactgcggaaatcgcggcccctctctgcggacaaccacggttacaggcaagattatccatgaatggtgttgcagaagctgtaccctgcctccccttcggtttcgcggggaggatggatgctggtatggcatggagatcagaccggtgaaagaaaaggaggaaaacctcgtccggtccatggtgagcgcggggtctggagaggttgactccttcagcctgggcattctgtgtgcttccatcatgattgaagaggtgatgagatctcgctggagccggaagatgctcatgacagggaccctggccgtctttcttctgctcatcatgggacaactgacctggaatgacctgattagactttgcatcatggtgggcgccaacgcttccgatcgcatgggcatggggacaacgtacctggccctcatggcgaccttcaaaatgagacctatgtttgctgttggactgctcttccggcgcctgacatctagagaggtgcttctgctcaccattggcctgagcctggtcgcctccgtggaacttcccaactctctggaggaactcggggacggactggccatgggcatcatgatgctcaagctgcttacagagtttcagccccaccagctgtggaccacgctcctgagcctgacattcatcaaaaccaccctttccctggattatgcttggaagacaaccgccatggctctcagcattgtgtctctgtttcctctctgtctgtccacaacgagccagaaaaccacatggcttccggtcctgctggggtctttcggatgcaagcccctcaccatgtttctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttacgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctatcccatgtccatccctgccacactgttcgtgtggtacttttggcagaaaaagaagcagagatctggcgttctttgggatacccccagcccgcctgaagtggagcgggctgtcctggacgatggcatttatcgcatcctgcaaagagggctcctgggacggtcccaggtgggcgtcggggtgttccaggacggagttttccatacaatgtggcacgtgacgcgcggcgccgtccttatgtaccaggggaaaagactggaaccctcttgggccagcgtgaagaaagacctcatttcctacggaggcggctggcggtttcaagggagctggaataccggagaggaggttcaggtgatcgctgtcgaacctggcaagaaccccaaaaatgtgcagacaaccccggggaccttcaagacacctgagggagaagtgggcgccattgcgctggattttaagcccgggacgtctggatcccctatcgttaacagagagggcaaaattgtcggcctctatgggaatggagtggtgaccacaagcggcacctacgtctctgctatcgcccaagccaaggcttcccaggaagggcccctgcccgagatcgaggacgaagtgttcaaaaagcgcaaccttacaattatggatctgcaccctggaagcggcaaaacccggagatatctgccggccatcgttcgcgaggcgattaagcggaagctcagaacgctgatccttgctcccacacgcgtggtcgcctccgaaatggccgaggctctgaaagggatgcctattcggtaccagaccaccgccgtgaagtctgaacatacaggcagagagatcgttgacctcatgtgccacgctacctttacaatgcgcctgctgagccccgtgcgggtccctaattataacatgatcattatggatgaggcccatttcaccgaccccgcgtccatcgccgctagaggatacattagcacgcgggtgggcatgggggaagccgctgccatctttatgacagccacccctccgggatctgttgaggctttcccccagtccaatgcggtgattcaagatgaagagcgcgacatccctgaaagaagctggaactctggctatgattggatcacagactttcccgggaaaaccgtctggttcgtgcctagcattaagtccggaaatgatatcgccaactgtctccggaaaaacggcaagcgcgtgattcagctttctagaaagacgtttgacaccgagtaccagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtatgtgtacatgggccagcctctgaacaatgatgaagaccacgctcattggacagaggccaagatgcttctggataacatcaatacccccgaggggattatccctgccctcttcgaaccggagcgggaaaagtctgctgccattgacggagagtatagactgcgcggcgaagcgagaaaaacgtttgtcgagctgatgcggcgcggggatctccccgtgtggcttagctacaaggttgcctccgagggcttccagtatagcgacagacggtggtgctttgatggagaacgcaacaatcaagtgctggaggaaaacatggacgtcgagatctggacaaaagaaggcgagagaaagaaactgcggcctagatggctcgacgctcgcacctactctgatcccctggcccttcgggagttcaaggaatttgctgccgggagacgctccgtgagcggagacctgattctcgagatcggcaaactgcctcagcacctgaccctccgggctcagaatgcccttgataacctggtcatgctgcacaattccgaacaggggggaaaggcgtatagacatgccatggaggaactccccgacacaatcgagaccctgatgcttctggctctcattgccgtgctgacaggcggcgttacgctgttctttctctctgggaagggacttggcaaaaccagcatcgggctgctgtgtgtgacagcttcctctgccctcctgtggatggccagcgtggagccgcactggattgctgcgtccatcattcttgaattctttctgatggtcctcctgatccctgagcccgatcggcaacgcacccctcaggacaaccagctggcctacgttgtgatcggactccttttcatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctatagccaggtgaatcctctcaccctgaccgctgccgtccttatgctggtggctcactacgccattatcggccccgggctccaggcgaaggccacacgcgaggctcaaaagagaacggccgctggaattatgaaaaaccccaccgttgacggcatcgtggccattgatctggaccctgtcgtgtatgacgccaagtttgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttctggaataccacaattgccgtttctatggctaacatctttcgcgggagctacctggccggagccggcctggctttctccctcatgaaatctcttgggggaggcagacgggggaccggagcccaaggcgagacactgggcgagaagtggaagcgccagctgaatcagctcagcaaatccgaattcaacacgtataagagaagcgggattatggaggtggatcggtccgaagcgaaagagggactgaagagaggcgaaaccacaaaacatgccgtctctcgcgggaccgctaagcttcggtggtttgtggagagaaatctggtgaagcctgagggaaaagttatcgacctcggctgtgggcgcggaggctggagctactattgcgccggcctgaagaaagtcacagaagtgaaggggtacaccaaaggaggccccgggcacgaggaacctatccccatggctacgtacggatggaacctggtgaagctccattccggcaaagatgtcttctttatgcctccggagaagtgtgacacccttctgtgcgatattggggaatctagccccaatcctacaatcgaggagggacggaccctgagagttctcaagatggtggaaccctggctgcgcggcaaccagttctgtattaaaatccttaatccttatatgccctccgtggtcgagacactggaacaaatgcagcggaagcacggcgggatgctcgtgagaaacccgctgtctcgcaatagcacccacgagatgtactgggtttcctgcggaacaggcaacattgtgagcgccgtcaacatgacctctcggatgctgctcaatagatttacgatggcgcatcgcaaacctacatatgagcgggacgtggatctgggggccggaaccagacacgttgctgtggaacccgaggtcgccaaccttgacatcattggccagcgcatcgaaaatatcaagaacgagcataaatccacctggcactacgatgaagacaatccctataagacatgggcttaccacgggagctatgaggtgaagccttctggatccgccagctctatggtgaacggcgtcgttagactgctcacgaaaccctgggatgtgattcctatggtgacccaaatcgctatgacagacaccacaccgttcggccagcagcgggtctttaaggagaaagtggacacccgcacacccagagccaagcgggggaccacgcagattatggaagttaccgcgaaatggctgtggggattcctttccagaaataagaagcctcggatctgtacacgcgaggaatttaccagaaaagtgcggagcaacgccgctattggcgccgtcttcgtggatgagaatcaatggaactccgctaaggaagccgttgaggacgagcgcttttgggatctggtgcatagagaacgggagctccacaaacaggggaagtgcgccacatgcgtctacaatatgatgggaaaacgcgaaaagaagctgggcgagttcgggaaagcgaagggcagcagagctatctggtacatgtggctgggagcccggtttctcgaattcgaggccctgggcttcatgaacgaggaccattggttttctcgcgaaaatagcttctccggggtggagggagaaggccttcacaaactggggtatatcctcagagatatttctaagatccccggaggcaacatgtacgctgacgataccgccgggtgggacacgcggattacagaggatgacctgcagaatgaggctaaaatcaccgatattatggaacctgagcatgcccttctggcgacaagcatctttaagctcacctatcagaacaaagttgtgcgcgtccaaagacccgccaagaacggcacggtgatggacgtcatctcccggcgcgatcagagaggatctggccaggtggggacctacggactgaatacattcaccaacatggaagttcagctgattcggcaaatggagagcgaaggcatctttctcccgtccgagctggagacacctaatcttgctgaaagagtgctggactggctcgagaagcacggggccgaacgcctgaaacggatggctatttctggagacgattgtgtcgtgaagcccatcgacgatagattcgccaccgcgcttacagccctgaacgacatgggcaaagtgcgcaaggatattcctcagtgggagcccagcaaagggtggaatgactggcagcaggttcctttttgctcccaccatttccaccaactcatcatgaaggatggccgggaaatcgtggtcccctgtagaaaccaggacgagctggtgggacgcgctcgggttagccagggcgccgggtggtctctgagagagaccgcttgcctcggaaagtcctatgcccaaatgtggcagctgatgtactttcatcgccgggatcttagactggctgccaatgcgatttgtagcgccgtgccggtcgactgggtgcctacgtctcgcacaacctggtccatccacgctcaccatcagtggatgaccacagaagatatgctcagcgtctggaaccgggtgtggattgaggaaaatccctggatggaggacaaaacccacgtttcctcttgggaagaggtgccctatctgggcaagagagaggaccagtggtgcgggagccttatcggactgacagcccgggccacgtgggctaccaacattcaagtcgccatcaatcaggtgagacgcctcattggcaacgaaaattacctggattacatgacatccatgaaacggttcaagaacgagagcgaccctgaaggggcgctgtggtga

SEQ ID NO: 18680 - RNA, 9879 nt, synthetic construct
  misc_feature 1..9879: note = derived and/or modified CDS sequence (opt5) from DENV-1__EU596504__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtttcgctgtgggcatggtcaccctctacctgggggtgatggttcaagccgactctggatgcgtgattaactggaaaggcagagaactgaagtgtgggtccggaatctttgtcacaaacgaggtgcacacctggacggaacagtataagttccaggctgatagccctaaacgcctctccgccgcgattggcaaggcctgggaggagggggtttgcggcatccggtctgctacaagactggaaaatattatgtggaaacagatcagcaacgagcttaatcatatcctgctcgaaaacgacatgaagtttaccgtggtcgtgggagacgccaatggcattctggctcaagggaaaaagatgatccgcccgcagcccatggagcacaaatactcctggaagtcttggggaaaggccaaaattatcggcgccgatattcagaacaccacattcatcatcgacgggcctgatacccccgaatgtcctgacaatcagcgggcttggaacatttgggaggtggaggattatggatttggcatcttcacgacaaatatttggctgaagcttagagacagctacacccaaatgtgcgatcaccgcctcatgtccgcggccatcaaagacagcaaggctgtccatgccgatatgggctattggattgaatctgagaaaaacgaaacatggaagctggcccgggcttccttcatcgaggttaagacctgtacatggcccaaaagccacaccctgtggtctaatggggtgctcgaatccgagatgatcattccgaagatctacggaggccctattagccagcataactatagacccgggtactttacgcagaccgccggaccttggcacctgggcaaacttgagctggacttcgatctctgcgaagggacaaccgtggtcgtggacgagcactgcggaaatcgcggcccctctctgcggacaaccacggttacaggcaagatcattcatgaatggtgttgcagaagctgtaccctgcctccccttcggtttcgcggggaggatggatgctggtacggcatggagatcagaccggtgaaagaaaaggaggaaaacctcgtccggtccatggtgagcgcggggtctggagaggttgactccttcagcctgggcatcctgtgtgcttccattatgatcgaagaggtgatgagatctcgctggagccggaagatgctcatgacagggaccctggccgtctttcttctgctcattatgggacaactgacctggaatgacctgatcagactttgcattatggtgggcgccaacgcttccgatcgcatgggcatggggacaacgtatctggccctcatggcgaccttcaaaatgagacctatgtttgctgttggactgctcttccggcgcctgacatctagagaggtgcttctgctcaccatcggcctgagcctggtcgcctccgtggaacttcccaactctctggaggaactcggggacggactggccatgggcattatgatgctcaagctgcttacagagtttcagccccaccagctgtggaccacgctcctgagcctgacattcatcaaaaccaccctttccctggattacgcttggaagacaaccgccatggctctcagcatcgtgtctctgtttcctctctgtctgtccacaacgagccagaaaaccacatggcttccggtcctgctggggtctttcggatgcaagcccctcaccatgtttctgattacagaaaataagatctggggccggaaatcctggcctcttaacgagggcattatggccatcgggattgttagcatcctgctctcttccctgctcaagaatgacgtgcccctggcgggacctcttatcgccggcgggatgctgattgcttgttatgtgatcagcggatccagcgccgatctgtctctcgagaaagctgccgaagtcagctgggagcaagaagccgagcattccggcacctctcacaacattctggtggaagttcaggacgatgggacgatgaagatcaaagacgaggagcgcgatgacacccttacaattctgctcaaggctaccctgctcgcggtgagcggagtctaccccatgtccatccctgccacactgttcgtgtggtatttctggcagaaaaagaagcagagatctggcgttctttgggatacccccagcccgcctgaagtggagcgggctgtcctggacgatggcatctaccgcattctgcaaagagggctcctgggacggtcccaggtgggcgtcggggtgtttcaggacggagttttccatacaatgtggcacgtgacgcgcggcgccgtccttatgtatcaggggaaaagactggaaccctcttgggccagcgtgaagaaagacctcatctcctacggaggcggctggcggtttcaagggagctggaataccggagaggaggttcaggtgattgctgtcgaacctggcaagaaccccaaaaatgtgcagacaaccccggggaccttcaagacacctgagggagaagtgggcgccatcgcgctggattttaagcccgggacgtctggatcccctattgttaacagagagggcaaaatcgtcggcctctacgggaatggagtggtgaccacaagcggcacctatgtctctgctattgcccaagccaaggcttcccaggaagggcccctgcccgagatcgaggacgaagtgttcaaaaagcgcaaccttacaatcatggatctgcaccctggaagcggcaaaacccggagatacctgccggccattgttcgcgaggcgatcaagcggaagctcagaacgctgattcttgctcccacacgcgtggtcgcctccgaaatggccgaggctctgaaagggatgcctatccggtatcagaccaccgccgtgaagtctgaacatacaggcagagagattgttgacctcatgtgccacgctacctttacaatgcgcctgctgagccccgtgcgggtccctaattacaacatgatcatcatggatgaggcccatttcaccgaccccgcgtccattgccgctagaggatatatcagcacgcgggtgggcatgggggaagccgctgccatttttatgacagccacccctccgggatctgttgaggctttcccccagtccaatgcggtgatccaagatgaagagcgcgacattcctgaaagaagctggaactctggctacgattggatcacagactttcccgggaaaaccgtctggttcgtgcctagcatcaagtccggaaatgatattgccaactgtctccggaaaaacggcaagcgcgtgatccagctttctagaaagacgttcgacaccgagtatcagaaaacaaagaataacgactgggattacgtcgttaccacagacattagcgagatgggggctaattttcgggccgatagagtgatcgacccccgccggtgcctgaaaccggtgattctgaaggatggccctgaaagagtcatcctcgccggacccatgcccgtgaccgttgcttccgccgcgcagcgccggggcagaattgggcgcaaccaaaataaagagggagaccagtacgtgtatatgggccagcctctgaacaatgatgaagaccacgctcattggacagaggccaagatgcttctggataacatcaatacccccgaggggatcattcctgccctcttcgaaccggagcgggaaaagtctgctgccatcgacggagagtacagactgcgcggcgaagcgagaaaaacgtttgtcgagctgatgcggcgcggggatctccccgtgtggcttagctataaggttgcctccgagggcttccagtacagcgacagacggtggtgctttgatggagaacgcaacaatcaagtgctggaggaaaacatggacgtcgagatttggacaaaagaaggcgagagaaagaaactgcggcctagatggctcgacgctcgcacctattctgatcccctggcccttcgggagttcaaggaatttgctgccgggagacgctccgtgagcggagacctgatcctcgagattggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcatcgccgtgctgacaggcggcgttacgctgttctttctctctgggaagggacttggcaaaaccagcattgggctgctgtgtgtgacagcttcctctgccctcctgtggatggccagcgtggagccgcactggatcgctgcgtccattatccttgaattctttctgatggtcctcctgattcctgagcccgatcggcaacgcacccctcaggacaaccagctggcctatgttgtgatcggactccttttcatgatcctgacagtggctgccaacgaaatgggcctgctcgagaccacgaagaaagatctggggattggacatgtcgccgctgagaatcaccaacacgccaccatgcttgacgtggatctgagacccgcgagcgcctggacactctacgctgttgccaccacagtgatcacccctatgatgcggcatacgattgaaaacacaaccgctaatatctctctgacagccattgcgaaccaggccgctatcctgatgggcctcgacaagggctggcccatttccaaaatggatatcggggtcccgcttctggccctgggatgctacagccaggtgaatcctctcaccctgaccgctgccgtccttatgctggtggctcactatgccatcattggccccgggctccaggcgaaggccacacgcgaggctcaaaagagaacggccgctggaatcatgaaaaaccccaccgttgacggcattgtggccatcgatctggaccctgtcgtgtacgacgccaagtttgaaaaacagctggggcagattatgctccttatcctgtgtacatctcagatcctgctcatgcggaccacatgggcgctgtgcgagtccattacccttgctacgggaccgctgacaaccctctgggaaggcagccccggcaagttctggaataccacaatcgccgtttctatggctaacattttccgcgggagctatctggccggagccggcctggctttttccctcatgaaatctcttgggggaggcagacgggggaccggagcccaaggcgagacactgggcgagaagtggaagcgccagctgaatcagctcagcaaatccgaattcaacacgtacaagagaagcgggatcatggaggtggatcggtccgaagcgaaagagggactgaagagaggcgaaaccacaaaacatgccgtctctcgcgggaccgctaagcttcggtggtttgtggagagaaatctggtgaagcctgagggaaaagttattgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctctactccggcaaagatgtcttctttatgcctccggagaagtgtgacacccttctgtgcgatatcggggaatctagccccaatcctacaattgaggagggacggaccctgagaatcctcaagatggttgaaccctggctgcgcggcaaccagttctgtattaaaatccttaatccttatatgccctccgtggtggagacactggaacaaatgcagcggaagcatggcgggatgctcgtcagaaacccgctgtctcgcaatagcacccacgagatgtactgggtgtcctgcggaacaggcaacattgttagcgccgtgaacatgacctctcggatgctgctcaatagatttacgatggcgcaccgcaaacctacatatgagcgggacgtcgatctgggggccggaaccagacatgtggctgttgaacccgaggtggccaaccttgacatcattggccagcgcatcgaaaatatcaagaacgagcacaaatccacctggcattacgatgaagacaatccctataagacatgggcttaccacgggagctatgaggtcaagccttctggatccgccagctctatggtgaacggcgtggtcagactgctcacgaaaccctgggatgttattcctatggtgacccaaatcgctatgacagacaccacaccgttcggccagcagcgggtgtttaaggagaaagtcgacacccgcacacccagagccaagcgggggaccacgcagattatggaagtgaccgcgaaatggctgtggggattcctttccagaaataagaagcctcggatctgtacacgcgaggaatttaccagaaaagttcggagcaacgccgctattggcgccgtgttcgtcgatgagaatcaatggaactccgctaaggaagccgtggaggacgagcgcttttgggatctggttcacagagaacgggagctccataaacaggggaagtgcgccacatgcgtgtacaatatgatgggaaaacgcgaaaagaagctgggcgagttcgggaaagcgaagggcagcagagctatctggtacatgtggctgggagcccggttcctcgaatttgaggccctgggcttcatgaacgaggaccactggttttctcgcgaaaatagcctttccggggtcgagggagaaggcctgcataaactcgggtatatcctgagagatatttctaagatccccggaggcaacatgtacgctgacgataccgccgggtgggacacgcggattacagaggatgaccttcagaatgaggctaaaatcaccgatattatggaacctgagcacgccctgctcgcgacaagcatcttcaagctgacctatcagaacaaagtggttcgcgtgcaaagacccgccaagaacggcacggtcatggacgtgatctcccggcgcgatcagagaggatctggccaggtcgggacctacggactgaatacatttaccaacatggaagtgcagctcattcggcaaatggagagcgaaggcatcttcctgccgtccgagcttgagacacctaatctggctgaaagagttctcgactggctggagaagcatggggccgaacgccttaaacggatggctatttctggagacgattgtgtggtcaagcccatcgacgatagatttgccaccgcgctgacagccctcaacgacatgggcaaagtgcgcaaggatattcctcagtgggagcccagcaaagggtggaatgactggcagcaggtgcctttctgctcccaccactttcatcaactgatcatgaaggatggccgggaaatcgttgtgccctgtagaaaccaggacgagctggtcggacgcgctcgggtgagccagggcgccgggtggtctctcagagagaccgcttgcctgggaaagtcctatgcccaaatgtggcagcttatgtacttccaccgccgggatctgagactcgctgccaatgcgatttgtagcgccgttccggtggactgggtccctacgtctcgcacaacctggtccatccatgctcaccaccagtggatgaccacagaagatatgctgagcgtgtggaaccgggtctggattgaggaaaatccctggatggaggacaaaacccatgtgtcctcttgggaagaggttccctatcttggcaagagagaggaccagtggtgcgggagcctgatcggactcacagcccgggccacgtgggctaccaacattcaagtggccatcaatcaggtcagacgcctgattggcaacgaaaattacctggattacatgacatccatgaaacggtttaagaacgagagcgaccctgaaggggcgctctggtga

SEQ ID NO: 18681 - RNA, 9879 nt, synthetic construct
  misc_feature 1..9879: note = derived and/or modified CDS sequence (opt5) from DENV-1__FJ024481__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctctactccggcaaagatgtctttttcatgcctccggagaagtgtgacacccttctgtgcgatattggggaatctagccccaatcctacaatcgaggagggacggaccctgagaattctcaagatggttgaaccctggctgcgcggcaaccagttttgtatcaaaattcttaatccttatatgccctccgtggtggagacactggaacaaatgcagcggaagcatggcgggatgctcgtcagaaacccgctgtctcgcaatagcacccacgagatgtactgggtgtcctgcggaacaggcaacatcgttagcgccgtgaacatgacctctcggatgctgctcaatagattcacgatggcgcaccgcaaacctacatatgagcgggacgtcgatctgggggccggaaccagacatgtggctgttgaacccgaggtggccaaccttgacattatcggccagcgcatcgaaaatattaagaacgagcacaaatccacctggcattacgatgaagacaatccctataagacatgggcttaccacgggagctatgaggtcaagccttctggatccgccagctctatggtgaacggcgtggtcagactgctcacgaaaccctgggatgttatccctatggtgacccaaattgctatgacagacaccacaccgtttggccagcagcgggtgttcaaggagaaagtcgacacccgcacacccagagccaagcgggggaccacgcagatcatggaagtgaccgcgaaatggctgtggggatttctttccagaaataagaagcctcggatttgtacacgcgaggaattcaccagaaaagttcggagcaacgccgctatcggcgccgtgtttgtcgatgagaatcaatggaactccgctaaggaagccgtggaggacgagcgcttctgggatctggttcacagagaacgggagctccataaacaggggaagtgcgccacatgcgtgtacaatatgatgggaaaacgcgaaaagaagctgggcgagtttgggaaagcgaagggcagcagagctatctggtacatgtggctgggagcccggttcctcgaattcgaggccctgggctttatgaacgaggaccactggttctctcgcgaaaatagcctttccggggtcgagggagaaggcctgcataaactcgggtatattctgagagatatctctaagattcccggaggcaacatgtacgctgacgataccgccgggtgggacacgcggatcacagaggatgaccttcagaatgaggctaaaattaccgatatcatggaacctgagcacgccctgctcgcgacaagcatctttaagctgacctatcagaacaaagtggttcgcgtgcaaagacccgccaagaacggcacggtcatggacgtgatttcccggcgcgatcagagaggatctggccaggtcgggacctacggactgaatacattcaccaacatggaagtgcagctcatccggcaaatggagagcgaaggcatttttctgccgtccgagcttgagacacctaatctggctgaaagagttctcgactggctggagaagcatggggccgaacgccttaaacggatggctatctctggagacgattgtgtggtcaagcccattgacgatagattcgccaccgcgctgacagccctcaacgacatgggcaaagtgcgcaaggatatccctcagtgggagcccagcaaagggtggaatgactggcagcaggtgcctttttgctcccaccacttccatcaactgatcatgaaggatggccgggaaattgttgtgccctgtagaaaccaggacgagctggtcggacgcgctcgggtgagccagggcgccgggtggtctctcagagagaccgcttgcctgggaaagtcctatgcccaaatgtggcagcttatgtactttcaccgccgggatctgagactcgctgccaatgcgatctgtagcgccgttccggtggactgggtccctacgtctcgcacaacctggtccattcatgctcaccaccagtggatgaccacagaagatatgctgagcgtgtggaaccgggtctggatcgaggaaaatccctggatggaggacaaaacccatgtgtcctcttgggaagaggttccctatcttggcaagagagaggaccagtggtgcgggagcctgattggactcacagcccgggccacgtgggctaccaacatccaagtggccattaatcaggtcagacgcctgatcggcaacgaaaattacctggattacatgacatccatgaaacggttcaagaacgagagcgaccctgaaggggcgctctggtga

SEQ ID NO: 18682 - RNA, 9879 nt, synthetic construct
  misc_feature 1..9879: note = derived and/or modified CDS sequence (opt5) from DENV-1__GQ199872__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagagcgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggaattcgctgccgggagacgctccgtgagcggagacctgattctcgagatcggcaaactgcctcagcacctgaccctccgggctcagaatgcccttgataacctggtcatgctgcacaattccgaacaggggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtttctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggtggatcggtccgaagcgaaagagggactgaagagaggcgaaaccacaaaacatgccgtctctcgcgggaccgctaagcttcggtggttcgtggagagaaatctggtgaagcctgagggaaaagttatcgacctcggctgtgggcgcggaggctggagctattactgcgccggcctgaagaaagtcacagaagtgaaggggtataccaaaggaggccccgggcacgaggaacctatccccatggctacgtacggatggaacctggtgaagctccattccggcaaagatgtctttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtggtcgagacactggaacaaatgcagcggaagcacggcgggatgctcgtgagaaacccgctgtctcgcaatagcacccacgagatgtattgggtttcctgcggaacaggcaacattgtgagcgccgtcaacatgacctctcggatgctgctcaatagattcacgatggcgcatcgcaaacctacatacgagcgggacgtggatctgggggccggaaccagacacgttgctgtggaacccgaggtcgccaaccttgacatcattggccagcgcatcgaaaatatcaagaacgagcataaatccacctggcactatgatgaagacaatccctacaagacatgggcttatcacgggagctacgaggtgaagccttctggatccgccagctctatggtgaacggcgtcgttagactgctcacgaaaccctgggatgtgattcctatggtgacccaaatcgctatgacagacaccacaccgtttggccagcagcgggtcttcaaggagaaagtggacacccgcacacccagagccaagcgggggaccacgcagattatggaagttaccgcgaaatggctgtggggatttctttccagaaataagaagcctcggatctgtacacgcgaggaattcaccagaaaagtgcggagcaacgccgctattggcgccgtctttgtggatgagaatcaatggaactccgctaaggaagccgttgaggacgagcgcttctgggatctggtgcatagagaacgggagctccacaaacaggggaagtgcgccacatgcgtctataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtggagggagaaggcctgcacaaactcgggtacatcctgagagatatttctaagatccccggaggcaacatgtatgctgacgataccgccgggtgggacacgcggattacagaggatgaccttcagaatgaggctaaaatcaccgatattatggaacctgagcatgccctgctcgcgacaagcatctttaagctgacctaccagaacaaagttgtgcgcgtccaaagacccgccaagaacggcacggtgatggacgtcatctcccggcgcgatcagagaggatctggccaggtggggacctatggactgaatacattcaccaacatggaagttcagctcattcggcaaatggagagcgaaggcatctttctgccgtccgagcttgagacacctaatctggctgaaagagtgctcgactggctggagaagcacggggccgaacgccttaaacggatggctatttctggagacgattgtgtcgtgaagcccatcgacgatagattcgccaccgcgctgacagccctcaacgacatgggcaaagtgcgcaaggatattcctcagtgggagcccagcaaagggtggaatgactggcagcaggttcctttttgctcccaccatttccaccaactgatcatgaaggatggccgggaaatcgtggtcccctgtagaaaccaggacgagctggtgggacgcgctcgggttagccagggcgccgggtggtctctcagagagaccgcttgcctgggaaagtcctacgcccaaatgtggcagcttatgtattttcatcgccgggatctgagactcgctgccaatgcgatttgtagcgccgtgccggtcgactgggtgcctacgtctcgcacaacctggtccatccacgctcaccatcagtggatgaccacagaagatatgctgagcgtctggaaccgggtgtggattgaggaaaatccctggatggaggacaaaacccacgtttcctcttgggaagaggtgccctaccttggcaagagagaggaccagtggtgcgggagcctgatcggactcacagcccgggccacgtgggctaccaacattcaagtcgccatcaatcaggtgagacgcctgattggcaacgaaaattatctggatcatatgacatccatgaaacggttcaagaacgagagcgaccctgaaggggcgctctggtga

SEQ ID NO: 18683 - RNA, 9879 nt, synthetic construct
  misc_feature 1..9879: note = derived and/or modified CDS sequence (opt5) from DENV-1__FJ410290__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagagaagcggtctgtcgccctggctcctcatgtggggctcggactggaaacacgcaccgagacgtggatgagctccgaaggcgcctggaaacagattcagagagttgagacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagactttgttgagggactctccggcgccacatgggtggatgtcgtgctggaacacgggagctgtgtgacgaccatggctaagaataaacccacactggacatcgagctcctgaagaccgaagtcacatctcctgccattcttcggaaactgtgcatcgaggcgaagatttccaacaccacgacagatagccgctgtccgacccagggagaagccaccctcgttgaggagcaggacgctaatttcgtgtgcagacggacatttgtggatcgcggctggggcaacgggtgtggactgttcggcaaagggtctcttctgacctgcgccaagtttaagtgcgtcacaaaactcgaaggaaagatcgtgcagtacgagaatctgaaatattccgttatcgtgacggtccacaccggcgaccaacatcaggtggggaacgaaacaaccgagcacggaacaattgctaccatcacgccccaggcccctaccagcgaaattcagctgacagattacggcgccctcaccctggactgttctcccagaacaggccttgacttcaatgagatggttctgctcaccatgaaggagaaatcctggctggtgcataagcaatggtttcttgatctgcctctcccctggacgagcggggcttccacatctcaggaaacctggaaccggcaggacctgctggtcacattcaaaaccgcgcacgccaagaagcaagaggtggtcgtgctcggaagccaggaaggcgctatgcacaccgccctgacaggggccacggagatccagacctccggaacaaccacaatttttgctggccatcttaaatgccgcctgaagatggataaactcaccctgaaggggacgagctatgttatgtgtacaggctctttcaaactggaaaaggaggtggccgagacccagcacggaaccgtccttgtgcaagttaagtacgaaggcacagacgcgccgtgcaaaatccctttctccacccaggatgagaagggggtgacacagaatggaagactcatcacggctaaccccattgtcaccgacaaagaaaagcctgtgaatatcgagacagagcccccctttggcgaaagctatattgtggttggggccggagagaaagccctgaagctgtcttggttcaagaaaggcagctccatcgggaagatgtttgaagctaccgcccggggcgctagacgcatggccattctcggagatacagcgtgggacttcggctctatcgggggagtctttaccagcgtgggcaaactggtgcatcaggtcttcgggacggcctacggagtgcttttttccggcgttagctggaccatgaagatcgggattggcatcctgctcacatggctgggactgaactctcggtccaccagcctttctatgacatgtattgctgtgggcatggtcaccctctacctgggggtgatggttcaagccgattccggatgcgtgatcaattggaaaggcagagagctgaagtgtgggagcggaattttcgtcacaaacgaagtgcacacctggacggagcagtataagtttcaggctgactcccctaaacgcctctctgccgcgatcggcaaggcctgggaggaaggggtttgcggcattcggagcgctacaagactggagaacatcatgtggaaacagatctccaatgaacttaaccatattctgctcgagaatgatatgaagttcaccgtggtcgtgggagacgccaacggcatcctggctcaagggaaaaagatgattcgcccgcagcccatggaacacaaatactcttggaagagctggggaaaggccaaaatcattggcgccgacatccagaataccacatttatcattgatgggcctgacacccccgagtgtcctgataaccagcgggcttggaatatctgggaggtggaagactatggattcggcatttttacgacaaacatctggctgaagcttagagattcctacacccaaatgtgcgaccaccgcctcatgagcgcggccattaaagattctaaggctgtccatgccgacatgggctattggatcgagtccgaaaaaaatgagacatggaagctggcccgggctagcttcatcgaagttaagacctgtacatggcccaaatctcacaccctgtggtccaacggggtgctcgagagcgagatgattatcccgaagatttacggaggccctatctctcagcataattatagacccgggtacttcacgcagaccgccggaccttggcacctgggcaaacttgaactggattttgacctctgcgaggggacaaccgtggtcgtggatgaacactgcggaaaccgcggccccagcctgcggacaaccacggttacaggcaagattatccatgagtggtgttgcagatcctgtaccctgcctccccttcggttccgcggggaggacggatgctggtacggcatggaaatcagaccggtgaaagagaaggaagagaatctcgtccggagcatggtgtctgcggggtccggagaagttgatagcttttccctgggcattctgtgtgtgtctatcatgattgaggaggtcatgagaagccgctggtcccggaagatgctcatgacagggaccctggtggttttccttctgctcatcatgggacaactgacctggaaagacctgattagactttgcatcatggtgggcgctaacgcctctgaccgcatgggcatggggacaacgtatctggccctcatggctacctttaagatgagacctatgttcgccgtcggactgctctttcggcgcctgacaagcagagaagtgcttctgctcaccattggcctgtccctggtggcgtctgtcgagcttcccaatagcctggaagagctcggggatggactggctatgggcatcatgatgctcaaactgcttacagaattccagccccaccagctgtggaccacgctcctgtccctgacatttatcaagaccacccttagcctggactacgcctggaaaacaaccgccatggctctctctattgtttccctgttccctctctgtctgagcacaacgtctcagaagaccacatggcttccggtgctgctggggtcctttggatgcaagcccctcaccatgttcctgatcacagagaacaaaatttggggccggaagagctggcctcttaacgagggcatcatggccattgggatcgtgtctatcctgctctccagcctgctcaaaaatgatgtccccctggctggacctcttattgccggcgggatgctgatcgcgtgttatgtgatttccggaagctctgccgacctgagcctcgaaaaggctgccgaggtttcctgggaacaagaggctgaacattctggcaccagccacaacatcctggtggaggtccaggatgacgggacgatgaaaattaaggatgaggaacgcgacgatacccttacaatcctgctcaaagccaccctgctcgccgtgtccggagtttaccccatgtctatccctgctacactgtttgtgtggtatttctggcagaagaagaaacagagaagcggcgtcctttgggacaccccctccccgcctgaggtggaacgggcggtcctggatgacggcatttaccgcatcctgcaaagagggctcctgggacggtctcaggtgggcgttggggtgttccaggatggagtctttcatacaatgtggcacgtgacgcgcggcgccgttcttatgtatcaggggaagagactggagcccagctgggcttccgtgaaaaaggacctcattagctacggaggcggctggcggttccaagggtcttggaataccggagaggaagtccaggtgatcgccgtggagcctggcaaaaaccccaagaatgttcagacaaccccggggacctttaagacacctgaaggagaggtcggcgccattgctctggacttcaaacccgggacgtccggaagccctatcgtgaacagagaaggcaagattgtgggcctctacgggaatggagtcgtgaccacatctggcacctatgtttccgccatcgcgcaagctaaagccagccaggaggggcccctgcccgagatcgaagatgaggtgtttaagaaacgcaaccttacaattatggacctgcaccctggatccggcaagacccggagatacctgccggccatcgtccgcgaagctattaagcggaaactcagaacgctgatccttgcccccacacgcgtggttgcgtctgagatggctgaagccctgaaggggatgcctattcggtatcagaccaccgccgtgaaaagcgagcatacaggcagagagatcgtcgatctcatgtgccacgctaccttcacaatgcgcctgctgtcccccgtgcgggttcctaattacaacatgatcattatggacgaagcccattttaccgatcccgctagcatcgccgcgagaggatatatttctacgcgggtgggcatgggggaggccgctgccatcttcatgacagctacccctccgggatccgtcgaagcctttccccagagcaatgccgtgattcaagacgaggaacgcgatatccctgagagatcttggaacagcggctacgactggatcacagatttccccgggaagaccgtgtggtttgtcccttccattaaatctggaaatgacatcgctaactgtctccggaagaatggcaagcgcgttattcagcttagcagaaaaacgttcgataccgagtatcagaagacaaaaaacaacgactgggactacgtggtgaccacagatatctccgaaatgggggcgaatttccgggccgacagagtcattgatccccgccggtgcctgaagccggtgatcctgaaagacggccctgagagagttattctcgctggacccatgcccgtgaccgtcgcctctgccgctcagcgccggggcagaatcgggcgcaaccaaaataaggaaggagatcagtacgtgtatatgggccagcctctgaacaatgacgaggatcacgcccattggacagaggcgaagatgcttctggacaacatcaatacccccgaagggattatccctgctctctttgagccggaacgggagaaaagcgccgccattgatggagaatacagactgcgcggcgaggctagaaagacgttcgttgagctgatgcggcgcggggacctccccgtgtggctttcctataaagtcgccagcgaaggctttcagtactctgatagacggtggtgcttcgacggagagcgcaacaatcaagtgctggaagagaacatggatgtcgaaatctggacaaaggagggcgagagaaaaaagctgcggcctagatggctcgacgcgcgcacctattccgaccccctggcccttcgggaatttaaagagttcgctgccgggagacgcagcgtgtccggagatctgattctcgaaatcggcaagctgcctcagcacctgaccctccgggctcagaatgcccttgacaacctggttatgctgcacaattctgagcaggggggaaaggcttacagacatgccatggaagagctccccgatacaatcgagaccctgatgcttctggcgctcattgccgtgctgacaggcggcgtgacgctgtttttcctcagcgggaaaggacttggcaagacctccatcgggctgctgtgtgtcacagcttctagcgccctcctgtggatggcttccgttgaaccgcactggattgccgccagcatcattcttgagtttttcctgatggtgctcctgatccctgaacccgaccggcaacgcacccctcaggataaccagctggcttatgtggtcatcggactcctttttatgattctgacagtggcggccaatgagatgggcctgctcgagaccacgaaaaaggacctggggatcggacatgttgctgccgaaaaccaccaacacgccaccatgcttgatgtggacctgagacccgcttctgcctggacactctacgcggtcgccaccacagtgattacccctatgatgcggcatacgatcgagaacacaaccgctaatatttccctgacagccatcgctaaccaggccgcgattctgatgggcctcgataaaggctggcccatcagcaagatggacatcggggtcccgcttctggccctgggatgctactctcaggtgaatcctctcaccctgaccgctgccgttcttatgctggtggctcactatgccattatcggccccgggctccaggctaaggccacacgcgaagcgcaaaaaagaacggccgctggaattatgaagaaccccaccgtcgatggcatcgtggccattgacctggatcctgttgtgtacgacgctaaattcgagaagcagctggggcagatcatgctccttatcctgtgtacatcccagattctgctcatgcggaccacatgggccctgtgcgaaagcatcacccttgccacgggaccgctgacaaccctctgggagggctctcccggcaaattttggaataccacaattgcggtcagcatggctaacatcttccgcgggtcctatctggccggagctggcctggccttctctctcatgaagagccttgggggaggcagacgggggaccggagcccaaggcgagacactgggcgaaaagtggaaacgccagctgaatcagctctccaagagcgagtttaacacgtacaaaagatccgggattatggaagtggaccggttcgaggctaaggaaggactgaaaagaggcgagaccacaaagcatgccgtgtctcgcgggaccgcgaagcttcggtggtttgttgagagaaatctggtcaaacctgaaggaaaggtgatcgatctcggctgtgggcgcggaggctggagctattactgcgccggcctgaaaaaggtgacagaggtcaaagggtataccaagggaggccccgggcacgaagagcctatccccatggctacgtacggatggaacctggttaaactccattccggcaaggacgtgttctttatgcctccggaaaagtgtgatacccttctgtgcgacattggggagtctagccccaatcctacaatcgaggaaggacggaccctgagagtgctcaaaatggtcgagccctggctgcgcggcaaccagttctgtattaagatccttaatccttacatgccctccgtggttgaaacactggagcaaatgcagcggaaacacggcgggatgctcgtgagaaacccgctgtctcgcaatagcacccacgagatgtattgggtctcctgcggaacaggcaacattgtgagcgccgttaatatgacctctcggatgctgctcaacagatttacgatggctcatcgcaagcctacatacgaacgggatgtggacctgggggccggaaccagacacgtcgcggtggagcccgaagtggccaaccttgatatcattggccagcgcatcgagaatatcaaaaacgaacataagtccacctggcactatgacgaggataatccctacaagacatgggcttatcacgggagctacgaggtcaaaccttctggatccgccagctctatggttaacggcgtggtgaagctgctcacgaaaccctgggacgtcattcctatggtgacccaaatcgctatgacagataccacaccgttcggccagcagagagtttttaaggaaaaagtggacacccggacaccccgcgccaagagagggaccacgcagattatggaggtcaccgctaagtggctgtggggattcctttcccggaataaaaagcctagaatctgtacacgggaagagtttacccgcaaagtgagaagcaacgccgcgattggcgccgttttcgtggacgaaaatcaatggaactccgctaaggaggccgtcgaggatgaacggttttgggacctggtgcatcgcgagagagaactccacaaacaggggaagtgcgctacatgcgtttataatatgatgggaaagcgggagaaaaagctgggcgaattcgggaaagccaagggcagccgcgccatctggtacatgtggctgggagcgagattcctcgagtttgaggctctgggcttcatgaacgaagatcattggttttctcgggagaatagcctttccggggtggaaggagagggcctgcacaaactcgggtacatcctgcgcgacatttctaagatccccggaggcaacatgtatgccgatgacaccgccgggtgggatacgagaattacagaggacgatcttcagaatgaagctaaaatcaccgacattatggagcctgaacatgccctgctcgctacaagcatcttcaagctgacctaccagaacaaggtcgtgcgggtccaacgccccgccaaaaatggcacggtgatggatgttatctccagacgggaccagcgcggatctggccaggtggggacctatggactgaacacatttaccaacatggaggtccagctcattagacaaatggaaagcgagggcatcttcctgccgtccgagcttgaaacacctaatctggcggagcgggtgctcgattggctggggaagcacggagccgaaagacttaaacgcatggctatttctggcgacgactgtgtggttaagcccatcgatgaccggtttgccaccgctctgacagccctcaacgatatggggaaagtgagaaaggacattcctcagtgggagcccagcaagggctggaatgattggcagcaggtccctttctgctcccaccattttcaccaactgatcatgaaagacggacgcgaaatcgtggttccctgtcggaaccaggatgagctggtgggcagagcgcgcgtcagccagggggccggatggtctctccgggagaccgcttgcctgggcaagtcctacgcccaaatgtggcagcttatgtatttccatagacgcgacctgcggctcgctacgaatgccaaatgtagcgctgtgccggtcgattgggtgcctacatctagaaccacctggtccattcacgcccaccatcagtggatgacaaccgaagacatgctgagcgtttggaaccgcgtgtggatcgaggaaaatccctggatggaggataagacacacgtctcctcttgggaagaggtgccctaccttgggaaacgggaggaccagtggtgcggaagcctgattggcctcacggcgagagccacctgggctacaaacatccaagttgccattaatcaggtgcggagactgatcgggaacgaaaattatctggactacatgacctccatgcgccggtttaagaacgagagcgatcctgaaggcgccctctggtga

SEQ ID NO: 18684 - RNA, 9879 nt, synthetic construct
  misc_feature 1..9879: note = derived and/or modified CDS sequence (opt5) from DENV-1__FJ024423__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtggtcgcctttttcctggcgcatgccatcgggacatctattacccaaaagggaatcatctttattctcctgatgcttgtgacccctagcatggctatgcgctgcgttggcatcgggaacagagatttcgtggagggactgtccggcgccacatgggtcgacgtggtgctcgagcacgggagctgtgtcacgaccatggctaagaataaacccacactggatattgaactgctcaagaccgaggttacaaaccctgccatcctgcggaaactttgcattgaagcgaagatctctaataccacgacagactcccgctgtccgacccagggagaggccaccctggtggaagagcaggatgctaactttgtgtgcagacggacattcgtcgaccgcggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcaacatcaggttgggaatgagacaaccgaacacggaacaatcgctattatcaccccccaggcccctacgtccgagattcagctgaccgactacggcgccctgacactcgactgtagccccagaaccggcctggattttaacgaaatggtgcttctgacaatgaaggagaaatcttggctcgtccataagcaatggttcctggaccttcctctgccctggacctccggggctagcacgtcccaggagacatggaatcggcaggatctcctggtgacctttaaaacagcgcacgccaagaagcaagaagtcgtggttctgggatctcaggagggcgctatgcacaccgccctcaccggggccacagaaatccagacgagcggaaccacaaccattttcgctggccatctgaaatgccgccttaagatggacaaactgacactcaaggggacctcctatgtgatgtgtacgggcagcttcaaactggagaaggaagtcgccgagacacagcacggaaccgtgctggttcaagtgaagtacgagggcaccgatgcgccgtgcaaaatccctttttctacacaggacgaaaagggggtcacccagaacggaagacttatcacagctaatcccattgtgacggataaagagaagcctgtgaacatcgaaaccgagccccccttcggcgagtcctatattgttatcggggccggagaaaaagccctcaagctgagctggtttaagaaaggctctagcattgggaagatgttcgaggctacagcccggggcgctagacgcatggccatcctgggagacaccgcgtgggattttggctccatcgggggagtcttcacatctgtgggcaaactcgtgcatcaggtctttgggaccgcctacggagtgctgttcagcggcgtttcctggacgatgaagattgggatcggcattcttctgacctggctcggactgaatagccggtctacatccctgagcatgacctgtatcgctgtgggcatggtcacactttacctcggggtgatggttcaagccgactctggatgcgtgattaactggaaaggcagagaactgaagtgtgggtccggaatctttgtcaccaacgaggtgcacacatggaccgaacagtataagttccaggctgatagccctaaacgcctgtccgccgcgattggcaaggcctgggaggagggggtttgcggcatccggtctgctacgagactcgaaaatatcatgtggaaacagattagcaacgagctgaatcatatccttctggaaaacgacatgaagtttacagtggtcgtgggagacgccaatggcattctcgctcaagggaaaaagatgatccgcccgcagcccatggagcacaaatactcctggaagtcttggggaaaggccaaaattatcggcgccgatatccagaacaccaccttcattatcgacgggcctgatacacccgaatgtcctgacgatcagcgggcttggaatatttgggaggtggaggactatggatttggcatcttcaccacgaacatttggctgaagctgagagatagctacacacaaatgtgcgaccaccgccttatgtccgcggccatcaaagatagcaaggctgtccatgccgacatgggctattggatcgaatctgagaaaaatgaaacctggaagctcgcccgggcttccttcattgaggttaagacatgtacctggcccaaaagccacacactgtggtctaacggggtgctggaatccgagatgatcattccgaagatctacggaggccctattagccagcataattatagacccgggtactttacccagacggccggaccttggcacctcggcaaactggagcttgatttcgacctgtgcgaagggaccacagtggtcgtggatgagcactgcggaaaccgcggcccctctctccggaccacaaccgttacgggcaagatcatccatgaatggtgttgcagaagctgtacactgcctcccctgcggtttcgcggggaggacggatgctggtacggcatggagattagaccggtgaaagaaaaggaggaaaatcttgtccggtccatggtgagcgcggggtctggagaggttgactccttcagcctcggcatcctgtgtgcttccattatgatcgaagaggtgatgagatctcgctggagccggaagatgctgatgaccgggacactcgccgtctttctgcttctgattatgggacaactcacctggaacgatctgatcagactgtgcattatggtgggcgccaatgcttccgaccgcatgggcatggggaccacatatcttgccctgatggcgacgttcaaaatgagacctatgtttgctgttggactcctgttccggcgcctcacctctagagaggtgctgcttctgacaatcggcctcagcctggtcgcctccgtggaactgcccaactctcttgaggaactgggggatggactcgccatgggcatcatgatgctgaagctcctgaccgagtttcagccccaccagctttggacaaccctgctcagcctgacgttcattaaaacaaccctgtcccttgactacgcttggaagaccacagccatggctctgagcatcgtgtctctctttcctctgtgtctctccaccacaagccagaaaacgacctggctgccggtccttctggggtctttcggatgcaagcccctgacaatgtttctcattaccgaaaacaagatctggggccggaaatcctggcctctgaatgagggcattatggccatcgggatcgttagcattcttctgtcttccctcctgaagaacgatgtgcccctcgcgggacctctgatcgccggcgggatgcttattgcttgttatgtgatcagcggatccagcgccgacctgtctctggagaaagctgccgaagtcagctgggagcaagaagccgagcattccggcacatctcacaatattctcgtggaagttcaggatgacgggaccatgaagatcaaagatgaggagaaggacgatacgctgaccatccttctgaaagctacactcctggcggtgagcggagtctaccccatgtccattcctgccaccctcttcgtgtggtatttctggcagaagaagaaacagcgctctggcgttctgtgggacacacccagcccgcctgaagtggagagagctgtccttgatgacggcatctaccggattctgcaacgcgggctgctcggaagatcccaggtgggcgtcggggtgtttcaggacggagttttccataccatgtggcacgtgacacggggcgccgtcctgatgtatcaggggaagcgccttgaaccctcttgggccagcgtgaaaaaggatctgatctcctacggaggcggctggagatttcaagggagctggaacacgggagaggaggttcaggtgattgctgtcgaacctggcaaaaatcccaagaacgtgcagaccacaccggggaccttcaagacccctgagggagaagtgggcgccatcgcgctcgactttaaacccgggacatctggatcccctattgttaatcgggagggcaagatcgtcggcctgtacgggaacggagtggtgacgaccagcggcacatatgtctctgctatcgcccaagccaaagcttcccaggaagggcccctccccgagattgaggatgaagtgttcaagaaaagaaatctgaccatcatggaccttcaccctggaagcggcaagacacgccggtacctgccggccattgttagagaggcgatcaagcgcaaactgcggaccctcattctggctcccacgagagtggtcgcctccgaaatggccgaggctcttaaggggatgcctatccgctatcagacaaccgccgtgaaatctgaacataccggccgggagatcgttgatctgatgtgccacgctacatttaccatgagactcctgagccccgtgcgcgtccctaactacaatatgattatcatggacgaggcccatttcacagatcccgcgtccattgccgctcggggatatatcagcaccagagtgggcatgggggaagccgctgccatttttatgacggccacacctccgggatctgttgaggctttcccccagtccaacgcggtgatccaagacgaagagcgggatatccctgaacgcagctggaattctggctacgactggattaccgattttcccgggaagacagtctggttcgtgcctagcatcaaatccggaaacgacattgccaattgtctgagaaagaacggcaagcgggtgatccagctctctcgcaaaaccttcgacacggagtatcagaagaccaaaaacaatgattgggactacgtcgttacaaccgatattagcgagatgggggctaactttagagccgaccgggtgatcgatcccagacgctgccttaagccggtgattctgaaagacggccctgaacgggtcatcctggccggacccatgcccgtgacagttgcttccgccgcgcagagacgcggccggatcgggagaaatcaaaacaaggagggagatcagtacgtgtatatgggccagcctctcaataacgacgaagatcacgctcattggaccgaggccaagatgctgcttgacaatattaacacacccgaggggatcattcctgccctgttcgaaccggagcgcgaaaaatctgctgccatcgatggagagtaccggctcagaggcgaagcgcgcaagacctttgtcgagctgatgagacggggggacctgcccgtgtggctcagctataaagttgcctccgagggcttccagtacagcgatcgcagatggtgctttgacggagaacggaataaccaagtgcttgaggaaaatatggacgtcgagatttggacgaaggaaggcgagcgcaaaaagctgagacctcggtggctggatgctagaacatattctgaccccctcgccctgcgcgagttcaaagaatttgctgccgggcggagatccgtgagcggagatcttatcctggagatcggcaagctccctcagcacctgaccctgcgcgctcagaacgccctcgacaatcttgtcatgctgcacaactccgaacaggggggaaaggcgtaccggcatgccatggaggaactgcccgataccattgagacactcatgctgcttgctctgatcgccgtgctcaccggcggcgttacactgttctttctgtctgggaaaggactcggcaagacgagcattgggcttctgtgtgtgaccgcttcctctgccctgctctggatggccagcgtggagccgcactggatcgctgcgtccattatcctggaattctttcttatggtcctgctcatccctgagcccgacagacaacggacacctcaggataatcagctggcctatgttgtgattggactgctcttcatgatccttaccgtggctgccaacgaaatgggcctgctggagacaaccaaaaaggacctcgggattggacatgtcgccgctgagaaccaccaacacgccacgatgctggatgtggaccttcgccccgcgagcgcctggaccctgtacgctgttgccacaaccgtgatcacacctatgatgagacataccattgaaaatacgacagctaacatctctctcaccgccattgcgaatcaggccgctatcctgatgggcctggataaaggctggcccatctccaagatggacattggggtcccgctccttgccctgggatgctacagccaggtgaaccctctgacactcaccgctgccgtcctgatgcttgtggctcactatgccatcattggccccgggctgcaggcgaaggccacccgggaggctcaaaaacgcacagccgctggaatcatgaagaatcccacggttgatggcattgtggccatcgacctcgaccctgtcgtgtacgatgccaaatttgaaaagcagctggggcagatcatgctgctcattctttgtacctctcagatcctgctgatgagaacaacctgggcgctctgcgagtccattacactggctaccggaccgcttacgacactgtgggaaggcagccccggcaaattctggaacaccaccatcgccgtttctatggctaatattttccgggggagctatctcgccggagccggcctggctttttccctgatgaagtctctcgggggaggccgcagagggacaggagcccaaggcgagacccttggcgagaagtggaaacggcagctgaaccagctgagcaagtccgaattcaatacatacaaacgcagcgggatcatggaggtggacagatccgaagcgaaggagggactcaaacggggcgaaacgaccaagcatgccgtctctagagggacagctaagctgcgctggtttgtggagcggaaccttgtgaaacctgagggaaaggttatcgatctgggctgtgggagaggaggctggagctattactgcgccggcctcaaaaaggtcaccgaagtgaaagggtatacaaagggaggccccgggcacgaggaacctattcccatggctacctacggatggaatctggtgaaactgcattccggcaaggacgtcttctttatgcctccggagaagtgtgatacgctcctttgcgacatcggggaatctagccccaaccctaccattgaggagggacgcacactgcgggttctgaaaatggtggaaccctggctcagaggcaatcagttctgtatcaagattctgaacccttacatgccctccgtggtcgagacccttgaacaaatgcagcgcaaacacggcgggatgctggtgcggaatccgctctctagaaacagcacacacgagatgtattgggtttcctgcggaaccggcaatatcgtgagcgccgtcaacatgacatctcgcatgctgctgaaccggtttaccatggcgcatagaaagcctacgtacgagcgcgatgtggacctcggggccggaacacggcacgttgctgtggaacccgaggtcgccaatctggatattatcggccagagaatcgaaaacattaaaaatgagcataagtccacctggcactatgacgaagataacccctacaagacctgggcttatcacgggagctacgaggtgaaaccttctggatccgccagctctatggtgaatggcgtcgttcgccttctgacaaagccctgggacgtgatccctatggtgacgcaaattgctatgaccgacacaaccccgttcggccagcagagagtctttaaagagaaggtggatacacggaccccccgcgccaaaagagggacaacccagatcatggaagttacggcgaagtggctctggggattcctgtcccggaacaagaaacctagaatttgtacccgggaggaatttacacgcaaggtgagaagcaatgccgctatcggcgccgtcttcgtggacgagaaccaatggaattccgctaaagaagccgttgaggatgagcggttttgggaccttgtgcatcgcgaaagagagctgcacaagcaggggaaatgcgccacctgcgtctataacatgatgggaaagcgggaaaagaaactcggcgagttcgggaaggcgaaaggcagccgcgctatctggtacatgtggctgggagccagattcctggaatttgaggccctcggcttcatgaatgaggatcattggttttctcgggaaaacagcctgtccggggtggagggagaaggccttcacaagctggggtacattctccgcgacatctctaaaattcccggaggcaatatgtatgctgatgacacagccgggtgggataccagaatcacggaggacgatctgcagaacgaggctaagattacagacatcatggaacctgagcatgcccttctggcgaccagcatcttcaaactcacataccagaataaggttgtgcgggtccaacgccccgccaagaacggcaccgtgatggatgtcatttccagacgggaccagcgcggatctggccaggtggggacgtatggactgaacacctttacaaatatggaagttcagctgatcagacaaatggagagcgaaggcattttcctcccgtccgagctggagacccctaaccttgctaaacgggtgctggactggctcgaaaagcacggggccgagagactgaaacgcatggctatctctggagatgactgtgtcgtgaagcccattgatgaccggtttgccacagcgcttaccgccctgaatgatatgggcaaagtgagaaaggacatccctcagtgggaacccagcaaggggtggaacgattggcagcaggttcctttctgctcccaccattttcaccaactcatcatgaaagacggccgcgagattgtggtcccctgtcggaatcaggatgaactggtgggaagagctcgcgttagccagggcgccgggtggtctctgcgggagacagcttgcctcggaaagtcctacgcccaaatgtggcagctgatgtatttccatagacgcgaccttcggctggctgccaacgcgatctgtagcgccgtgccggtcgattgggtgcctacctctagaacgacatggtccattcacgctcaccatcagtggatgaccaccgaggacatgctcagcgtctggaatcgcgtgtggatcgaagagaacccctggatggaagacaaaacacacgtttcctcttgggaggaagtgccctacctgggcaagcgggaggatcagtggtgcgggagccttattggactgaccgccagagccacatgggctacgaatatccaagtcgccattaaccaggtgcggagactcatcggcaatgagaactatctggactacatgacctccatgaaacgctttaagaatgaaagcgatcctgagggggcgctgtggtga

SEQ ID NO: 18685 - RNA, 9879 nt, synthetic construct
  misc_feature 1..9879: note = derived and/or modified CDS sequence (opt5) from DENV-1__FJ547089__SS-prME
  source 1..9879: mol_type = other RNA
agcgtgaccatgctgctcatgctgcttcccaccgctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagaccattcatgaatggtgttgcagaagctgtacactgcctccccttcggttccgcggggaggatggatgctggtacggcatggagatcagaccggtgaaagaaaaggaggaaaacctcgtccggtccatggtgagcgcggggtctggagaggttgactcctttagcctgggcatcctgtgtgcttccattatgatcgaagaggtgatgagatctcgctggagccggaagatgctcatgaccgggaccctggccgtcttccttctgctcattatgggacaactgacatggaatgacctgatcagactttgcattatggtgggcgccaacgcttccgatcgcatgggcatggggacgacctatctggccctcatggcgacatttaaaatgagacctatgttcgctgttggactgctctttcggcgcctgacctctagagaggtgcttctgctcacaatcggcctgagcctggtcgcctccgtggaacttcccaactctctggaggaactcggggacggactggccatgggcattatgatgctcaagctgcttaccgagttccagccccaccagctgtggacgacactcctgagcctgacctttatcaaaaccacactttccctggattacgcttggaagaccacagccatggctctcagcatcgtgtctctgttccctctctgtctgtccacgaccagccagaaaacaacctggcttccggtcctgctggggtcttttggatgcaagcccctcacaatgttcctgattaccgaaaataagatctggggccggaaatcctggcctcttaacgagggcattatggccatcgggattgttagcatcctgctctcttccctgctcaagaatgacgtgcccctggcgggacctcttatcgccggcgggatgctgattgcttgttatgtgatcagcggatccagcgccgatctgtctctcgagaaagctgccgaagtcagctgggagcaagaagccgagcattccggcacgtctcacaacattctggtggaagttcaggacgatgggaccatgaagatcaaagacgaggagcgcgatgacacacttaccattctgctcaaggctacactgctcgcggtgagcggagtctaccccatgtccatccctgccaccctgtttgtgtggtatttctggcagaaaaagaagcagagatctggcgttctttgggatacacccagcccgcctgaagtggagcgggctgtcctggacgatggcatctaccgcattctgcaaagagggctcctgggacggtcccaggtgggcgtcggggtgttccaggacggagtttttcatacgatgtggcacgtgacccgcggcgccgtccttatgtatcaggggaaaagactggaaccctcttgggccagcgtgaagaaagacctcatctcctacggaggcggctggcggttccaagggagctggaatacaggagaggaggttcaggtgattgctgtcgaacctggcaagaaccccaaaaatgtgcagaccaccccggggacatttaagacgcctgagggagaagtgggcgccatcgcgctggatttcaagcccgggacctctggatcccctattgttaacagagagggcaaaatcgtcggcctctacgggaatggagtggtgacaaccagcggcacatatgtctctgctattgcccaagccaaggcttcccaggaagggcccctgcccgagatcgaggacgaagtgtttaaaaagcgcaaccttaccatcatggatctgcaccctggaagcggcaaaacgcggagatacctgccggccattgttcgcgaggcgatcaagcggaagctcagaacactgattcttgctcccacccgcgtggtcgcctccgaaatggccgaggctctgaaagggatgcctatccggtatcagaccacagccgtgaagtctgaacataccggcagagagattgttgacctcatgtgccacgctacattcaccatgcgcctgctgagccccgtgcgggtccctaattacaacatgatcatcatggatgaggcccattttacggaccccgcgtccattgccgctagaggatatatcagcacacgggtgggcatgggggaagccgctgccattttcatgaccgccacacctccgggatctgttgaggcttttccccagtccaatgcggtgatccaagatgaagaacgcgacattcctgaaagaagctggaactctggctacgattggatcaccgacttccccgggaaaacggtctggtttgtgcctagcatcaagtccggaaatgatattgccaactgtctccggaaaaacggcaagcgcgtgatccagctttctagaaagaccttcgacacagagtatcagaaaaccaagaataacgactgggattacgtcgttacaaccgacattagcgagatgggggctaatttccgggccgatagagtgatcgacccccgccggtgcctgaaaccggtgattctgaaggatggccctgaaagagtcatcctcgccggacccatgcccgtgacagttgcttccgccgcgcagcgccggggcagaattgggcgcaaccaaaataaagagggagaccagtacgtgtatatgggccagcctctgaacaatgatgaagaccacgctcattggaccgaggccaagatgcttctggataacatcaatacgcccgaggggatcattcctgccctctttgaaccggagcgggaaaagtctgctgccatcgacggagagtacagactgcgcggcgaagcgagaaaaacattcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatttggaccaaagaaggcgagagaaagaaactgcggcctagatggctcgacgctcgcacctattctgatcccctggcccttcgggagtttaaggagttcgctgccgggagacgctccgtgagcggagacctgatcctcgagattggcaaactgcctcagcacctgacactccgggctcagaatgcccttgataacctggtcatgctgcacaattccgaacaagggggaaaggcgtacagacatgccatggaggaactccccgacaccatcgagacactgatgcttctggctctcatcgccgtgctgacgggcggcgttaccctgtttttcctctctgggaagggacttggcaaaacaagcattgggctgctgtgtgtgaccgcttcctctgccctcctgtggatggccagcgtggagccgcactggatcgctgcgtccattatccttgaatttttcctgatggtcctcctgattcctgagcccgatcggcaacgcacacctcaggacaaccagctggcctatgttgtgatcggactcctttttatgatcctgaccgtggctgccaacgaaatgggcctgctcgagacgaccaagaaagatctggggattggacatgtcgccgctgagaatcaccaacacgccacaatgcttgacgtggatctgagacccgcgagcgcctggaccctctacgctgttgccacaaccgtgatcacgcctatgatgcggcatacaattgaaaacaccacagctaatatctctctgaccgccattgcgaaccaggccgctatcctgatgggcctcgacaagggctggcccatttccaaaatggatatcggggtcccgcttctggccctgggatgctacagccaggtgaatcctctcaccctgacagctgccgtccttatgctggtggctcactatgccatcattggccccgggctccaggcgaaggccacgcgcgaggctcaaaagagaaccgccgctggaatcatgaaaaaccccacagttgacggcattgtggccatcgatctggaccctgtcgtgtacgacgccaagttcgaaaaacagctggggcagattatgctccttatcctgtgtacctctcagatcctgctcatgcggacaacctgggcgctgtgcgagtccattacgcttgctacaggaccgctgaccaccctctgggaaggcagccccggcaagttttggaatacaaccatcgccgtttctatggctaacattttccgcgggagctatctggccggagccggcctggctttctccctcatgaaatctcttgggggaggcagacgggggacaggagcccaaggcgagacgctgggcgagaagtggaagcgccagctgaatcagctcagcaaatccgaatttaacacctacaagagaagcgggatcatggaggtggatcggtccgaagcgaaagagggactgaagagaggcgaaacaaccaaacatgccgtctctcgcgggacagctaaacttcggtggttcgtggagagaaatctggtgaagcctgagggaaaagttattgacctcggctgtgggcgcggaggctggagctattactgcgccggcctgaagaaagtcaccgaagtgaaggggtatacgaaaggagtgcccgctcgggaggaacctatccccatggccacctacggctggaacctggtcaagctccactccgggaaagatgtgtttttcatgcctccggagaagtgtgacacacttctgtgcgatatcggagaatctagccccaatcctaccattgaggagggcagaacactgcgcgttctcaagatggtggaaccctggctgcgggggaaccagttttgtatcaaaattcttaatccttacatgccctccgtcgtggagaccctggaacaaatgcagagaaagcatggaggcatgctcgttcgcaacccgctgtctcggaatagcacacacgagatgtattgggtgtcctgcggcaccgggaacatcgtcagcgcggtgaacatgacgtctagaatgctgctcaatcgcttcacaatggcccaccggaaacctacctacgagagagacgttgatctgggagctggcacccgccatgtggccgtcgaacccgaggtggctaaccttgacattatcgggcagagaattgaaaatatcaagaacgagcacaaatccacatggcattatgatgaagacaatccctacaagacgtgggcctatcacggaagctacgaggtgaagccttctggctccgctagctctatggtcaacggggttgtgcggctgctcaccaaaccctgggatgtgatccctatggtcacacaaattgccatgaccgacacaaccccgtttggacagcagcgcgtgttcaaggagaaagttgacacaagaacaccccgggcgaagagaggcacgacccagatcatggaagtgacagccaaatggctgtggggctttctttcccggaataagaagcctcgcatttgtaccagagaggagttcacacggaaagtccgcagcaacgctgccatcggggctgtgtttattgatgagaatcaatggaactccgccaaggaagccgttgaggacgagagattctgggatctggtgcaccgggaacgcgagctccataaacagggaaagtgcgcgacctgcgtctataatatgatgggcaaaagagaaaagaagctgggggagtttggaaaagctaagggcagccgggccatctggtacatgtggctgggggcccgcttcctcgagttcgaggctctgggctttatgaacgaggaccactggttctctagagaaaatagcctttccggagtggagggcgaagggctgcataaactcggatacatcctgcgggatatttctaagatccccggcgggaacatgtatgccgacgatacggctggatgggacacacgcgttaccgaggatgaccttcagaatgaggccaaaattacagatatcatggaacctgagcacgcgctgctcgccaccagcatttttaagctgacgtaccagaacaaagtggtcagagtgcaacggcccgctaagaacggcaccgtcatggacgtgatctcccgcagagatcagcgggggtctggccaggttggaacatatggcctgaataccttcacaaacatggaagtgcagctcatcagacaaatggagagcgaagggatttttctgccgtccgagcttgagacccctaatctggccgaacgcgtcctcgactggctggagaagcatggagctgaacggcttagacgcatggccatctctggcgacgattgtgtggtgaaacccattgacgatcggttcgcgacagccctgaccgctctcaacgacatggggaaggttagaaaagatatccctcagtgggagcccagcaagggatggaatgactggcaacaggtgcctttttgctcccaccacttccatcaactgattatgaaagatggccgcgaaatcgtcgtgccctgtcggaaccaggacgagctggttgggagagcccgcgtgagccagggcgctggatggtctctccgggagacggcctgcctgggcaagtcctacgctcaaatgtggcagcttatgtattttcacagacgcgatctgcggctcgccgcgaatgccatctgtagcgctgtcccggtggactgggtccctacatctagaaccacctggtccattcatgcccaccaccagtggatgacaaccgaagatatgctgagcgtgtggaaccgggtttggatcgaggaaaatccctggatggaggacaagacacatgtgtcctcttgggaagaggtcccctaccttgggaaaagagaggaccagtggtgcggaagcctgattggcctcacggcccgcgctacctgggccacaaacatccaagtggcgattaatcaggttcggagactgatcgggaacgaaaattatctggattacatgacctccatgaagcgcttcaaaaacgagagcgaccctgaaggagctctctggtga

SEQ ID NO: 18686 - RNA, 9879 nt, synthetic construct
  misc_feature 1..9879: note = derived and/or modified CDS sequence (opt5) from DENV-1__FJ024484__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtggtcgcctttttcctggcgcatgccatcgggacatctattacccaaaagggaatcatctttattctcctgatgcttgtgacccctagcatggctatgcgctgcgttggcatcgggaacagagatttcgtggagggactgtccggcgccacatgggtcgacgtggtgctcgagcacgggagctgtgtcacgaccatggctaagaataaacccacactggatattgaactgctcaagaccgaggttacaaaccctgccatcctgcggaaactttgcattgaagcgaagatctctaataccacgacagactcccgctgtccgacccagggagaggccaccctggtggaagagcaggatgctaactttgtgtgcagacggacattcgtcgaccgcggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcaacatcaggttgggaatgagacaaccgaacacggaacaatcgctaccattacgccccaggcccctacctccgagatccagctgacagactacggcgccctgaccctcgactgtagccccagaacaggcctggattttaacgaaatggtgcttctgaccatgaaggagaaatcttggctcgtccataagcaatggttcctggaccttcctctgccctggacgtccggggctagcacatcccaggagacctggaatcggcaggatctcctggtgacatttaaaaccgcgcacgccaagaagcaagaagtcgtggttctgggatctcaggagggcgctatgcacaccgccctcacaggggccacggaaattcagaccagcggaacaaccacaatcttcgctggccatctgaaatgccgccttaagatggacaaactgaccctcaaggggacgtcctatgtgatgtgtacaggcagcttcaaactggagaaggaagtcgccgagacccagcacggaaccgtgctggttcaagtgaagtacgagggcacagatgcgccgtgcaaaattcctttttctacccaggacgaaaagggggtcacacagaacggaagacttatcacggctaatcccatcgtgaccgataaagagaagcctgtgaacattgaaacagagccccccttcggcgagtcctatatcgttattggggccggagaaaaagccctcaagctgagctggtttaagaaaggctctagcatcgggaagatgttcgaggctaccgcccggggcgctagacgcatggccattctgggagacacagcgtgggattttggctccatcgggggagtcttcacctctgtgggcaaactcgtgcatcaggtctttgggacggcctacggagtgctgttcagcggcgtttcctggaccatgaagatcgggattggcatccttctgacatggctcggactgaatagccggtctacctccctgagcatgacatgtattgctgtgggcatggtcaccctttacctcggggtgatggttcaagccgactctggatgcgtgatcaactggaaaggcagagaactgaagtgtgggtccggaatttttgtcacaaacgaggtgcacacctggacggaacagtataagttccaggctgatagccctaaacgcctgtccgccgcgatcggcaaggcctgggaggagggggtttgcggcattcggtctgctacaagactcgaaaatatcatgtggaaacagatcagcaacgagctgaatcatattcttctggaaaacgacatgaagtttaccgtggtcgtgggagacgccaatggcatcctcgctcaagggaaaaagatgattcgcccgcagcccatggagcacaaatactcctggaagtcttggggaaaggccaaaatcattggcgccgatatccagaacaccacattcatcattgacgggcctgatacccccgaatgtcctgacgatcagcgggcttggaatatctgggaggtggaggactatggatttggcattttcacgacaaacatctggctgaagctgagagatagctacacccaaatgtgcgaccaccgccttatgtccgcggccattaaagatagcaaggctgtccatgccgacatgggctattggatcgaatctgagaaaaatgaaacatggaagctcgcccgggcttccttcatcgaggttaagacctgtacatggcccaaaagccacaccctgtggtctaacggggtgctggaatccgagatgattatcccgaagatttacggaggccctatcagccagcataattatagacccgggtactttacgcagaccgccggaccttggcacctcggcaaactggagcttgatttcgacctgtgcgaagggacaaccgtggtcgtggatgagcactgcggaaaccgcggcccctctctccggacaaccacggttacaggcaagattatccatgaatggtgttgcagaagctgtaccctgcctcccctgcggtttcgcggggaggacggatgctggtacggcatggagatcagaccggtgaaagaaaaggaggaaaatcttgtccggtccatggtgagcgcggggtctggagaggttgactccttcagcctcggcattctgtgtgcttccatcatgattgaagaggtgatgagatctcgctggagccggaagatgctgatgacagggaccctcgccgtctttctgcttctgatcatgggacaactcacctggaacgatctgattagactgtgcatcatggtgggcgccaatgcttccgaccgcatgggcatggggacaacgtatcttgccctgatggcgaccttcaaaatgagacctatgtttgctgttggactcctgttccggcgcctcacatctagagaggtgctgcttctgaccattggcctcagcctggtcgcctccgtggaactgcccaactctcttgaggaactgggggatggactcgccatgggcatcatgatgctgaagctcctgacagagtttcagccccaccagctttggaccacgctgctcagcctgacattcatcaaaaccaccctgtcccttgactacgcttggaagacaaccgccatggctctgagcattgtgtctctctttcctctgtgtctctccacaacgagccagaaaaccacatggctgccggtccttctggggtctttcggatgcaagcccctgaccatgtttctcatcacagaaaacaagatttggggccggaaatcctggcctctgaatgagggcatcatggccattgggatcgttagcatccttctgtcttccctcctgaagaacgatgtgcccctcgcgggacctctgattgccggcgggatgcttatcgcttgttatgtgattagcggatccagcgccgacctgtctctggagaaagctgccgaagtcagctgggagcaagaagccgagcattccggcacctctcacaatatcctcgtggaagttcaggatgacgggacgatgaagattaaagatgaggagaaggacgataccctgacaatccttctgaaagctaccctcctggcggtgagcggagtctaccccatgtccatccctgccacactcttcgtgtggtatttctggcagaagaagaaacagcgctctggcgttctgtgggacacccccagcccgcctgaagtggagagagctgtccttgatgacggcatttaccggatcctgcaacgcgggctgctcggaagatcccaggtgggcgtcggggtgtttcaggacggagttttccatacaatgtggcacgtgacgcggggcgccgtcctgatgtatcaggggaagcgccttgaaccctcttgggccagcgtgaaaaaggatctgatttcctacggaggcggctggagatttcaagggagctggaacaccggagaggaggttcaggtgatcgctgtcgaacctggcaaaaatcccaagaacgtgcagacaaccccggggaccttcaagacacctgagggagaagtgggcgccattgcgctcgactttaaacccgggacgtctggatcccctatcgttaatcgggagggcaagattgtcggcctgtacgggaacggagtggtgaccacaagcggcacctatgtctctgctatcgcccaagccaaagcttcccaggaagggcccctccccgagatcgaggatgaagtgttcaagaaaagaaatctgacaattatggaccttcaccctggaagcggcaagacccgccggtacctgccggccatcgttagagaggcgattaagcgcaaactgcggacgctcatcctggctcccacaagagtggtcgcctccgaaatggccgaggctcttaaggggatgcctattcgctatcagaccaccgccgtgaaatctgaacatacaggccgggagatcgttgatctgatgtgccacgctacctttacaatgagactcctgagccccgtgcgcgtccctaactacaatatgatcattatggacgaggcccatttcaccgatcccgcgtccatcgccgctcggggatatattagcacgagagtgggcatgggggaagccgctgccatctttatgacagccacccctccgggatctgttgaggctttcccccagtccaacgcggtgattcaagacgaagagcgggatatccctgaacgcagctggaattctggctacgactggatcacagattttcccgggaagaccgtctggttcgtgcctagcattaaatccggaaacgacatcgccaattgtctgagaaagaacggcaagcgggtgattcagctctctcgcaaaacgttcgacaccgagtatcagaagacaaaaaacaatgattgggactacgtcgttaccacagatatcagcgagatgggggctaactttagagccgcccgggtgattgaccccagacgctgccttaagccggtgatcctgaaagatggccctgaacgggtcattctggctggacccatgcccgtgaccgttgcctccgcggctcagagacgcggccggatcgggagaaatcaaaacaaggagggagaccagtacgtgtatatgggccagcctctcaataacgatgaagaccacgcccattggacagaggccaagatgctgcttgataatatcaacacccccgaggggattatccctgctctgttcgaaccggagcgcgaaaaatctgccgcgattgacggagagtaccggctcagaggcgaagcccgcaagacgtttgtcgagctgatgagacggggggatctgcccgtgtggctcagctataaagttgcttccgagggcttccagtacagcgaccgcagatggtgctttgatggagaacggaataaccaagtgcttgaggaaaatatggacgtcgagatctggacaaaggaaggcgagcgcaaaaagctgagacctcggtggctggacgccagaacctattctgatcccctcgctctgcgcgagttcaaagaatttgccgctgggcggagatccgtgagcggagaccttattctggagatcggcaagctccctcagcacctgaccctgcgcgcccagaacgcgctcgataatcttgtcatgctgcacaactccgaacaggggggaaaggcctaccggcatgctatggaggaactgcccgacacaatcgagaccctcatgctgcttgccctgattgctgtgctcacaggcggcgttacgctgttctttctgtctgggaaaggactcggcaagaccagcatcgggcttctgtgtgtgacagcctcctctgccctgctctggatggctagcgtggagccgcactggattgcggcctccatcattctggaattctttcttatggtcctgctcatccctgagcccgatagacaacggacccctcaggacaatcagctggcttatgttgtgatcggactgctcttcatgattcttacagtggccgccaacgaaatgggcctgctggagaccacgaaaaaggatctcgggatcggacatgtcgctgccgagaaccaccaacacgcgaccatgctggacgtggatcttcgccccgccagcgcttggacactgtacgccgttgctaccacagtgattacccctatgatgagacatacgatcgaaaatacaaccgccaacatttctctcacagcgatcgccaatcaggctgccattctgatgggcctggacaaaggctggcccatctccaagatggatatcggggtcccgctccttgctctgggatgctacagccaggtgaaccctctgaccctcaccgccgctgtcctgatgcttgtggcccactatgcgattatcggccccgggctgcaggccaaggctacacgggaggcccaaaaacgcacggctgccggaattatgaagaatcccaccgttgacggcatcgtggccattgatctcgaccctgtcgtgtacgacgcgaaatttgaaaagcagctggggcagatcatgctgctcatcctttgtacatctcagattctgctgatgagaaccacatgggctctctgcgagtccatcaccctggccacgggaccgcttacaaccctgtgggaaggcagccccggcaaattctggaacaccacaattgctgtttctatggccaatatcttccgggggagctatctcgccggagctggcctggccttttccctgatgaagtctctcgggggaggccgcagagggaccggagcgcaaggcgagacacttggcgagaagtggaaacggcagctgaaccagctgacgaagagcgaattcaatacctacaaacgctccgggattatggaggtggatagaagcgaagccaaggagggactcaaacggggcgaaacaaccaagcatgctgtctccagagggacagccaagctgcgctggtttgtggagcggaaccttgtgaaacctgagggaaaggttatcgacctgggctgtgggagaggaggctggtcttattactgcgctggcctcaaaaaggtcaccgaagtgaaagggtatacgaagggaggccccgggcacgaggaacctatccccatggccacctacggatggaatctggtgaaactgcatagcggcaaggatgggttctttatgcctccggagaagtgtggaacactcctttgcgacattggcgaatcctctcccaaccctaccatcgaggagggccgcacactgcgggtcctgaaaatggttgaaccctggctcagagggaatcagttctgtattaagatcctgaacccttacatgcccagcgtggtggagacccttgaacaaatgcagcgcaaacacggaggcatgctggtccggaatccgctctccagaaactctacacacgagatgtattgggtgagctgcgggaccggaaatattgtttccgcggtgaacatgacgagccgcatgctgctgaaccggtttacaatggcccatagaaagcctacctacgagcgcgatgtcgacctcggcgctgggacccggcacgtggccgttgaacccgaggtggctaatctggatatcattggacagagaatcgaaaacatcaaaaatgagcataagtctacatggcactatgacgaagataacccctacaagacgtgggcctatcacggctcctacgaggtcaaacctagcggctctgcttccagcatggtgaatggggtggtccgccttctgaccaagccctgggacgttattcctatggtgacacaaatcgccatgaccgatacaaccccgttcggacagcagagagtgtttaaagagaaggtcgacacacggaccccccgcgcgaaaagaggcacgacccagattatggaagtgacagccaagtggctctgggggttcctgtctcggaacaagaaacctagaatctgtacccgggaggaatttacacgcaaggttagatccaatgctgccattggagctgtgttcgtcgacgagaaccaatggaatagcgccaaagaagccgtggaggatgagcggttttgggaccttgttcatcgcgaaagagagctgcacaagcagggcaaatgcgcgacctgcgtgtataacatgatggggaagcgggaaaagaaactcggcgagttcggaaaggctaaaggctcccgcgccatctggtacatgtggctgggggccagattcctggaatttgaggctctcggattcatgaatgaggatcattggtttagccgggaaaactctctgagcggcgtcgagggggaaggacttcacaagctgggctacatcctccgcgacatttccaaaatccccgggggcaatatgtatgccgatgacacggctggatgggatacaagaattaccgaggacgatctgcagaacgaggccaagatcacagacattatggaacctgagcatgcgcttctggccacctctatcttcaaactcacgtaccagaataaggtggttcgggtgcaacgccccgctaagaacggcaccgtcatggatgtgatcagcagacgggaccagcgcgggtccggacaggtcggcacatatgggctgaacacctttacaaatatggaagtgcagctgattagacaaatggagtctgaaggaatcttcctcccgagcgagctggagacccctaaccttgccaaacgggttctggattggctcgaaaagcacggcgctgagagactgaaacgcatggccatttccggggacgactgtgtggtcaagcccatcgatgaccggtttgcgacagcccttaccgctctgaatgatatgggcaaagtgagaaaggacattcctcagtgggaaccctctaagggatggaacgattggcagcaggtgcctttctgcagccaccattttcaccaactcatcatgaaagacggccgcgagatcgttgtgccctgtcggaatcaggatgaactggtcgggagagcccgcgtgtcccagggagctggctggagcctgcgggagacggcctgcctcgggaagtcttacgctcaaatgtggcagctgatgtatttccatagacgcgaccttcggctggccgcgaacgccatttgttccgctgttccggtggattgggtccctacaagcagaaccacctggtctatccacgcccaccatcagtggatgacaaccgaggacatgctctccgtgtggaatcgcgtctggattgaagagaacccctggatggaagataaaacacacgtgagctcctgggaggaagttccctacctgggaaagcgggaggaccagtggtgcggctctcttatcgggctgacggccagagctacctgggccacaaatattcaagtggcgatcaaccaggtccggagactcattggcaatgagaactatctggactacatgaccagcatgaaacgctttaagaatgaatccgatcctgagggagctctgtggtga

SEQ ID NO: 18687 - RNA, 9879 nt, synthetic construct
  misc_feature 1..9879: note = derived and/or modified CDS sequence (opt5) from DENV-1__EU596503__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtatcggcagcttcaaactggagaaggaagtggccgagacacagcacggaaccgtccttgtgcaagttaagtacgagggcaccgatgcgccgtgcaaaatccctttctctacacaggacgaaaagggggtgacccagaacggaagactcattacagctaatcccatcgtcacggataaagagaagcctgtgaacattgaaaccgagcccccctttggcgagtcctatatcgtggttggggccggagaaaaagccctgaagctgagctggttcaagaaaggctctagcattgggaagatgtttgaggctacagcccggggcgctagacgcatggccatcctcggagacaccgcgtgggatttcggctccatcgggggaatgtttacatctgtcggcaaactggtgcatcaggtgttcgggaccgcctacggagtcctttttagcggcgtgtcctggacgatgaagattgggatcggcattctgctcacctggctgggactgaatagccggtctacatcccttagcatgacctgtatcgctgttggcatggtgacactctacctgggggtcatggtgcaagccgactctggatgcgttattaactggaaaggcagagaactgaagtgtgggtccggaatcttcgtgaccaacgaggtccacacatggaccgaacagtataagtttcaggctgatagccctaaacgcctctccgccgcgattggcaaggcctgggaggagggggtgtgcggcatccggtctgctacgagactggaaaatatcatgtggaaacagattagcaacgagcttaatcatatcctgctcgaaaacgacatgaagttcacagttgtggtcggagacgccaatggcattctggctcaagggaaaaagatgatccgcccgcagcccatggagcacaaatactcctggaagtcttggggaaaggccaaaattatcggcgccgatatccagaacaccacctttattatcgacgggcctgatacacccgaatgtcctgacaatcagcgggcttggaacatttgggaggtggaggattatggattcggcatctttaccacgaatatttggctgaagcttagagacagctacacacaaatgtgcgatcaccgcctcatgtccgcggccatcaaagacagcaaggctgtgcatgccgatatgggctattggatcgaatctgagaaaaacgaaacctggaagctggcccgggcttccttcattgaggtcaagacatgtacctggcccaaaagccacacactgtggtctaatggggttctcgaatccgagatgatcattccgaagatctacggaggccctattagccagcataactatagacccgggtacttcacccagacggccggaccttggcacctgggcaaacttgagctggactttgatctctgcgaagggaccacagtggtggtcgacgagcactgcggaaatcgcggcccctctctgcggaccacaaccgtgacgggcaagatcatccatgaatggtgttgcagaagctgtacactgcctccccttcggttccgcggggaggatggatgctggtacggcatggagattagaccggttaaagaaaaggaggaaaacctcgtgcggtccatggtcagcgcggggtctggagaggtggactcctttagcctgggcatcctgtgtgcttccattatgatcgaagaggttatgagatctcgctggagccggaagatgctcatgaccgggacactggccgtgttccttctgctcattaccggacaactgacctggaatgacctgatcagactttgcattatggtcggcgccaacgcttccgatcgcatgggcatggggacaacgtatctggccctcatggcgacctttaaaatgagacctatgttcgctgtgggactgctctttcggcgcctgacatctagagaggttcttctgctcaccatcggcctgagcctggtggcctccgtcgaacttcccaactctctggaggaactcggggacggactggccatgggcatcatgatgctcaagctgcttacagagttccagccccaccagctgtggaccacgctcctgagcctgacatttattaaaaccaccctttccctggattacgcttggaagacaaccgccatggctctcagcatcgtgtctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggccatcgggatcgtcagcattctgctctcttccctgctcaagaatgacgttcccctggcgggacctcttatcgccggcgggatgctgattgcttgttatgtgatcagcggatccagcgccgatctgtctctcgagaaagctgccgaagtgagctgggagcaagaagccgagcattccggcacctctcacaacattctggtcgaagtgcaggacgatgggacgatgaagatcaaagacgaggagcgcgatgacacccttacaatcctgctcaaggctaccctgctcgcggttagcggagtgtaccccatgtccattcctgccacactgtttgtctggtatttctggcagaaaaagaagcagagatctggcgtgctttgggatacccccagcccgcctgaagttgagcgggctgtgctggacgatggcatctaccgcattctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatctcctacggaggcggctggcggttccaagggagctggaataccggagaggaggtgcaggttattgctgtggaacctggcaagaaccccaaaaatgtccagacaaccccggggacctttaagacacctgagggagaagtgggcgccatcgcgctggatttcaagcccgggacgtctggatcccctattgtgaacagagagggcaaaatcgttggcctctacgggaatggagtcgtgaccacaagcggcacctatgtgtctgctatcgcccaagccaaggcttcccaggaagggcccctgcccgagattgaggacgaagtctttaaaaagcgcaaccttacaatcatggatctgcaccctggaagcggcaaaacccggagatacctgccggccattgtgcgcgaggcgatcaagcggaagctcagaacgctgattcttgctcccacacgcgttgtggcctccgaaatggccgaggctctgaaagggatgcctatccggtatcagaccaccgccgtcaagtctgaacatacaggcagagagatcgtggacctcatgtgccacgctaccttcacaatgcgcctgctgagccccgttcgggtgcctaattacaacatgattatcatggatgaggcccattttaccgaccccgcgtccattgccgctagaggatatatcagcacgcgggtcggcatgggggaagccgctgccattttcatgacagccacccctccgggatctgtggaggcttttccccagtccaatgcggttatccaagatgaagagcgcgacatccctgaaagaagctggaactctggctacgattggattacagacttccccgggaaaaccgtgtggtttgtccctagcatcaagtccggaaatgatattgccaactgtctccggaaaaacggcaagcgcgtgatccagctttctagaaagacgttcgacaccgagtatcagaaaacaaagaataacgactgggattacgtggtcaccacagacattagcgagatgggggctaatttccgggccgatagagttatcgacccccgccggtgcctgaaaccggtgattctgaaggatggccctgaaagagtgatcctcgccggacccatgcccgtcaccgtggcttccgccgcgcagcgccggggcagaatcgggcgcaaccaaaataaagagggagaccagtacgtttatatgggccagcctctgaacaatgatgaagaccacgctcattggacagaggccaagatgcttctggataacattaatacccccgaggggatcattcctgccctctttgaaccggagcgggaaaagtctgctgccatcgacggagagtacagactgcgcggcgaagcgagaaaaacgttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatttggacaaaagaaggcgagagaaagaaactgcggcctagatggctcgacgctcgcacctattctgatcccctggcccttcgggagtttaaggaattcgctgccgggagacgctccgtcagcggagacctgatcctcgagatcggcaaactgcctcagcacctgaccctccgggctcagaatgcccttgataacctggtgatgctgcacaattccgaacaggggggaaaggcgtacagacatgccatggaggaactccccgacacaattgagaccctgatgcttctggctctcatcgccgtcctgacaggcggcgtgacgctgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgatccctgagcccgatcggcaacgcacccctcaggacaaccagctggcctatgtcgttattggactcctttttatgatcctgacagtggctgccaacgaaatgggcctgctcgagaccacgaagaaagatctggggattggacatgtggccgctgagaatcaccaacacgccaccatgcttgacgtcgatctgagacccgcgagcgcctggacactctacgctgtggccaccacagttatcacccctatgatgcggcatacgattgaaaacacaaccgctaatatctctctgacagccattgcgaaccaggccgctatcctgatgggcctcgacaagggctggcccatctccaaaatggatattggggtgccgcttctggccctgggatgctacagccaggtcaatcctctcaccctgaccgctgccgtgcttatgctggtcgctcactatgccatcattggccccgggctccaggcgaaggccacacgcgaggctcaaaagagaacggccgctggaatcatgaaaaaccccaccgtggacggcattgttgccatcgatctggaccctgtggtctacgacgccaagttcgaaaaacagctggggcagatcatgctccttattctgtgtacatctcagatcctgctcatgcggaccacatgggcgctgtgcgagtccattacccttgctacgggaccgctgacaaccctctgggaaggcagccccggcaagttttggaataccacaatcgccgtgtctatggctaacattttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggatcatggaggttgatcggtccgaagcgaaagagggactgaagagaggcgaaaccacaaaacatgccgtgtctcgcgggaccgctaagcttcggtggttcgtcgagagaaatctggtgaagcctgagggaaaagtgatcgacctcggctgtgggcgcggaggctggagctattactgcgccggcctgaagaaagttacagaagtcaaggggtataccaaaggaggccccgggcacgaggaacctattcccatggctacgtacggatggaacctggtgaagctccattccggcaaagatgtgtttttcatgcctccggagaagtgtgacacccttctgtgcgatatcggggaatctagccccaatcctacaattgaggagggacggaccctgagagtcctcaagatggttgaaccctggctgcgcggcaaccagttttgtatcaaaattcttaatccttacatgccctccgtggtggagacactggaacaaatgcagcggaagcacggcgggatgctcgtcagaaacccgctgtctcgcaatagcacccacgagatgtattgggtgtcctgcggaacaggcaacatcgttagcgccgtgaacatgacctctcggatgctgctcaatagattcacgatggcgcatcgcaaacctacatacgagcgggacgtcgatctgggggccggaaccagacacgtggctgttgaacccgaggtggccaaccttgacattatcggccagcgcatcgaaaatattaagaacgagcataaatccacctggcactatgatgaagacaatccctacaagacatgggcttatcacgggagctacgaggtcaagccttctggatccgccagctctatggtgaacggcgtggtcagactgctcacgaaaccctgggatgttatccctatggtgacccaaattgctatgacagacaccacaccgtttggccagcagcgggtgttcaaggagaaagtcgacacccgcacacccagagccaagcgggggaccacgcagatcatggaagtgaccgcgaaatggctgtggggatttctttccagaaataagaagcctcggatttgtacacgcgaggaattcaccagaaaagttcggagcaacgccgctatcggcgccgtgtttgtcgatgagaatcaatggaactccgctaaggaagccgtggaggacgagcgcttctgggatctggttcatagagaacgggagctccacaaacaggggaagtgcgccacatgcgtgtataatatgatgggaaaacgcgaaaagaagctgggcgagtttgggaaagcgaagggcagcagagctatctggtacatgtggctgggagcccggttcctcgaattcgaggccctgggctttatgaacgaggaccattggttctctcgcgaaaatagcctttccggggtcgagggagaaggcctgcacaaactcgggtacattctgagagatatctctaagattcccggaggcaacatgtatgctgacgataccgccgggtgggacacgcggatcacagaggatgaccttcagaatgaggctaaaattaccgatatcatggaacctgagcatgccctgctcgcgacaagcatctttaagctgacctaccagaacaaagtggttcgcgtgcaaagacccgccaagaacggcacggtcatggacgtgatttcccggcgcgatcagagaggatctggccaggtcgggacctatggactgaatacattcaccaacatggaagtgcagctcatccggcaaatggagagcgaaggcatttttctgccgtccgagcttgagacacctaatctggctgaaagagttctcgactggctggagaagcacggggccgaacgccttaaacggatggctatctctggagacgattgtgtggtcaagcccattgacgatagattcgccaccgcgctgacagccctcaacgacatgggcaaagtgcgcaaggatatccctcagtgggagcccagcaaagggtggaatgactggcagcaggtgcctttttgctcccaccatttccaccaactgatcatgaaggatggccgggaaattgttgtgccctgtagaaaccaggacgagctggtcggacgcgctcgggtgagccagggcgccgggtggtctctcagagagaccgcttgcctgggaaagtcctacgcccaaatgtggcagcttatgtattttcatcgccgggatctgagactcgctgccaatgcgatctgtagcgccgttccggtggactgggtccctacgtctcgcacaacctggtccattcacgctcaccatcagtggatgaccacagaagatatgctgagcgtgtggaaccgggtctggatcgaggaaaatccctggatggaggacaaaacccacgtgtcctcttgggaagaggttccctaccttggcaagagagaggaccagtggtgcgggagcctgattggactcacagcccgggccacgtgggctaccaacatccaagtggccattaatcaggtcagacgcctgatcggcaacgaaaattatctggattacatgacatccatgaaacggttcaagaacgagagcgaccctgaaggggcgctctggtga

SEQ ID NO: 18688 - RNA, 9879 nt, synthetic construct
  misc_feature 1..9879: note = derived and/or modified CDS sequence (opt5) from DENV-1__FJ024479__SS-prME
  source 1..9879: mol_type = other RNA
agcgtgaccatgctgctcatgctgcttcccaccgccctggctttccacctcacgaccagaggcggggaacctcacatgatcgtctccaagcaggaacggggaaagtctctgctttttaagacaagcgccggcgttaacatgtgcaccctgattgcgatggacctcggggaactgtgtgaagatacaatgacctacaaatgcccgcagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggctttttcacgacaaatatttggctgaaacttagagacagctacacccaaatgtgcgatcaccgcctcatgtccgcggccatcaaagacagcaaggctgtccatgccgatatgggctattggattgaatctgagaaaaacgaaacatggaagctggcccgggcttccttcatcgaggttaagacctgtacatggcccaaaagccacaccctgtggtctaatggggtgctcgaatccgagatgatcattccgaagatctacggaggccctattagccagcataactatagacccgggtactttacgcagaccgccggaccttggcacctgggcaaacttgagctggacttcgatctctgcgaagggacaaccgtggtcgtggacgagcactgcggaaatcgcggcccctctctgcggacaaccacggttacaggcaagatcattcatgaatggtgttgcagaagctgtaccctgcctccccttcggtttcgcggggaggatggatgctggtacggcatggagatcagaccggtgaaagaaaaggaggaaaacctcgtccggtccatggtgagcgcggggtctggagaggttgactccttcagcctgggcatcctgtgtgcttccattatgatcgaagaggtgatgagatctcgctggagccggaagatgctcatgacagggaccctggccgtctttcttctgctcattatgggacaactgacctggaatgacctgatcagactttgcattatggtgggcgccaacgcttccgatcgcatgggcatggggacaacgtatctggccctcatggcgaccttcaaaatgagacctatgtttgctgttggactcctgttccggcgcctgacatctagagaggtgcttctgctcaccatcggcctgagcctggtcgcctccgtggaacttcccaactctctggaggaactcggggacggactggccatgggcattatgatgctcaagctgcttacagagtttcagccccaccagctgtggaccacgctcctgagcctgacattcatcaaaaccaccctttccctggattacgcttggaagacagccgctatggccctcagcatcgtgtctctgtttcctctctgtctgtccaccacaagccagaaaacgacctggcttccggtcctgctggggtctttcggatgcaagcccctcacaatgtttctgattaccgaaaataagatctggggccggaaatcctggcctcttaacgagggcattatggcgatcgggattgttagcatcctgctctcttccctgctcaagaatgacgtgcccctggccggacctcttatcgctggcgggatgctgattgcctgttatgtgatcagcggatccagcgctgatctgtctctcgagaaagccgccgaagtcagctgggagcaagaagctgagcattccggcacatctcacaacattctggtggaagttcaggacgatgggaccatgaagatcaaagacgaggagcgcgatgacacgcttaccattctgctcaaggcgacactgctcgccgtgagcggagtctaccccatgtccatccctgctaccctgttcgtgtggtatttctggcagaaaaagaagcagagatctggcgttctttgggatacacccagcccgcctgaagtggagcgggccgtcctggacgatggcatctaccgcattctgcaaagagggctcctgggacggtcccaggtgggcgtcggggtgtttcaggacggagttttccataccatgtggcacgtgacacgcggcgccgtccttatgtatcaggggaaaagactggaaccctcttgggctagcgtgaagaaagacctcatctcctacggaggcggctggcggtttcaagggagctggaatacgggagaggaggttcaggtgattgccgtcgaacctggcaagaaccccaaaaatgtgcagaccacaccggggaccttcaagacccctgagggagaagtgggcgcgatcgctctggattttaagcccgggacatctggatcccctattgttaacagagagggcaaaatcgtcggcctctacgggaatggagtggtgacgaccagcggcacatatgtctctgccattgcccaagctaaggcctcccaggaagggcccctgcccgagatcgaggacgaagtgttcaaaaagcgcaaccttaccatcatggatctgcaccctggaagcggcaaaacacggagatacctgccggcgattgttcgcgaggctatcaagcggaagctcagaaccctgattcttgcccccacgcgcgtggtcgcctccgaaatggctgaggccctgaaagggatgcctatccggtatcagacaaccgctgtgaagtctgaacataccggcagagagattgttgacctcatgtgccacgccacatttaccatgcgcctgctgagccccgtgcgggtccctaattacaacatgatcatcatggatgaggcgcatttcacagaccccgcctccattgctgccagaggatatatcagcacccgggtgggcatgggggaagctgccgccatttttatgacggctacacctccgggatctgttgaggcgttcccccagtccaatgccgtgatccaagatgaagaacgcgacattcctgaaagaagctggaactctggctacgattggatcaccgactttcccgggaaaacagtctggttcgtgcctagcatcaagtccggaaatgatattgctaactgtctccggaaaaacggcaagcgcgtgatccagctttctagaaagaccttcgacacggagtatcagaaaaccaagaataacgactgggattacgtcgttacaaccgacattagcgagatgggggccaattttcgggccgctagagtgatcgatccccgccggtgcctgaaaccggtgattctgaaggacggccctgaaagagtcatcctcgccggacccatgcccgtgacagttgcgtccgctgcccagcgccggggcagaattgggcgcaaccaaaataaagagggagatcagtacgtgtatatgggccagcctctgaacaatgacgaagatcacgcccattggaccgaggctaagatgcttctggacaacatcacaacccccgaggggatcattcctgccctcttcgaaccggagcgggaaaagtctgcggccatcgatggagagagcagactgcgcggcgaacccagaaaaacgtttgtcgagctgatgcggcgcggggacctccctgtgtggctttcctacaaggttgctagcgagggcttccagtattctgatagacggtggtgctttgacggagaacgcaataaccaagtgctggaggaaaatatggatgtcgagatttggcccaaagaaggcgagagaaagaaactgcggcctagatggctcgacgcccgcacatactccgaccccctggctcttggggagttcaaggaatttggagccggccggagaagcgggtccggagctctgatcctcgagattggcaaactgccgcagcatctgcctctccgcgcccagaacggccttgataatctggtgatggtccacaactctgaacaagggggaaaggcgtatcggcatgccatggaggaactgcccgacaccatcgagaccctcatgctgcttgctctgatcgccgtgctcacaggcggggttaccctgttctttctgagcggaaagggcctcgggaaaacatccattggacttctgtgtgtgacggcttctagcgccctgctctggatggcctccgtggagcctcactggatcgctgcgagcattatcctggagttctttcttatggtcctgctcattcccgagcctgatagacaacggacaccccaggacaatcagctggcctacgttgtgatcggcctcctgttcatgatccttacagtggctgccaacgaaatgggcctgctggagaccacaaagaaagatctcgggattggacatgtcgccgctgagaaccaccaacacgccaccatgctggacgtggatcttcgcccggcgtctgcctggacgctgtatgctgttgccaccacagtgatcacccctatgatgagacatacaattgaaaataccacggctaacatctccctcacagccattgcgaatcaggccgctatcctgatgggcctggccaaggggtggcccattagcaaaatggacatcggagtccccctccttgctctgggctgctactctcaggtgaaccctctgaccctcacagccgctgtcctgatgcttgtggcccactacgcgatcattgggccgggactgcaggccaaggctacccgggaggcccaaaagcgcaccgctgccggcatcatgaaaaatcccacagttgatggcattgtggccatcgacctcgatcctgtcgtgtatgacgcgaagtttgaaaaacagctggggcagattatgctgctcatcctttggacgtcccagatcctgctgatgagaaccacatgggctctcggagagagcattaccctggccacaggcccccttaccacgctgtgggaagggtctcctggaaagttctggaacacaaccatcgctgttagcatggccaatattttccggggctcctacctcgccggggctggactggccttttctctgatgaaaagcctcggcggcgggcgcagaggaaccggcgcgcaaggggagacacttggagagaagtggaagcggcagctgaaccagctgtccaaaagcgagttcaatacctataagcgctccggcatcatggaggtggatagatctgaagccaaagaggggctcaagcggggagaaacaacgaaacatgctgtcagcagaggcaccgccaagctgcgctggtttgtggagcggaaccttgtgaatcccgagggcaaggttattgacctggggtgtggaagaggcgggtggtcctactattgcgctggactcaaaaaggtcacagaagtgaaaggctacaccaaagggggacctggccacgaggaaccgatccccatggccacatatggctggaacctggtgaaactgcattctgggaaggacgtcttctttatccctcccgagaaatgtgataccctcctttgcgacattggagaaagctcccctaatcccacgatcgaggagggccgcaccctgcgggggctgaagatggttgaaccgtggctcagaggaaaccagttctgtattaagatcctgaatccttacatgccctctgtggtggagacacttgaacaaatgcagcgcaaacacggcgggatgctggtccggaaccccctcagcagaaattccacccacgagatggattgggtgagctgcggaacaggcaacattgtttctgcggtgaacatgacctcccgcatgctgctgaatcggtttacaatggcccatagaaagcctacctacgagcgcgacgtcgatctcggcgctgggacgcggcacgtggccgttgaacccgaggtggctaacctggacatcattggacagagaatcgaaaatatcaaaaacgagcataagagcacatggcactatgatgaagacaatccttacaaaacctgggcctatcacggctcttacgaggtcaagccgtccgggagcgcttcttccatggtgaacggagtggtccgccttctgaccaagccctgggatgttattcctatggtgacacaaatcgccatgacggacaccacacccttcggccagcagagagtgtttaaagagaaggtcgatacccggacacctcgcgcgaaaagagggaccacacagattatggaagtgaccgccaagtggctctggggcttcctgagccggaataaaaagcccagaatctgtacgcgggaggaatttacccgcaaggttagatccaacgctgccattggagctgtggtcgtggacgagaatcaatggaacagcgccaaagaagccggcgaggacgagcgggtttgggatcttggggaccgcgaaagagagctgcataagcagggaaaatgcgcgacatgtggctataatatgatggggaagcgggagaagaagctcggagagttcggcaaggctaaagggtctcgcgccatctggtacatgtggctgggcgccagatttctggagttcgaggctctcggattcatgaacgaggatcactggtttagccgggaaaattccctgtctggcgtggagggggaaggacttcataagctgggctatatcctccgcgacattagcaaaatccccgggggaaacatgtacgccgatgacaccgctggctgggatacaagaattaccgaggacgatctgcagaatgaggccaagatcacggacattatggaacctgagcacgcgcttctggccacatccatcttcaaactcacctaccagaacaaggtcgtgcgggttcaacgccccgctaaaaacgggacagtgatggatgtcatctctagacgggcccagcgcggcagcggacaggtgggcacctatgggctgaatacgtttaccaacatggaagtccagctgattagacaaatggagtccgaaggaatcttcctcccttctgagctggagacacccaatcttgctgaacgggtgctggactggctcgagaagcatggcgccgaaagactgaagcgcatggcgattagcggggatgactgcgttgtgaaacctatcgacgatcggtttgccaccgctcttacagccctgaacgacatgggaaaggtcagaaaagatattccccagtgggagccgtccaagggctggaatgactggcaacaggtggctttctggagccaccactttcatcaactcatcatgaaagatgggcgcgaaatcgtggttccttgccggaaccaggacgagctgggcggcagagctcgcgtgtctcagggagctgggtggtccctgcgggagaccgcctgtctcggaaagagctacgcgcaaatgtggcagctgatgtatttccacagacgcgatcttcggctggccgctaatgccatttgctctgccgtccccgtggactgggttcccacatccagaaccacgtggagcatccatgctcaccaccagtggatgacaaccgaagatatgctctccgtgtggaaccgcgtctggattgaggaaaatccttggatggaggacaagacccatgtgtctagctgggaagaggtcccgtacctgggcaaacgggaggatcagtggtgtgggtcccttatcggactgacagccagagcgacctgggctacaaacattcaagtggccatcaatcaggttcggagactcattggcaacgaaaattatctggactacatgacgagcatgaagcgctttaaaaacgagtctgaccccgaaggcgccctgtggtga

SEQ ID NO: 18689 - RNA, 9879 nt, synthetic construct
  misc_feature 1..9879: note = derived and/or modified CDS sequence (opt5) from DENV-1__FJ182002__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcaccggacaactgacatggaatgacctgattagactttgcatcatggtgggcgccaacgcttccgatcgcatgggcatggggacgacctatctggccctcatggcgacatttaaaatgagacctatgttcgctgttggactgctctttcggcgcctgacctctagagaggtgcttctgctcacaattggcctgagcctggtcgcctccgtggaacttcccaactctctggaggaactcggggacggactggccatgggcatcatgatgctcaagctgcttaccgagttccagccccaccagctgtggacgacactcctgagcctgacctttatcaaaaccacactttccctggattacgcttggaagaccacagccatggctctcagcattgtgtctctgttccctctctgtctgtccacgaccagccagaaaacaacctggcttccggtcctgctggggtcttttggatgcaagcccctcacaatgttcctgatcaccgaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacgtctcacaacatcctggtggaagttcaggacgatgggaccatgaagattaaagacgaggagcgcgatgacacacttaccatcctgctcaaggctacactgctcgcggtgagcggagtctaccccatgtccatccctgccaccctgtttgtgtggtatttctggcagaaaaagaagcagagatctggcgttctttgggatacacccagcccgcctgaagtggagcgggctgtcctggacgatggcatttaccgcatcctgcaaagagggctcctgggacggtcccaggtgggcgtcggggtgttccaggacggagtttttcatacgatgtggcacgtgacccgcggcgccgtccttatgtatcaggggaaaagactggaaccctcttgggccagcgtgaagaaagacctcatttcctacggaggcggctggcggttccaagggagctggaatacaggagaggaggttcaggtgatcgctgtcgaacctggcaagaaccccaaaaatgtgcagaccaccccggggacatttaagacgcctgagggagaagtgggcgccattgcgctggatttcaagcccgggacctctggatcccctatcgttaacagagagggcaaaattgtcggcctctacgggaatggagtggtgacaaccagcggcacatatgtctctgctatcgcccaagccaaggcttcccaggaagggcccctgcccgagatcgaggacgaagtgtttaaaaagcgcaaccttaccattatggatctgcaccctggaagcggcaaaacgcggagatacctgccggccatcgttcgcgaggcgattaagcggaagctcagaacactgatccttgctcccacccgcgtggtcgcctccgaaatggccgaggctctgaaagggatgcctattcggtatcagaccacagccgtgaagtctgaacataccggcagagagatcgttgacctcatgtgccacgctacattcaccatgcgcctgctgagccccgtgcgggtccctaattacaacatgatcattatggatgaggcccattttacggaccccgcgtccatcgccgctagaggatatattagcacacgggtgggcatgggggaagccgctgccatcttcatgaccgccacacctccgggatctgttgaggcttttccccagtccaatgcggtgattcaagatgaagagcgcgacatccctgaaagaagctggaactctggctacgattggatcaccgacttccccgggaaaacggtctggtttgtgcctagcattaagtccggaaatgatatcgccaactgtctccggaaaaacggcaagcgcgtgattcagctttctagaaagaccttcgacacagagtatcagaaaaccaagaataacgactgggattacgtcgttacaaccgacatcagcgagatgggggctaatttccgggccgatagagtgattgacccccgccggtgcctgaaaccggtgatcctgaaggatggccctgaaagagtcattctcgccggacccatgcccgtgacagttgcttccgccgcgcagcgccggggcagaatcgggcgcacccaaacgaaagagggagaccagtacgtgtatatgggccagcctctgaacaatgatgaagaccacgctcattggacagaggccaagatgcttctggccaacatcaatacccccgaggggattatccctgctctctttgaaccggagcgggaaaagtctcccgccattgatggagagtacagactgcgcggcgaagcgagaaaaaccttcgtcgagctgatgcggcgcggggacctccctgtgtggcttagctataaggttgcctccgagggctttcagtacagcgatagacggtggtggttcgacggagaacgcaacaatcaagtgctggaggaaaacatggatgtcgagatctggacaaaagaaggcgagagaaagaaactgcggcccagatggctcgacgctcgcacctattctgaccctctggcccttggggagtttaaggaattcggagctggccggagatccgggagcggagatctgattctcgagatcggcaaactgccccagcacctgacactccgcgcccagaatggccttgacaacctggtgatggtccacaattccgaacaggggggaaaggcttaccggcatgccatggaggaactgccggatacgatcgagaccctcatgctgcttgcgctgattgccgtgctcacaggcggggttaccctgtttttcctgtctggaaagggcctcgggaaaacaagcatcggacttctgtgcgtgaccgcttcctctgccctgctctggatggctagcgtggagcctcactggattgccgcctccatcattctggaatttttccttatggtcctgctcatccccgagcctgacagacaacggacgccccaggataaccagctggcttatgttgtgatcggcctgctctttatgattcttaccgtggcggccaatgaaatgggcctgctggagacaaccaagaaagacctcgggatcggacatgtcgctgccgagaaccaccaacacgccacaatgctggatgtggaccttcgccctgctagcgcctggaccctgtacgcggttgccacgacagtgattacccccatgatgagacatacaatcgaaaacaccaccgctaatatttctctcacagccatcgctaaccaggccgcgattctgatgggcctggataaggggtggccgatctccaaaatggacatcggagtccctctccttgccctgggctgttacagccaggtgaatcccctgacgctcaccgctgccgtcctgatgcttgtggctcactatgccattatcgggcccggactgcaggctaaggccacacgggaggcgcaaaagcgcaccgccgctggcattatgaaaaaccctacagttgatggcatcgtggccattgacctcgatccggtcgtgtacgacgctaagttcgaaaaacagctggggcagatcatgctgctcatcctttgcacctctcagattctgctgatgagaacgacatgggccctctgtgagtccatcaccctggccaccggaccccttacaaccctgtgggaaggcagccctgggaagttttggaatacaacgattgcggtttctatggctaacatcttccggggaagctatctcgccggcgctgggctggccttctccctgatgaaatctctcggaggcggccgcagagggaccggagcccaaggcgagacacttggggagaagtggaagcggcagctgaatcagctgagcaaatccgaatttaacacctacaagcgcagcggaattatggaggtggacagatccgaagctaaagagggcctcaagcggggggaaacaaccaaacatgccgtctctagaggaacggcgaagctgcgctggttcgtggagcggaatcttgtgaagcccgagggcaaagttatcgatctgggctgcgggagaggaggctggagctattactgtgccgggctcaagaaagtcaccgaagtgaagggatatacaaaaggcgggcctggacacgaggaacccatccctatggctacctacggctggaacctggtgaagctgcattccggcaaagacgtctttttcatgccgcccgagaagtgcgatacactcctttgtgacattggggaatctagccctaatcccaccatcgaggagggacgcacactgcgggttctgaagatggtggaaccttggctcagaggcaaccagttttgcattaaaatcctgaatccctacatgccgtccgtggtcgagacccttgaacaaatgcagcgcaagcacgggggaatgctggtgcggaaccctctctctagaaatagcacgcacgagatgtattgggtttcctgtggcacagggaacattgtgagcgccgtcaatatgacctctcgcatgctgctgaaccggttcaccatggctcatagaaaacccacatacgagcgcgatgtggacctcggagccggcacgcggcacgttgcggtggaacccgaggtcgccaacctggatatcattggccagagaatcgaaaatatcaagaacgagcataaatccacctggcactatgacgaagataatccttacaagacatgggcttatcacgggagctacgaggtgaagccctctggatccgccagctctatggtgaacggcgtcgttcgccttctgaccaaaccttgggacgtgattccgatggtgacacaaatcgctatgaccgatacaaccccctttgggcagcagagagtcttcaaggagaaagtggacacgcggacccctcgcgccaagagaggaacaacccagattatggaagttacagctaaatggctctggggctttctgtcccggaataagaagcccagaatctgcacccgggaggaattcacgcgcaaagtgagaagcaacgccgcgattggggccgtctttgtggacgagaatcaatggaactccgctaaggaagccggcgaggatgagcgggtttgggaccttgtggatcgcgaaagagagctgcataaacagggaaagtggggcacagggggatataatatgatgggcaaacgggaaaagaagctcggggagttcggaaaagctaagggcagccgcgggatctggtacatgtggctgggcgccagatttctggaattcgaggccctcggattcatgaacgaggaccactggttttctcgggaaaatagcctgtccggcgtcgagggggaaggacttcataaactgggctacatcctccgcgatatttctaagatccctgggggaaacatgtatgcggacgataccgctggctgggacacaagaattaccgaggatgacctgcagaatgaggccaaaatcacggatattatggaacccgagcacgcccttctggctaccagcatcttcaagctcacataccagaacaaagtggttcgggtgcaacgcccggccaagaatgggaccgtcatggacgtgatctccagacgggatcagcgcggctctggacaggtcggcacatatgggctgaacacctttacaaacatggaagtgcagctgattagacaaatggagagcgaaggaatcttcctcccttccgagctggagacccccaatcttgctgaacgggttctggactggctcgagaagcatggcgccgaaagactgaaacgcatgcctatttctggggacgattgtgtggtcaagcccatcgacgatcggtttgcgacggcccttacagctctgaacgacatgggaaaagtgagaaaggatattcctcagtgggagcccagcaaaggctggaatgactggcagcaggtgccgttctggtcccaccactttcatcaactcatcatgaaggatgggcgcgaaatcgttgtgccttgccggaaccaggacgagctggtcggcagagcccgcgtgagccagggagctggctggtctctgcgggagaccgcctggctcgggaagtcctacgcgcaaatgggacagctgatgtatttccacagacgcgatcttcggctggccgctaatgccatttggagcgctggccccggggactgggttcccacctctagaacaacctggtccatccatgcccaccaccagtggatgacaacggaagatatgctcagcgtgtggaaccgcgtctggattgaggaaaatccttggatggaggacaaaacccatgtgtcctcttgggaagaggtcccgtacctgggaaagcgggaggaccagtggtgcggcagccttatcggcctgacagctagagccacctgggcgacaaacattcaagtggccatcaatcaggttcggagactcattgggaacgaaaattatctggattacatgacctccatgaaacgctttaagaacgagagcgaccccgaaggagctctgtggtga

SEQ ID NO: 18690 - RNA, 9879 nt, synthetic construct
  misc_feature 1..9879: note = derived and/or modified CDS sequence (opt5) from DENV-1__FJ024482__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttcctcacccaggacgaaaagggggtgacacagaacggaagactgatcacggctaatcccattgtcaccgataaagagaagcctgtgaacatcgaaacagagcccccctttggcgagtcttatattgtggttggggccggagaaaaagccctgaagctctcctggttcaagaaaggcagctctatcgggaagatgtttgaggctaccgcccggggcgctagacgcatggccattctgggagacacagcgtgggatttcggcagcatcgggggagtctttacctccgtgggcaaacttgtgcatcaggtcttcgggacggcctacggagtgctgttttctggcgttagctggaccatgaagatcgggattggcatcctcctgacatggctgggacttaattcccggagcacctctctctccatgacatgtattgctgtgggcatggtcaccctgtacctgggggtgatggttcaagccgacagcggatgcgtgatcaactggaaaggcagagaactcaagtgtgggtctggaattttcgtcacaaacgaggtgcacacctggacggaacagtataagtttcaggctgattcccctaaacgcctgagcgccgcgatcggcaaggcctgggaggagggggtttgcggcattcggtccgctacaagacttgaaaatatcatgtggaaacagatctctaacgagctgaatcatattctcctggaaaacgacatgaagttcaccgtggtcgtgggagacgccaatggcatcctggctcaagggaaaaagatgattcgcccgcagcccatggagcacaaatacagctggaagtcctggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggcttaagctcagagactcttacacccaaatgtgcgatcaccgcctgatgagcgcggccattaaagactccaaggctgtccatgccgatatgggctattggatcgaaagcgagaaaaacgaaacatggaagctggcccgggcttctttcatcgaggttaagacctgtacatggcccaaatcccacaccctctggagcaatggggtgctggaatctgagatgattatcccgaagatttacggaggccctatctcccagcataactatagacccgggtacttcacgcagaccgccggaccttggcaccttggcaaactggagctcgactttgatctgtgcgaagggacaaccgtggtcgtggacgagcactgcggaaatcgcggccccagcctgcggacaaccacggttacaggcaagattatccatgaatggtgttgcagatcttgtacccttcctcccctccggttccgcggggaggatggatgctggtacggcatggagatcagaccggtgaaagaaaaggaggaaaacctggtccggagcatggtgtccgcggggagcggagaggttgactctttttccctgggcattctctgtgctagcatcatgattgaagaggtgatgagatcccgctggtctcggaagatgctgatgacagggacccttgccgtcttcctgctcctgatcatgggacaactgacctggaatgaccttattagactgtgcatcatggtgggcgccaacgctagcgatcgcatgggcatggggacaacgtatctcgccctgatggcgacctttaaaatgagacctatgttcgctgttggactcctgtttcggcgccttacatccagagaggtgctgctcctgaccattggcctgtctcttgtcgccagcgtggaactgcccaactccctcgaggaactgggggacggactcgccatgggcatcatgatgctgaagcttctgacagagttccagccccaccagctctggaccacgctgctgtctcttacatttatcaaaaccaccctgagcctcgattacgcttggaagacaaccgccatggctctgtccattgtgagcctcttccctctgtgtctttctacaacgtcccagaaaaccacatggctgccggtcctgctcgggagctttggatgcaagcccctgaccatgttccttatcacagaaaataagatttggggccggaaatcttggcctctgaacgagggcatcatggccattgggatcgtttccatcctcctgagctctctcctgaagaatgacgtgccccttgcgggacctctgattgccggcgggatgctgatcgcttgttatgtgatttccggaagctccgccgatctcagcctggagaaagctgccgaagtctcttgggagcaagaagccgagcatagcggcacctcccacaacatccttgtggaagttcaggacgatgggacgatgaagattaaagacgaggagcgcgatgacaccctgacaatcctcctgaaggctaccctcctggcggtgtctggagtctaccccatgagcatccctgccacactttttgtgtggtatttctggcagaaaaagaagcagagatccggcgttctgtgggataccccctctccgcctgaagtggagcgggctgtcctggacgatggcatttaccgcatcctccaaagagggctgcttggacggagccaggtgggcgtcggggtgttccaggacggagtttttcatacaatgtggcacgtgacgcgcggcgccgtcctgatgtatcaggggaaaagactcgaaccctcctgggcctctgtgaagaaagacctgattagctacggaggcggctggcggttccaagggtcctggaataccggagaggaggttcaggtgatcgctgtcgaacctggcaagaaccccaaaaatgtgcagacaaccccggggacctttaagacacctgagggagaagtgggcgccattgcgctcgatttcaagcccgggacgagcggatctcctatcgttaacagagagggcaaaattgtcggcctgtacgggaatggagtggtgaccacatccggcacctatgtcagcgctatcgcccaagccaaggcttctcaggaagggccccttcccgagatcgaggacgaagtgtttaaaaagcgcaacctgacaattatggatctgcaccctggatccggcaaaacccggagatacctcccggccatcgttcgcgaggcgattaagcggaagctgagaacgcttatcctggctcccacacgcgtggtcgccagcgaaatggccgaggctctcaaagggatgcctattcggtatcagaccaccgccgtgaagtccgaacatacaggcagagagatcgttgacctgatgtgccacgctaccttcacaatgcgcctgctctctcccgtgcgggtccctaattacaacatgatcattatggatgaggcccattttaccgaccccgcgagcatcgccgctagaggatatatttccacgcgggtgggcatgggggaagccgctgccatcttcatgacagccacccctccgggaagcgttgaggcttttccccagtctaatgcggtgattcaagatgaagagcgcgacatccctgaaagatcctggaacagcggctacgattggatcacagacttccccgggaaaaccgtctggtttgtgccttctattaagagcggaaatgatatcgccaactgtcttcggaaaaacggcaagcgcgtgattcagctgtccagaaagacgttcgacaccgagtatcagaaaacaaagaataacgactgggattacgtcgttaccacagacatctctgagatgggggctaatttccgggccgatagagtgattgacccccgccggtgcctgaaaccggtgatcctcaaggatggccctgaaagagtcattctggccggacccatgcccgtgaccgttgctagcgccgcgcagcgccggggcagaatcgggcgcaaccaaaataaagagggagaccagtacgtgtatatgggccagcctcttaacaatgatgaagaccacgctcattggacagaggccaagatgctgctcgataacatcaatacccccgaggggattatccctgccctgtttgaaccggagcgggaaaagtccgctgccattgacggagagtacagactgcgcggcgaagcgagaaaaacgttcgtcgagctcatgcggcgcggggatcttcccgtgtggctgtcttataaggttgccagcgagggctttcagtactccgacagacggtggtgcttcgatggagaacgcaacaatcaagtgctggaggaaaacatggacgtcgagatctggcctaaagaaggcgagagaaagaaactccggcccagatggctggacgctcgcacatatagcgatcctcttgccctgcgggagtttaaggaattcgctgccgggagacgctctgtgtccggagacctcattctggagatcggcaaactgccccagcacctcacccttcgggctcagaatgccctggataacctggtcatggtgcacaatagcgaacaggggggaaaggcgtacagacatgccatggaggaactcccggacaccatcgagacactgatgcttctggctctcattgccgttctgaccggcggcgtgacactgtttttcctctccgggaagggacttggcaaaacgtctatcgggctgctgtgtgtgaccgctagctccgccctcctgtggatggcctctgtcgagcctcactggattgctgcgagcatcattcttgaatttttcctgatggttctcctgatccccgagcctgatcggcaacgcacaccccaggacaaccagctggcctatgtggtgatcggactcctttttctgattctgaccgtcgctgccaacgaaatgggcctcctggagacaaccaagaaagatcttgggatcggacatgtggccgctgagaatcaccaacacgccacgatgctggacgttgatctcagacctgcgtccgcctggaccctgtacgctgtggccacaaccgtcattacacccatgatgcggcataccatcgaaaacacgacagctaatattagcctgaccgccatcgcgaaccaggccgctattctcatgggccttgacaagggctggccgatctctaaaatggatatcggggtgcctctgctggccctcggatgctactcccaggtcaatcccctgacacttaccgctgccgtgctgatgctcgttgctcactatgccattatcggccccgggctgcaggcgaaggccacccgcgaggctcaaaagagaacagccgctggaattatgaaaaaccctacggtggacggcatcgtcgccattgatctggacccggtggtttacgacaccaagttcgaaaaacagctcgggcagatcatgcttctgatcctgtgtacaagccagattctcctgatgcggaccacatgggccctttgcgagtctatcaccctggcgacgggacccctcacaaccctgtgggaaggctcccctggcaagttttggaataccacaattgctgtgagcatggccaacatcttccgcgggtcttatctggctggagccggcctcgccttcagccttatgaaatccctggggggaggcagacgggggaccggagctcaaggcgagacactgggcgagaagtggaagcgccagctcaatcagctgtctaaaagcgaatttaacacgtacaagagatccgggattatggaggtcgatcggagcgaagccaaagagggacttaagagaggcgaaaccacaaaacatgcggtgtcccgcgggaccgccaagctgcggtggttcgtggagagaaatctcgttaagcccgagggaaaagtcatcgacctgggctgtgggcgcggaggctggtcttattactgcgctggcctgaagaaagtgacagaagtgaaggggtataccaaaggaggccctgggcacgaggaacccatccctatggccacgtacggatggaacctcgtcaagcttcatagcggcaaagatgtttttttcatgccgcccgagaagtgtgacaccctgctgtgcgatattggggaatcctctcctaatcccacaatcgaggagggacggaccctcagagtgctgaagatggtggaaccttggcttcgcggcaaccagttttgtattaaaatcctgaatccctacatgccgagcgtcgtggagacactcgaacaaatgcagcggaagcacggcgggatgctggttagaaaccctctgtcccgcaattctacccacgagatgtattgggtgagctgcggaacaggcaacattgtctccgctgtgaacatgaccagccggatgctcctgaatagattcacgatggcccatcgcaaacccacatacgagcgggacgttgatcttggggcgggaaccagacacgtggccgtcgaacccgaggtggctaacctggacatcattggccagcgcatcgaaaatatcaagaacgagcataaatctacctggcactatgatgaagacaatccttacaagacatgggcctatcacgggtcctacgaggtgaagcccagcggatctgcttccagcatggtcaacggcgttgtgagactcctgacgaaaccttgggatgtgattccgatggtcacccaaatcgccatgacagacaccacaccctttggccagcagcgggtgttcaaggagaaagttgacacccgcacacctagagctaagcgggggaccacgcagattatggaagtgaccgccaaatggctttggggatttctgtctagaaataagaagccccggatctgtacacgcgaggaattcaccagaaaagtccggtccaacgcggccattggcgctgtgtttgttgatgagaatcaatggaacagcgccaaggaagctgtggaggacgagcgcttctgggatctcgtccatagagaacgggagctgcacaaacaggggaagtgcgccacatgcgtgtataatatgatgggaaaacgcgaaaagaagctgggcgagtttgggaaagccaagggctccagagcgatctggtacatgtggctcggagctcggttcctggaattcgaggcccttggctttatgaacgaggaccattggttcagccgcgaaaattcttttagcggggttgagggagaaggcctgcacaaactcgggtacatcctgagagatatttccaagatccctggaggcaacatgtatgccgacgataccgctgggtgggacacgcggattacagaggatgaccttcagaatgaggccaaaatcaccgatattatggaacccgagcatgctctgctcgccacatctatcttcaagctgacctaccagaacaaagtggtccgcgtgcaaagaccggcgaagaacggcacggtcatggacgtgatcagccggcgcgcccagagaggatccggccaggttgggacctatggactgaatacatttaccaacatggaagtgcagctcattcggcaaatggagtctgaaggcatcttcctgcctagcgagcttgagacacccaatctggctgaaagagtcctcgattggctggagaagcacggggccgaacgccttaaacggatggctatttccggagacgactgtgtggtgaagcctatcgatgacagatttgccaccgcgctgacagccctcaacgctatgggcaaagttcgcaaggatattccccagtgggagccttctaaagggtggaatgactggcagcaggtgcccttctgcagccaccattttcaccaactgatcatgaaggatggccgggaaatcgtcgtgccgtgtagaaaccaggacgagctggttggacgcgcccgggtgtcccagggcgctgggtggagcctcagagagaccgcctgcctgggaaagtcttacgctcaaatgtggcagcttatgtatttccatcgccgggatctgagactcgccgcgaatgccatttgttccgctgtccctgtggactgggtccccacgagccgcacaacctggtctatccacgcccaccatcagtggatgaccacagaagatatgctgtccgtgtggaaccgggtttggattgaggaaaatccctggatggaggacaaaacccacgtgagctcctgggaagaggtcccttaccttggcaagagagaggatcagtggtgcgggtctctgatcggactcacagcccgggctacgtgggccaccaacattcaagtggcgatcaatcaggttagacgcctgattggcaacgaaaattatctggactacatgacaagcatgaaacggtttaagaacgagtccgacccggaaggggctctctggtga

SEQ ID NO: 18691 - RNA, 9879 nt, synthetic construct
  misc_feature 1..9879: note = derived and/or modified CDS sequence (opt5) from DENV-1__EU596501__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgctccctctgtgtctttccacaacgagccagaaaaccacatggctgccggtcctgctcgggtctttcggatgcaagcccctgaccatgtttcttatcacagaaaataagatttggggccggaaatcctggcctctgaacgagggcatcatggccattgggatcgttagcatcctcctgtcttccctcctgaagaatgacgtgccccttgcgggacctctgattgccggcgggatgctgatcgcttgttatgtgattagcggatccagcgccgatctctctctggagaaagctgccgaagtcagctgggagcaagaagccgagcattccggcacctctcacaacatccttgtggaagttcaggacgatgggacgatgaagattaaagacgaggagcgcgatgacaccctgacaatcctcctgaaggctaccctcctggcggtgagcggagtctaccccatgtccatccctgccacacttttcgtgtggtatttttggcagaaaaagaagcagagatctggcgttctgtgggatacccccagcccgcctgaagtggagcgggctgtcctggacgatggcatttaccgcatcatgcaaagagggctcctgggacggtcccaggtgggcgtcggggtgttccaggacggagttttccatacaatgtggcacgtgacgcgcggcgccgtccttatgtatcaggggaaaagactggaaccctcttgggccagcgtgaagaaagacctcatttcctacggaggcggctggcggtttcaagggagctggaataccggagaggaggttcaggtgatcgctgtcgaacctggcaagaaccccaaaaatgtgcagacaaccccggggaccttcaagacactggagggagaagtgggcgccattgcgctcgattttaagcctgggacgtctggatcccccatcgttaacagagagggcaaaattgtcggcctgtacgggaatggagtggtgaccacaagcggcacctatgtctctgctatcgcccaagccaaggcttcccaggaagggcctcttcccgagatcgaggacgaagtgttcaaaaagcgcaacctgacaattatggatctgcaccccggaagcggcaaaacccggagatacctccctgccatcgttcgcgaggcgattaagcggaagctgagaacgcttatcctggctccgacacgcgtggtcgcctccgaaatggccgaggctctcaaagggatgcccattcggtatcagaccaccgccgtgaagtctgaacatacaggcagagagatcgttgacctgatgtgccacgctacctttacaatgcgcctgctcagccctgtgcgggtccccaattacaacatgatcattatggatgaggcccatttcaccgaccctgcgtccatcgccgctagaggatatattagcacgcgggtgggcatgggggaagccgctgccatctttatgacagccaccccccctggatctgttgaggctttcccgcagtccaatgcggtgattcaagatgaagagcgcgacatccccgaaagaagctggaactctggctacgattggatcacagactttcctgggaaaaccgtctggttcgtgcccagcattaagtccggaaatgatatcgccaactgtcttcggaaaaacggcaagcgcgtgattcagctgtctagaaagacgtttgacaccgagtatcagaaaacaaagaataacgactgggattacgtcgttaccacagacatcagcgagatgggggctaatttccgggccgatagagtgattgaccctcgccggtgcctgaaacccgtgatcctcaaggatggcccggaaagagtcattctggccggacctatgcccgtgaccgttgcttccgccgcgcagcgccggggcagaatcgggcgcaaccaaaataaagagggagaccagtacgtgtatatgggccagccccttaacaatgatgaagaccacgctcattggacagaggccaagatgctgctcgataacatcaatacccctgaggggattatccccgccctgttcgaacctgagcgggaaaagtctgctgccattgacggagagtacagactgcgcggcgaagcgagaaaaacgtttgtcgagctcatgcggcgcggggatcttccggtgtggctgagctataaggttgcctccgagggcttccagtacagcgacagacggtggtgctttgatggagaacgcaacaatcaagtgctggaggaaaacatggacgtcgagatctggacaaaagaaggcgagagaaagaaactccggcccagatggctggacgctcgcacctattctgatcctcttgccctgcgggagttcaaggaatttgctgccgggagacgctccgtgagcggagacctcattctggagatcggcaaactgccccagcacctcacccttcgggctcagaatgccctggataacctggtcatgctccacaattccgaacaggggggaaaggcgtacagacatgccatggaggaactgcctgacacaatcgagacccttatgctgctcgctctgattgccgtgctgacaggcggcgttacgctcttctttctttctgggaagggactgggcaaaaccagcatcgggctgctctgtgtgacagcttcctctgccctgctttggatggccagcgtggagccccactggattgctgcgtccatcattctggaattctttctcatggtcctgctgatcccggagcctgatcggcaacgcaccccccaggacaaccagctcgcctatgttgtgatcggacttctgttcatgattctgacagtggctgccaacgaaatgggcctcctggagaccacgaagaaagatcttgggatcggacatgtcgccgctgagaatcaccaacacgccaccatgctggacgtggatctcagacctgcgagcgcctggacactgtacgctgttgccaccacagtgattacccccatgatgcggcatacgatcgaaaacacaaccgctaatatttctctgacagccatcgcgaaccaggccgctattctcatgggccttgacaagggctggcctatctccaaaatggatatcggggtccccctgctggccctcggatgctacagccaggtgaatccgctgacccttaccgctgccgtcctgatgctcgtggctcactatgccattatcggccctgggctgcaggcgaaggccacacgcgaggctcaaaagagaacggccgctggaattatgaaaaaccccaccgttgacggcatcgtggccattgatctggaccccgtcgtgtacgacgccaagtttgaaaaacagctcgggcagatcatgcttctgatcctgtgtacatctcagattctcctgatgcggaccacatgggcgctttgcgagtccatcaccctggctacgggacctctcacaaccctgtgggaaggcagcccgggcaagttctggaataccacaattgccgtttctatggctaacatctttcgcgggagctatctggccggagccggcctcgctttctcccttatgaaatctctggggggaggcagacgggggaccggagcccaaggcgagacactgggcgagaagtggaagcgccagctcaatcagctgagcaaatccgaattcaacacgtacaagagaagcgggattatggaggtggatcggtccgaagcgaaagagggacttaagagaggcgaaaccacaaaacatgccgtctctcgcgggaccgctaagctgcggtggtttgtggagagaaatctcgtgaagcccgagggaaaagttatcgacctgggctgtgggcgcggaggctggagctattactgcgccggcctgaagaaagtcacagaagtgaaggggtataccaaaggaggccctgggcacgaggaacccatccctatggctacgtacggatggaacctcgtgaagcttcattccggcaaagatgtcttctttatgccccctgagaagtgtgacaccctgctgtgcgatattggggaatctagcccgaatcccacaatcgaggagggacggaccctcagagttctgaagatggtggaaccttggcttcgcggcaaccagttctgtattaaaatcctgaatccctacatgccttccgtggtcgagacactcgaacaaatgcagcggaagcacggcgggatgctggtgagaaaccccctgtctcgcaatagctcccacgagatgtattgggttagctgcggaaccggcaacattgtgtctgccgtcaacatgacatcccggatgctcctgaatagatttaccatggcgcatcgcaaaccgacgtacgagcgggacgtggatcttggggccggaacaagacacgttgctgtggaacctgaggtcgccaacctggacatcattggccagcgcatcgaaaatatcaagaacgagcataaaagcacctggcactatgatgaagacaatccctacaagacctgggcttatcacgggtcttacgaggtgaagccctccggaagcgcctcttccatggtgaacggcgtcgttagactcctgacaaaaccttgggatgtgattcccatggtgacgcaaatcgctatgaccgacacaacccctttcggccagcagcgggtctttaaggagaaagtggacacacgcaccccgagagccaagcgggggacaacccagattatggaagttacggcgaaatggctttggggattcctgagcagaaataagaagccccggatctgtacccgcgaggaatttacaagaaaagtgcggtccaacgccgctattggcgccgtcttcgtggatgagaatcaatggaacagcgctaaggaagccgttgaggacgagcgcttttgggatctcgtgcatagagaacgggagctgcacaaacaggggaagtgcgccacctgcgtctataatatgatgggaaaacgcgaaaagaagctgggcgagttcgggaaagcgaagggctctagagctatctggtacatgtggctcggagcccggtttctggaattcgaggcccttggcttcatgaacgaggaccattggtttagccgcgaaaattccctgtctggggtggagggagaaggcctccacaaactggggtacatccttagagatattagcaagatccctggaggcaacatgtatgctgacgatacagccgggtgggacacccggattacggaggatgacctgcagaatgaggctaaaatcacagatattatggaacccgagcatgccctcctggcgacctccatcttcaagctgacataccagaacaaagttgtgcgcgtccaaagacctgccaagaacggcaccgtgatggacgtcatctctcggcgcgatcagagaggaagcggccaggtggggacgtatggactcaatacctttacaaacatggaagttcagctgattcggcaaatggagtccgaaggcatcttccttccctctgagctggagaccccgaatctcgctgaaagagtgctggactggcttgagaagcacggggccgaacgcctgaaacggatggctattagcggagacgattgtgtcgtgaagcctatcgacgatagatttgccacagcgctcaccgccctgaacgacatgggcaaagtgcgcaaggatattccccagtgggagccttccaaagggtggaatgactggcagcaggttcccttctgcagccaccattttcaccaactgatcatgaaggatggccgggaaatcgtggtcccttgtagaaaccaggacgagctcgtgggacgcgctcgggtttctcagggcgccgggtggtccctgagagagacagcttgccttggaaagagctacgcccaaatgtggcagctgatgtatttccatcgccgggatctcagactggctgccaatgcgatttgttctgccgtgcccgtcgactgggtgccgacctcccgcacgacatggagcatccacgctcaccatcagtggatgaccaccgaagatatgctttccgtctggaaccgggtgtggattgaggaaaatccttggatggaggacaaaacacacgtttctagctgggaagaggtgccctacctgggcaagagagaggaccagtggtgcgggtccctcatcggactgaccgcccgggccacatgggctacgaacattcaagtcgccatcaatcaggtgagacgcctgattggcaacgaaaattatctcgattacatgaccagcatgaaacggtttaagaacgagtctgaccccgaaggggcgctgtggtga

SEQ ID NO: 18692 - RNA, 9879 nt, synthetic construct
  misc_feature 1..9879: note = derived and/or modified CDS sequence (opt5) from DENV-1__FJ898437__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaagaacgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggagttcgctgccgggagacgctccgtgagcggagacctgattctcgagatcggcaaactgcctcagcacctgaccctccgggctcagaatgcccttgataacctggtcatgctgcacaattccgaacaagggggaaaggcgtacagacatgccatggaggaactccccgacacaatcgagaccctgatgcttctggctctcattgccgtgctgacaggcggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgtgaccatgcttgacgttgatctgagacccgccagcgcgtggacactctacgccgtggctaccacagtcattacccctatgatgcggcatacgatcgaaaacacaaccgccaatatttctctgacagctatcgccaaccaggcggccattctgatgggcctcgacaagggctggcccatctccaaaatggatatcggggtgccgcttctggctctgggatgctacagccaggtcaatcctctcaccctgaccgccgctgtgcttatgctggttgcccactatgctattatcggccccgggctccaggccaaggcgacacgcgaggcccaaaagagaacggctgccggaattatgaaaaaccccaccgtggacggcatcgtcgctattgatctggaccctgtggtttacgacgccaagttcgaaaaacagctggggcagatcatgctccttatcctgtgtacatctcagattctgctcatgcggaccacatgggccctgtgcgagtccatcacccttgcgacgggaccgctgacaaccctctgggaaggcagccccggcaagttttggaataccacaattgctgtgtctatggccaacatcttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacacgtacaagagaagcgggattatggaggtcgatcggtccgaagccaaagagggactgaagagaggcgaaaccacaaaacatgcggtgtctcgcgggaccgccaaacttcggtggttcgtggagagaaatctggttaagcctgagggaaaagtcatcgacctcggctgtgggcgcggaggctggagctattactgcgctggcctgaagaaagtgacagaagtgaaggggtataccaaaggaggccccgggcacgaggaacctatccccatggccacgtacggatggaacctggtcaagctccattccggcaaagatgtgtttttcatgcctccggagaagtgtgacacccttctgtgcgatattggggaatctagccccaatcctacaatcgaggagggacggaccctgagagttctcaagatggtggaaccctggctgcgcggcaaccagttttgtattaaaatccttaatccttacatgccctccgtcgtggagacactggaacaaatgcagcggaagcacggcgggatgctcgttagaaacccgctgtctcgcaatagcacccacgagatgtattgggtgtcctgcggaacaggcaacattgtcagcgctgtgaacatgacctctcggatgctgctcaatagattcacgatggcccatcgcaaacctacatacgagcgggacgttgatctgggggcgggaaccagacacgtggccgtcgaacccgaggtggctaaccttgacatcattggccagcgcatcgaaaatatcaagaacgagcataaatccacctggcactatgatgaagacaatccctacaagacatgggcctatcacgggagctacgaggtgaagccttctggatccgctagctctatggtcaacggcgttgtgagactgctcacgaaaccctgggatgtgattcctatggtcacccaaatcgccatgacagacaccacaccgtttggccagcagcgggtgttcaaggagaaagttgacacccgcacacccagagctaagcgggggaccacgcagattatggaagtgaccgccaaatggctgtggggatttctttccagaaataagaagcctcggatctgtacacgcgaggagttcaccagaaaagtccggagcaacgcggccattggcgctgtgtttatcgatgagaatcaatggaactccgccaaggaagctgttgaggacgagcgcttctgggatctggtgcatagagaacgggagctccacaaacaggggaagtgcgccacatgcgtctataatatgatgggaaaacgcgaaaagaagctgggcgagtttgggaaagccaagggcagcagagcgatctggtacatgtggctgggagctcggttcctcgagttcgaggccctgggctttatgaacgaggaccattggttctctcgcgaaaatagcctttccggggtggagggagaaggcctgcacaaactcgggtacattctgagagatatctctaagattcccggaggcaacatgtatgccgacgataccgctgggtgggacacgcgggttacagaggatgaccttcagaatgaggccaaaatcaccgatattatggaacctgagcatgctctgctcgccacaagcatctttaagctgacctaccagaacaaagtggtccgcgtgcaaagacccgcgaagaacggcacggtcatggacgtgatctcccggcgcgatcagagaggatctggccaggttgggacctatggactgaatacattcaccaacatggaagtgcagctcattcggcaaatggagagcgaaggcatctttctgccgtccgagcttgagacacctaatctggccgaaagagtcctcgactggctggagaagcacggggctgaacgccttcggagaatggccatttctggagacgattgtgtggtgaaacccatcgacgatcgcttcgctaccgccctgacagcgctcaacgacatgggcaaggttcggaaagatattcctcagtgggagcccagcaaggggtggaatgactggcaacaggtgcctttttgctcccaccatttccaccaactgatcatgaaagatggcagagaaatcgtcgtgccctgtcgcaaccaggacgagctggttggacgggccagagtgagccagggcgctgggtggtctctccgcgagaccgcctgcctgggaaagtcctacgctcaaatgtggcagcttatgtattttcatcggagagatctgcgcctcgccgctaatgccatttgtagcgcggtcccggtggactgggtccctacgtctcggacaacctggtccatccacgcccaccatcagtggatgaccacagaagatatgctgagcgtgtggaacagagtttggattgaggaaaatccctggatggaggacaagacccacgtgtcctcttgggaagaggtcccctaccttggcaaacgggaggaccagtggtgcgggagcctgatcggactcacagctagagccacgtgggccaccaacattcaagtggctatcaatcaggttcgccggctgattggcaacgaaaattatctggattacatgacatccatgaagagattcaaaaacgagagcgaccctgaaggggccctctggtga

SEQ ID NO: 18693 - RNA, 9879 nt, synthetic construct
  misc_feature 1..9879: note = derived and/or modified CDS sequence (opt5) from DENV-1__FJ024480__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctgatggcctccgtcgaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtgctgctggggtcttttggatgcaagcccctcaccatgttcctgatcacagaaaataagatttggggccggaaatcctggcctcttaacgagggcatcatggccattgggatcgtcagcatcctgctctcttccctgctcaagaatgacgttcccctggcgggacctcttattgccggcgggatgctgatcgcttgttatgtgattagcggatccagcgccgatctgtctctcgagaaagctgccgaagtgagctgggagcaagaagccgagcattccggcacctctcacaacatcctggtcgaagtgcaggacgatgggacgatgaagattaaagacgaggagcgcgatgacacccttacaatcctgctcaaggctaccctgctcgcggttagcggagtgtaccccatgtccatccctgccacactgtttgtctggtatttctggcagaaaaagaagcagagatctggcgtgctttgggatacccccagcccgcctgaagttgagcgggctgtgctggacgatggcatttaccgcatcctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatttcctacggaggcggctggcggttccaagggagctggaataccggagaggaggtgcaggttatcgctgtggaacctggcaagaaccccaaaaatgtccagacaaccccggggacctttaagacacctgagggagaagtgggcgccattgcgctggatttcaagcccgggacgtctggatcccctatcgtgaacagagagggcaaaattgttggcctctacgggaatggagtcgtgaccacaagcggcacctatgtgtctgctatcgcccaagccaaggcttcccaggaagggcccctgcccgagatcgaggacgaagtctttaaaaagcgcaaccttacaattatggatctgcaccctggaagcggcaaaacccggagatacctgccggccatcgtgcgcgaggcgattaagcggaagctcagaacgctgatccttgctcccacacgcgttgtggcctccgaaatggccgaggctctgaaagggatgcctattcggtatcagaccaccgccgtcaagtctgaacatacaggcagagagatcgtggacctcatgtgccacgctaccttcacaatgcgcctgctgagccccgttcgggtgcctaattacaacatgatcattatggatgaggcccattttaccgaccccgcgtccatcgccgctagaggatatattagcacgcgggtcggcatgggggaagccgctgccatcttcatgacagccacccctccgggatctgtggaggcttttccccagtccaatgcggttattcaagatgaagagcgcgacatccctgaaagaagctggaactctggctacgattggatcacagacttccccgggaaaaccgtgtggtttgtccctagcattaagtccggaaatgatatcgccaactgtctccggaaaaacggcaagcgcgtgattcagctttctagaaagacgttcgacaccgagtatcagaaaacaaagaataacgactgggattacgtggtcaccacagacatcagcgagatgggggctaatttccgggccgatagagttattgacccccgccggtgcctgaaaccggtgatcctgaaggatggccctgaaagagtgattctcgccggacccatgcccgtcaccgtggcttccgccgcgcagcgccggggcagaatcgggcgcaaccaaaataaagagggagaccagtacgtttatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatctggacaaaagaaggcgagagaaagaaactgcggcctagatggctcgacgctcgcacctattctgatcccctggcccttcgggagtttaaggaattcgctgccgggagacgctccgtcagcggagacctgattctcgagatcggcaaactgcctcagcacctgaccctccgggctcagaatgcccttgataacctggtgatgctgcacaattccgaacaggggggaaaggcgtacagacatgccatggaggaactccccgacacaatcgagaccctgatgcttctggctctcattgccgtcctgacaggcggcgtgacgctgtttttcctctctgggaagggacttggcaaaaccagcatcgggctgctgtgtgttacagcttcctctgccctcctgtggatggccagcgtggagccgcactggattgctgcgtccatcattcttgaatttttcctgatggtgctcctgatccctgagcccgatcggcaacgcacccctcaggacaaccagctggcctatgtcgttatcggactcctttttatgattctgacagtggctgccaacgaaatgggcctgctcgagaccacgaagaaagatctggggatcggacatgtggccgctgagaatcaccaacacgccaccatgcttgacgtcgatctgagacccgcgagcgcctggacactctacgctgtggccaccacagttattacccctatgatgcggcatacgatcgaaaacacaaccgctaatatttctctgacagccatcgcgaaccaggccgctattctgatgggcctcgacaagggctggcccatctccaaaatggatatcggggtgccgcttctggccctgggatgctacagccaggtcaatcctctcaccctgaccgctgccgtgcttatgctggtcgctcactatgccattatcggccccgggctccaggcgaaggccacacgcgaggctcaaaagagaacggccgctggaattatgaaaaaccccaccgtggacggcatcgttgccattgatctggaccctgtggtctacgacgccaagttcgaaaaacagctggggcagatcatgctccttatcctgtgtacatctcagattctgctcatgcggaccacatgggcgctgtgcgagtccatcacccttgctacgggaccgctgacaaccctctgggaaggcagccccggcaagttttggaataccacaattgccgtgtctatggctaacatcttccgcgggagctatctggccggagccggcctggctttctccctcatgaaatctcttgggggaggcagacgggggaccggagcccaaggcgagacactgggcgagaagtggaagcgccagctgaatcagctcagcaaatccgaatttaacacgtacaagagaagcgggattatggaggttgatcggtccgaagcgaaagagggactgaagagaggcgaaaccacaaaacatgccgtgtctcgcgggaccgctaagcttcggtggttcgtcgagagaaatctggtgaagcctgagggaaaagtgatcgacctcggctgtgggcgcggaggctggagctattactgcgccggcctgaagaaagttacagaagtcaaggggtataccaaaggaggccccgggcacgaggaacctatccccatggctacgtacggatggaacctggtgaagctccattccggcaaagatgtgtttttcatgcctccggagaagtgtgacacccttctgtgcgatattggggaatctagccccaatcctacaatcgaggagggacggaccctgagagtcctcaagatggttgaaccctggctgcgcggcaaccagttttgtattaaaatccttaatccttacatgccctccgtggtggagacactggaacaaatgcagcggaagcacggcgggatgctcgtcagaaacccgctgtctcgcaatagcacccacgagatgtattgggtgtcctgcggaacaggcaacattgttagcgccgtgaacatgacctctcggatgctgctcaatagattcacgatggcgcatcgcaaacctacatacgagcgggacgtcgatctgggggccggaaccagacacgtggctgttgaacccgaggtggccaaccttgacatcattggccagcgcatcgaaaatatcaagaacgagcataaatccacctggcactatgatgaagacaatccctacaagacatgggcttatcacgggagctacgaggtcaagccttctggatccgccagctctatggtgaacggcgtggtcaaactgctcacgaagccctgggatgttattcctatggtgacccaaatcgctatgacagacaccacaccgtttggccagcagagagtgttcaaagagaaggtcgacacccggacaccccgcgccaaaagagggaccacgcagattatggaagtgaccgcgaagtggctgtggggatttctttcccggaataagaaacctagaatctgtacacgggaggaattcacccgcaaggttagaagcaacgccgctattggcgccgtgtttgtcgatgagaatcaatggaactccgctaaagaagccgtggaggacgagcggttctgggatctggttcatcgcgaaagagagctccacaagcaggggaaatgcgccacatgcgtgtataatatgatgggaaagcgggaaaagaaactgggcgagtttgggaaggcgaaaggcagccgcgctatctggtacatgtggctgggagccagattcctcgaattcgaggccctgggctttatgaacgaggaccattggttctctcgggaaaatagcctttccggggtcgagggagaaggcctgcacaagctcgggtacatcctgcgcgatatttctaaaatccccggaggcaacatgtatgctgacgataccgccgggtgggacacgagaattacagaggatgaccttcagaatgaggctaagatcaccgatattatggaacctgagcatgccctgctcgcgacaagcatctttaaactgacctaccagaacaaggtggttcgggtgcaacgccccgccaagaacggcacggtcatggacgtgatctccagacgggatcagcgcggatctggccaggtcgggacctatggactgaatacattcaccaacatggaagtgcagctcattagacaaatggagagcgaaggcatctttctgccgtccgagcttgagacacctaatctggctgaacgggttctcgactggctggagaaacacggggccgaaagacttaagcgcatggctatttctggagacgattgtgtggtcaaacccatcgacgatcggttcgccaccgcgctgacagccctcaacgacatgggcaaggtgagaaaagatattcctcagtgggagcccagcaaggggtggaatgactggcagcaggtgcctttttgctcccaccatttccaccaactgatcatgaaggatggccgcgaaatcgttgtgccctgtcggaaccaggacgagctggtcggaagagctcgcgtgagccagggcgccgggtggtctctccgggagaccgcttgcctgggaaaatcctacgcccaaatgtggcagcttatgtattttcatagacgcgatctgcggctcgctgccaatgcgatttgtagcgccgttccggtggactgggtccctacgtctagaacaacctggtccatccacgctcaccatcagtggatgaccacagaagatatgctgagcgtgtggaaccgcgtctggattgaggaaaatccctggatggaggacaagacccacgtgtcctcttgggaagaggttccctaccttggcaaacgggaggaccagtggtgcgggagcctgatcggactcacagccagagccacgtgggctaccaacattcaagtggccatcaatcaggtccggagactgattggcaacgaaaattatctggattacatgacatccatgaagcgcttcaaaaacgagagcgaccctgaaggggcgctctggtga

SEQ ID NO: 18694 - RNA, 9879 nt, synthetic construct
  misc_feature 1..9879: note = derived and/or modified CDS sequence (opt5) from DENV-1__FJ873814__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtggtcgcctttttcctggcgcatgccatcgggacatctattacccaaaagggaatcatctttattctcctgatgcttgtgacccctagcatggctatgcgctgcgttggcatcgggaacagagatttcgtggagggactgtccggcgccacatgggtcgacgtggtgctcgagcacgggagctgtgtcacgaccatggctaagaataaacccacactggatattgaactgctcaagaccgaggttacaaaccctgccatcctgcggaaactttgcattgaagcgaagatctctaataccacgacagactcccgctgtccgacccagggagaggccaccctggtggaagagcaggatgctaactttgtgtgcagacggacattcgtcgaccgcggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcaacatcaggttgggaatgagacaaccgaacacggaacaatcgctattatcaccccccaggcccctacgtccgagattcagctgaccgactacggcgccctgacactcgactgtagccccagaaccggcctggattttaacgaaatggtgcttctgacaatgaaggagaaatcttggctcgtccataagcaatggttcctggaccttcctctgccctggacctccggggctagcacgtcccaggagacatggaatcggcaggatctcctggtgacctttaaaacagcgcacgccaagaagcaagaagtcgtggttctgggatctcaggagggcgctatgcacaccgccctcaccggggccacagaaatccagacgagcggaaccacaaccattttcgctggccatctgaaatgccgccttaagatggacaaactgacactcaaggggacctcctatgtgatgtgtacgggcagcttcaaactggagaaggaagtcgccgagacacagcacggaaccgtgctggttcaagtgaagtacgagggcaccgatgcgccgtgcaaaatccctttttctacacaggacgaaaagggggtcacccagaacggaagacttatcacagctaatcccattgtgacggataaagagaagcctgtgaacatcgaaaccgagccccccttcggcgagtcctatattgttatcggggccggagaaaaagccctcaagctgagctggtttaagaaaggctctagcattgggaagatgttcgaggctacagcccggggcgctagacgcatggccatcctgggagacaccgcgtgggattttggctccatcgggggagtcttcacatctgtgggcaaactcgtgcatcaggtctttgggaccgcctacggagtgctgttcagcggcgtttcctggacgatgaagattgggatcggcattcttctgacctggctcggactgaatagccggtctacatccctgagcatgacctgtatcgctgtgggcatggtcacactttacctcggggtgatggttcaagccgactctggatgcgtgattaactggaaaggcagagaactgaagtgtgggtccggaatctttgtcaccaacgaggtgcacacatggaccgaacagtataagttccaggctgatagccctaaacgcctgtccgccgcgattggcaaggcctgggaggagggggtttgcggcatccggtctgctacgagactcgaaaatatcatgtggaaacagattagcaacgagctgaatcatatccttctggaaaacgacatgaagtttacagtggtcgtgggagacgccaatggcattctcgctcaagggaaaaagatgatccgcccgcagcccatggagcacaaatactcctggaagtcttggggaaaggccaaaattatcggcgccgatatccagaacaccaccttcattatcgacgggcctgatacacccgaatgtcctgacgatcagcgggcttggaatatttgggaggtggaggactatggatttggcatcttcaccacgaacatttggctgaagctgagagatagctacacacaaatgtgcgaccaccgccttatgtccgcggccatcaaagatagcaaggctgtccatgccgacatgggctattggatcgaatctgagaaaaatgaaacctggaagctcgcccgggcttccttcattgaggttaagacatgtacctggcccaaaagccacacactgtggtctaacggggtgctggaatccgagatgatcattccgaagatctacggaggccctattagccagcataattatagacccgggtactttacccagacggccggaccttggcacctcggcaaactggagcttgatttcgacctgtgcgaagggaccacagtggtcgtggatgagcactgcggaaaccgcggcccctctctccggaccacaaccgttacgggcaagatcatccatgaatggtgttgcagaagctgtacactgcctcccctgcggtttcgcggggaggacggatgctggtacggcatggagattagaccggtgaaagaaaaggaggaaaatcttgtccggtccatggtgagcgcggggtctggagaggttgactccttcagcctcggcatcctgtgtgcttccattatgatcgaagaggtgatgagatctcgctggagccggaagatgctgatgaccgggacactcgccgtctttctgcttctgattatgggacaactcacctggaacgatctgatcagactgtgcattatggtgggcgccaatgcttccgaccgcatgggcatggggaccacatatcttgccctgatggcgacgttcaaaatgagacctatgtttgctgttggactcctgttccggcgcctcacctctagagaggtgctgcttctgacaatcggcctcagcctggtcgcctccgtggaactgcccaactctcttgaggaactgggggatggactcgccatgggcatcatgatgctgaagctcctgaccgagtttcagccccaccagctttggacaaccctgctcagcctgacgttcattaaaacaaccctgtcccttgactacgcttggaagaccacagccatggctctgagcatcgtgtctctctttcctctgtgtctctccaccacaagccagaaaacgacctggctgccggtccttctggggtctttcggatgcaagcccctgacaatgtttctcattaccgaaaacaagatctggggccggaaatcctggcctctgaatgagggcattatggccatcgggatcgttagcattcttctgtcttccctcctgaagaacgatgtgcccctcgcgggacctctgatcgccggcgggatgcttattgcttgttatgtgatcagcggatccagcgccgacctgtctctggagaaagctgccgaagtcagctgggagcaagaagccgagcattccggcacatctcacaatattctcgtggaagttcaggatgacgggaccatgaagatcaaagatgaggagaaggacgatacgctgaccatccttctgaaagctacactcctggcggtgagcggagtctaccccatgtccattcctgccaccctcttcgtgtggtatttctggcagaagaagaaacagcgctctggcgttctgtgggacacacccagcccgcctgaagtggagagagctgtccttgatgacggcatctaccggattctgcaacgcgggctgctcggaagatcccaggtgggcgtcggggtgtttcaggacggagttttccataccatgtggcacgtgacacggggcgccgtcctgatgtatcaggggaagcgccttgaaccctcttgggccagcgtgaaaaaggatctgatctcctacggaggcggctggagatttcaagggagctggaacacgggagaggaggttcaggtgattgctgtcgaacctggcaaaaatcccaagaacgtgcagaccacaccggggaccttcaagacccctgagggagaagtgggcgccatcgcgctcgactttaaacccgggacatctggatcccctattgttaatcgggagggcaagatcgtcggcctgtacgggaacggagtggtgacgaccagcggcacatatgtctctgctatcgcccaagccaaagcttcccaggaagggcccctccccgagattgaggatgaagtgttcaagaaaagaaatctgaccatcatggaccttcaccctggaagcggcaagacacgccggtacctgccggccattgttagagaggcgatcaagcgcaaactgcggaccctcattctggctcccacgagagtggtcgcctccgaaatggccgaggctcttaaggggatgcctatccgctatcagacaaccgccgtgaaatctgaacataccggccgggagatcgttgatctgatgtgccacgctacatttaccatgagactcctgagccccgtgcgcgtccctaactacaatatgattatcatggacgaggcccatttcacagatcccgcgtccattgccgctcggggatatatcagcaccagagtgggcatgggggaagccgctgccatttttatgacggccacacctccgggatctgttgaggctttcccccagtccaacgcggtgatccaagacgaagagcgggatatccctgaacgcagctggaattctggctacgactggattaccgattttcccgggaagacagtctggttcgtgcctagcatcaaatccggaaacgacattgccaattgtctgagaaagaacggcaagcgggtgatccagctctctcgcaaaaccttcgacacggagtatcagaagaccaaaaacaatgattgggactacgtcgttacaaccgatattagcgagatgggggctaactttagagccgaccgggtgatcgatcccagacgctgccttaagccggtgattctgaaagacggccctgaacgggtcatcctggccggacccatgcccgtgacagttgcttccgccgcgcagagacgcggccggatcgggagaaatcaaaacaaggagggagatcagtacgtgtatatgggccagcctctcaataacgacgaagatcacgctcattggaccgaggccaagatgctgcttgacaatattaacacacccgaggggatcattcctgccctgttcgaaccggagcgcgaaaaatctgctgccatcgatggagagtaccggctcagaggcgaagcgcgcaagacctttgtcgagctgatgagacggggggacctgcccgtgtggctcagctataaagttgcctccgagggcttccagtacagcgatcgcagatggtgctttgacggagaacggaataaccaagtgcttgaggaaaatatggacgtcgagatttggacgaaggaaggcgagcgcaaaaagctgagacctcggtggctggatgctagaacatattctgaccccctcgccctgcgcgagttcaaagaatttgctgccgggcggagatccgtgagcggagatcttatcctggagatcggcaagctccctcagcacctgaccctgcgcgctcagaacgccctcgacaatcttgtcatgctgcacaactccgaacaggggggaaaggcgtaccggcatgccatggaggaactgcccgataccattgagacactcatgctgcttgctctgatcgccgtgctcaccggcggcgttacactgttctttctgtctgggaaaggactcggcaagacgagcattgggcttctgtgtgtgaccgcttcctctgccctgctctggatggccagcgtggagccgcactggatcgctgcgtccattatcctggaattctttcttatggtcctgctcatccctgagcccgacagacaacggacacctcaggataatcagctggcctatgttgtgattggactgctcttcatgatccttaccgtggctgccaacgaaatgggcctgctggagacaaccaaaaaggacctcgggattggacatgtcgccgctgagaaccaccaacacgccacgatgctggatgtggaccttcgccccgcgagcgcctggaccctgtacgctgttgccacaaccgtgatcacacctatgatgagacataccattgaaaatacgacagctaacatctctctcaccgccattgcgaatcaggccgctatcctgatgggcctggataaaggctggcccatctccaagatggacattggggtcccgctccttgccctgggatgctacagccaggtgaaccctctgacactcaccgctgccgtcctgatgcttgtggctcactatgccatcattggccccgggctgcaggcgaaggccacccgggaggctcaaaaacgcacagccgctggaatcatgaagaatcccacggttgatggcattgtggccatcgacctcgaccctgtcgtgtacgatgccaaatttgaaaagcagctggggcagatcatgctgctcattctttgtacctctcagatcctgctgatgagaacaacctgggcgctctgcgagtccattacactggctaccggaccgcttacgacactgtgggaaggcagccccggcaaattctggaacaccaccatcgccgtttctatggctaatattttccgggggagctatctcgccggagccggcctggctttttccctgatgaagtctctcgggggaggccgcagagggacaggagcccaaggcgagacccttggcgagaagtggaaacggcagctgaaccagctgagcaagtccgaattcaatacatacaaacgcagcgggatcatggaggtggacagatccgaagcgaaggagggactcaaacggggcgaaacgaccaagcatgccgtctctagagggacagctaagctgcgctggtttgtggagcggaaccttgtgaaacctgagggaaaggttatcgatctgggctgtgggagaggaggctggagctattactgcgccggcctcaaaaaggtcaccgaagtgaaagggtatacaaagggaggccccgggcacgaggaatccattcctatggctacctacgcctggaatctggtgaaactgcattctggaaaggacgtcttctttatgccccctgagaagtgtgatacgctcctttgcgacatcggcgaaagctccccgaaccccaccattgaggaggggcgcacactgcgggttctgaaaatggtggaaccttggctcagaggaaatcagttctgtatcaagattctgaacccctacatgccttctgtggtcgagacccttgaacaaatgcagcgcaaacacggcggcatgctggtgcggaatcccctcagcagaaactccacacacgagatgtattgggttagctgcgggaccggaaatatcgtgtctgcggtcaacatgacatcccgcatgctgctgaaccggtttaccatggcccatagaaagccgacgtacgagcgcgatgtggacctcggcgctgggacacggcacgttgccgtggaacctgaggtcgctaatctggatattatcggacagagaatcgaaaacattaaaaatgagcataagagcacctggcactatgacgaagataacccctacaagacctgggcctatcacggctcttacgaggtgaaaccctccgggagcgcttcttccatggtgaatggagtcgttcgccttctgacaaagccttgggacgtgatccccatggtgacgcaaattgccatgaccgacacaacccctttcggccagcagagagtctttaaagagaaggtggatacacggaccccgcgcgcgaaaagaggcacaacccagatcatggaagttacggccaagtggctctgggggttcctgagccggaacaagaaacccagaatttgtacccgggaggaatttacacgcaaggtgagatccaatgctgccatcggagctgtcttcgtggacgagaaccaatggaatagcgccaaagaagccgttgaggatgagcggttttgggaccttgtgcatcgcgaaagagagctgcacaagcagggcaaatgcgcgacctgcgtctataacatgatggggaagcgggaaaagaaactcggagagttcggcaaggctaaagggtctcgcgccatctggtacatgtggctgggcgccagattcctggaatttgaggctctcggattcatgaatgaggatcattggtttagccgggaaaactccctgtctggcgtggagggggaaggacttcacaagctgggctacattctccgcgacatcagcaaaattcctgggggaaatatgtatgccgatgacacagctggctgggataccagaatcacggaggacgatctgcagaacgaggccaagattacagacatcatggaacccgagcatgcgcttctggccacctccatcttcaaactcacataccagaataaggttgtgcgggtccaacgccctgctaagaacgggaccgtgatggatgtcatttctagacgggaccagcgcggcagcggacaggtgggcacgtatgggctgaacacctttacaaatatggaagttcagctgatcagacaaatggagtccgaaggaattttcctcccctctgagctggagaccccgaaccttgccaaacgggtgctggactggctcgaaaagcacggcgctgagagactgaaacgcatggccatcagcggggatgactgtgtcgtgaagcctattgatgaccggtttgcgacagcccttaccgctctgaatgatatgggaaaagtgagaaaggacatcccccagtgggaaccttccaagggctggaacgattggcagcaggttcccttctgcagccaccattttcaccaactcatcatgaaagacgggcgcgagattgtggtcccttgtcggaatcaggatgaactggtgggcagagcccgcgtttctcagggagctggctggtccctgcgggagacagcctgcctcgggaagagctacgctcaaatgtggcagctgatgtatttccatagacgcgaccttcggctggccgcgaacgccatctgttctgctgtgcccgtcgattgggtgccgacctccagaacgacatggagcattcacgcccaccatcagtggatgaccaccgaggacatgctctccgtctggaatcgcgtgtggatcgaagagaacccttggatggaagacaaaacacacgtttctagctgggaggaagtgccctacctgggaaagcgggaggatcagtggtgcggctcccttattgggctgaccgccagagctacatgggccacgaatatccaagtcgcgattaaccaggtgcggagactcatcggaaatgagaactatctggactacatgaccagcatgaaacgctttaagaatgaatctgatcccgagggcgctctgtggtga

SEQ ID NO: 18695 - RNA, 9879 nt, synthetic construct
  misc_feature 1..9879: note = derived and/or modified CDS sequence (opt5) from DENV-1__JN819403__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaagtctctgctttttaagacaagcgccggcgttaacatgtgcaccctgattgcgatggacctcggggagctgtgtgaagatacaatgacctacaagtgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattgtgtctctgttccctctctgtctgtccacaacgagccagaaaaccacatggcttccggtcctgctggggtcttttggatgcaagcccctcaccatgttcctgatcacagaaaataagatttggggccggaaatcctggcctcttaacgagggcatcatggccattgggatcgttagcatcctgctctcttccctgctcaagaatgacgtgcccctggcgggacctcttattgccggcgggatgctgatcgcttgttatgtgattagcggatccagcgccgatctgtctctcgagaaagctgccgaagtcagctgggagcaagaagccgagcattccggcacctctcacaacatcctggtggaagttcaggacgatgggacgatgaagattaaagacgaggagcgcgatgacacccttacaatcctgctcaaggctaccctgctcgcggtgagcggagtctaccccatgtccatccctgccacactgtttgtgtggtatttctggcagaaaaagaagcagagatctggcgttctttgggatacccccagcccgcctgaagtggagcgggctgtcctggacgatggcatttaccgcatcctgcaaagagggctcctgggacggtcccaggtgggcgtcggggtgttccaggacggagtttttcatacaatgtggcacgtgacgcgcggcgccgtccttatgtatcaggggaaaagactggaaccctcttgggccagcgtgaagaaagacctcatttcctacggaggcggctggcggttccaagggagctggaataccggagaggaggttcaggtgatcgctgtcgaacctggcaagaaccccaaaaatgtgcagacaaccccggggacctttaagacacctgagggagaagtgggcgccattgcgctggatttcaagcccgggacgtctggatcccctatcgttaacagagagggcaaaattgtcggcctctacgggaatggagtggtgaccacaagcggcacctatgtctctgctatcgcccaagccaaggcttcccaggaagggcccctgcccgagatcgaggacgaagtgtttaaaaagcgcaaccttacaattatggatctgcaccctggaagcggcaaaacccggagatacctgccggccatcgttcgcgaggcgattaagcggaagctcagaacgctgatccttgctcccacacgcgtggtcgcctccgaaatggccgaggctctgaaagggatgcctattcggtatcagaccaccgccgtgaagtctgaacatacaggcagagagatcgttgacctcatgtgccacgctaccttcacaatgcgcctgctgagccccgtgcgggtccctaattacaacatgatcattatggatgaggcccattttaccgaccccgcgtccatcgccgctagaggatatattagcacgcgggtgggcatgggggaagccgctgccatcttcatgacagccacccctccgggatctgttgaggcttttccccagtccaatgcggtgattcaagatgaggaacgcgacatccctgaaagaagctggaactctggctacgattggatcacagacttccccgggaaaaccgtctggtttgtgcctagcattaagtccggaaatgatatcgccaactgtctccggaaaaacggcaagcgcgtgattcagctttctagaaagacgttcgacaccgagtatcagaaaacaaagaataacgactgggattacgtcgttaccacagacatcagcgagatgggggctaatttccgggccgatagagtgattgacccccgccggtgcctgaaaccggtgatcctgaaggatggccctgaaagagtcattctcgccggacccatgcccgtgaccgttgcttccgccgcgcagcgccggggcagaatcgggcgcaaccaaaataaagagggagaccagtacgtgtatatgggccagcctctgaacaatgatgaagaccacgctcattggacagaggccaagatgcttctggataacatcaatacccccgaggggattatccctgccctctttgaaccggagcgggaaaagtctgctgccattgacggagagtacagactgcgcggcgaagcgagaaaaacgttcgtcgagctgatgcggcgcggggatctccccgtgtggcttagctataaggttgcctccgagggctttcagtacagcgacagacggtggtgcttcgatggagaacgcaacaatcaagtgctggaggaaaacatggacgtcgagatctggacaaaagaaggcgagagaaagaaactgcggcctagatggctcgacgctcgcacctattctgatcccctggcccttcgggagtttaaggagttcgctgccgggagacgctccgtgagcggagacctgattctcgagatcggcaaactgcctcagcacctgaccctccgggctcagaatgcccttgataacctggtcatgctgcacaattccgaacaaggcgggaaggcgtacagacatgccatggaggaactccccgacacaatcgagaccctgatgcttctggctctcattgccgtgctgacagggggcgttacgctgtttttcctctctgggaagggacttggcaaaaccagcatcgggctgctgtgtgtgacagcttcctctgccctcctgtggatggccagcgtggagccgcactggattgctgcgtccatcattcttgaatttttcctgatggtcctcctgatccctgagcccgatcggcaacgcacccctcaggacaaccagctggcctatgttgtgatcggactcctttttatgattctgacagtggctgccaacgaaatgggcctgctcgagaccacgaagaaagatctggggatcggacatgtcgccgctgagaatcaccaacacgccaccatgcttgacgtggatctgagacccgcgagcgcctggacactctacgctgttgccaccacagtgattacccctatgatgcggcatacgatcgaaaacacaaccgctaatatttctctgacagccatcgcgaaccaggccgctattctgatgggcctcgacaagggctggcccatctccaaaatggatatcggggtcccgcttctggccctgggatgctacagccaggtgaatcctctcaccctgaccgctgccgtccttatgctggtggctcactatgccattatcggccccgggctccaggcgaaggccacacgcgaggctcaaaagagaacggccgctggaattatgaaaaaccccaccgttgacggcatcgtggccattgatctggaccctgtcgtgtacgacacaaagttcgaaaaacagctggggcagatcatgctccttatcctgtgtacctctcagattctgctcatgcggacaacctgggccctgtgcgagtccatcacgcttgcgacaggaccgctgaccaccctctgggaaggcagccccggcaagttttggaatacaaccattgctgtttctatggccaacatcttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacacctacaagagaagcgggattatggaggtggatcggtccgaagccaaagagggactgaagagaggcgaaacaaccaaacatgcggtctctcgcgggacagccaaacttcggtggttcgtggagagaaatctggtgaagcctgagggaaaagttatcgacctcggctgtgggcgcggaggctggagctattactgcgctggcctgaagaaagtcaccgaagtgaaggggtatacgaaaggaggccccgggcacgagggacctatccccatggccacctacggctggaacctggtgaagctccattccgggaaagatgtctttttcatgcctccggaaaagtgtgacacacttctgtgcgatattggagagtctagccccaatcctaccatcgaagagggccggacactgagagttctcaagatggtggagccctggctgcgcggcaaccagttttgtattaaaatccttaatccttacatgccctccgtggtcgaaaccctggagcaaatgcagcggaagtatgggggaatgctcgtgagaaacccgctgtctcgcaatagcacacacgaaatgtactgggtttcctgcggcaccgggaacattgtgagcgctgtcaacatgacgtctcggatgctgctcaatagattcacaatggcccaccgcaaacctacctatgagcgggacgtggatctgggagcgggcaccagacatgttgccgtggagcccgaagtcgctaaccttgacatcattgggcagcgcatcgagaatatcaagaacgaacacaaatccacatggcattacgatgaggacaatccctataagacgtgggcctaccacggaagctatgaagtgaagccttctggctccgctagctctatggtgaacggcgtcgttagactgctcaccaaaccctgggatgtgattcctatggtgacacaaatcgccatgaccgacacaaccccgtttgggcagcagcgggtcttcaaggagaaagtggacacacgcacccccagagctaagcggggaacgacccagattatggaggttacagccaaatggctgtggggctttctttccagaaataagaagcctcggatctgtacccgcgaagagttcacaagaaaagtgcggagcaacgcggccattggggctgtctttgtggatgaaaatcaatggaactccgccaaggaggctgttgaagacgagcgcttctgggatctggtgcacagagagcgggaactccataaacagggaaagtgcgctacctgcgtctacaatatgatgggcaaacgcgagaagaagctgggggaatttggcaaagccaagggaagcagagcgatctggtacatgtggctgggcgctcggttcctcgagttcgaagccctggggtttatgaacgaggaccactggttctctcgcgagaatagcctttccggagtggaaggcgaggggctgcataaactcggatatatcctgagagatatttctaagatccccggcgggaacatgtacgccgacgatacggctggctgggacacacggattaccgaagatgaccttcagaatgaggccaaaatcacagatattatggagcctgaacacgctctgctcgccaccagcatctttaagctgacgtatcagaacaaagttgtgcgcgtccaaagacccgcgaagaacggaaccgtgatggacgtcatctcccggcgcgatcagagaggctctggacaggtgggaacatacggcctgaataccttcacaaacatggaggttcagctcattcggcaaatggaaagcgaggggatctttctgccgtccgaacttgagacccctaatctggccgagagagtgctcgactggctggaaaagcatggagctgagcgccttaaacggatggccatttctggcgacgattgtgtcgtgaagcccatcgacgatagattcgctacagccctgaccgcgctcaacgacatggggaaagtgcgcaaggatattcctcagtgggaacccagcaaaggctggaatgactggcagcaggttcctttttgctcccaccacttccatcaactgatcatgaaggatggacgggagatcgtggtcccctgtagaaaccaggacgaactggtgggccgcgcccgggttagccagggggctggatggtctctcagagagacggcctgcctgggcaagtcctatgctcaaatgtggcagcttatgtactttcaccgccgggatctgagactcgccgctaatgccatttgtagcgcggtgccggtcgactgggtgcctacatctcgcaccacctggtccatccatgcccaccaccagtggatgacaaccgaggatatgctgagcgtctggaaccgggtgtggattgaagagaatccctggatggaagacaaaacacatgtttcctcttgggaggaagtgccctatcttgggaagagagaggaccagtggtgcggaagcctgatcggcctcacggctcgggccacctgggccacaaacattcaagtcgctatcaatcaggtgagacgcctgattgggaacgagaattacctggattacatgacctccatgaaacggttcaagaacgaaagcgaccctgagggcgccctctggtga

SEQ ID NO: 18696 - RNA, 9879 nt, synthetic construct
  misc_feature 1..9879: note = derived and/or modified CDS sequence (opt5) from DENV-1__KF973453__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattatctctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggccatcgggatcgtcagcattctgctctcttccctgctcaagaatgacgttcccctggcgggacctcttatcgccggcgggatgctgattgcttgttatgtgatcagcggatccagcgccgatctgtctctcgagaaagctgccgaagtgagctgggagcaagaagccgagcattccggcacctctcacaacattctggtcgaagtgcaggacgatgggacgatgaagatcaaagacgaggagcgcgatgacacccttacaatcctgctcaaggctaccctgctcgcggttagcggagtgtaccccatgtccattcctgccacactgtttgtctggtatttctggcagaaaaagaagcagagatctggcgtgctttgggatacccccagcccgcctgaagttgagcgggctgtgctggacgatggcatctaccgcattctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatctcctacggaggcggctggcggttccaagggagctggaataccggagaggaggtgcaggttattgctgtggaacctggcaagaaccccaaaaatgtccagacaaccccggggacctttaagacacctgagggagaagtgggcgccatcgcgctggatttcaagcccgggacgtctggatcccctattgtgaacagagagggcaaaatcgttggcctctacgggaatggagtcgtgaccacaagcggcacctatgtgtctgctatcgcccaagccaaggcttcccaggaagggcccctgcccgagattgaggacgaagtctttaaaaagcgcaaccttacaatcatggatctgcaccctggaagcggcaaaacccggagatacctgccggccattgtgcgcgaggcgatcaagcggaagctcagaacgctgattcttgctcccacacgcgttgtggcctccgaaatggccgaggctctgaaagggatgcctatccggtatcagaccaccgccgtcaagtctgaacatacaggcagagagatcgtggacctcatgtgccacgctaccttcacaatgcgcctgctgagccccgttcgggtgcctaattacaacatgattatcatggatgaggcccattttaccgaccccgcgtccattgccgctagaggatatatcagcacgcgggtcggcatgggggaagccgctgccattttcatgacagccacccctccgggatctgtggaggcttttccccagtccaatgcggttatccaagatgaagagcgcgacatccctgaaagaagctggaactctggctacgattggattacagacttccccgggaaaaccgtgtggtttgtccctagcatcaagtccggaaatgatattgccaactgtctccggaaaaacggcaagcgcgtgatccagctttctagaaagacgttcgacaccgagtatcagaaaacaaagaataacgactgggattacgtggtcaccacagacattagcgagatgggggctaatttccgggccgatagagttatcgacccccgccggtgcctgaaaccggtgattctgaaggatggccctgaaagagtgatcctcgccggacccatgcccgtcaccgtggcttccgccgcgcagcgccggggcagaatcgggcgcaaccaaaataaagagggagaccagtacgtttatatgggccagcctctgaacaatgatgaagaccacgctcattggacagaggccaagatgcttctggataacattaatacccccgaggggatcattcctgccctctttgaaccggagcgggaaaagtctgctgccatcgacggagagtacagactgcgcggcgaagcgagaaaaacgttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatttggacaaaagaaggcgagagaaagaaactgcggcctagatggctcgacgctcgcacctattctgatcccctggcccttcgggagtttaaggaattcgctgccgggagacgctccgtcagcggagacctgatcctcgagatcggcaaactgcctcagcacctgaccctccgggctcagaatgcccttgataacctggtgatgctgcacaattccgaacaggggggaaaggcgtacagacatgccatggaggaactccccgacacaattgagaccctgatgcttctggctctcatcgccgtcctgacaggcggcgtgacgctgtttttcctctctgggaagggacttggcaaaaccagcattgggctgctgtgtgttacagcttcctctgccctcctgtggatggccagcgtggagccgcactggatcgctgcgtccattatccttgaatttttcctgatggtgctcctgatccctgagcccgatcggcaacgcacccctcaggacaaccagctggcctatgtcgttattggactcctttttatgatcctgacagtggctgccaacgaaatgggcctgctcgagaccacgaagaaagatctggggattggacatgtggccgctgagaatcaccaacacgccaccatgcttgacgtcgatctgagacccgcgagcgcctggacactctacgctgtggccaccacagttatcacccctatgatgcggcatacgattgaaaacacaaccgctaatatctctctgacagccattgcgaaccaggccgctatcctgatgggcctcgacaagggctggcccatctccaaaatggatattggggtgccgcttctggccctgggatgctacagccaggtcaatcctctcaccctgaccgctgccgtgcttatgctggtcgctcactatgccatcattggccccgggctccaggcgaaggccacacgcgaggctcaaaagagaacggccgctggaatcatgaaaaaccccaccgtggacggcattgttgccatcgatctggaccctgtggtctacgacacaaagttcgaaaaacagctggggcagatcatgctccttattctgtgtacctctcagatcctgctcatgcggacaacctgggccctgtgcgagtccattacgcttgcgacaggaccgctgaccaccctctgggaaggcagccccggcaagttttggaatacaaccatcgctgtgtctatggccaacattttccgcgggagctatctggctggagccggcctggccttctccctcatgaaatctcttgggggaggcagacgggggacaggagctcaaggcgagacgctgggcgagaagtggaagcgccagctgaatcagctcagcaaatccgaatttaacatctacaagagaagcgggatcatggaggttgatcggtccgaagccaaagagggactgaagagaggcgaaaccacaaaacatgcggtgtctcgcgggaccgccaagcttcggtggttcgtcgagagaaatctggtgaagcctgagggaaaagtgattgacctcggctgtgggcgcggaggctggagctattactgcgctggcctgaagaaagttacagaagtcaaggggtataccaaaggaggccccgggcacgaggaacctatccccatggccacgtacggatggaacctggtgaagctccattccggcaaagatgtgtttttcatgcctccggagaagtgtgacacccttctgtgcgatattggggaatctagccccaatcctacaatcgaggagggacggaccctgagagtcctcaagatggttgaaccctggctgcgcggcaaccagttttgtattaaaatccttaatccttacatgccctccgtggtggagacactggaacaaatgcagcggaagtatggcgggatgctcgtcagaaacccgctgtctcgcaatagcacccacgagatgtactgggtgtcctgcggaacaggcaacattgttagcgctgtgaacatgacctctcggatgctgctcaatagattcacgatggcccaccgcaaacctacatatgagcgggacgtcgatctgggggcgggaaccagacatgtggccgttgaacccgaggtggctaaccttgacatcatcggccagcgcattgaaaatatcaagaacgagcacaaatccacctggcattacgatgaagacaatccctataagacatgggcctaccacgggagctatgaggtcaagccttctggatccgctagctctatggtgaacggcgtggtcagactgctcacgaaaccctgggatgttattcctatggtgacccaaatcgccatgacagacaccacaccgtttggccagcagcgggtgttcaaggagaaagtcgacacccgcacacccagagctaagcgggggaccacgcagattatggaagtgaccgccaaatggctgtggggatttctttccagaaataagaagcctcggatctgtacacgcgaggaattcaccagaaaagttcggagcaacgcggccatcggcgctgtgtttgtcgatgagaatcaatggaactccgccaaggaagctgtggaggacgagcgcttctgggatctggttcacagagaacgggagctccataaacaggggaagtgcgccacatgcgtgtacaatatgatgggaaaacgcgaaaagaagctgggcgagtttgggaaagccaagggcagcagagcgatttggtacatgtggctgggagctcggttcctcgaattcgaggccctgggctttatgaacgaggaccactggttctctcgcgaaaatagcctttccggggtcgagggagaaggcctgcataaactcgggtatatcctgagagatatttctaagatccccggaggcaacatgtacgccgacgataccgctgggtgggacacgcggattacagaggatgaccttcagaatgaggccaaaatcaccgatatcatggaacctgagcacgctctgctcgccacaagcatttttaagctgacctatcagaacaaagtggttcgcgtgcaaagacccgcgaagaacggcacggtcatggacgtgatctcccggcgcgatcagagaggatctggccaggtcgggacctacggactgaatacattcaccaacatggaagtgcagctcattcggcaaatggagagcgaaggcatctttctgccgtccgagcttgagacacctaatctggccgaaagagttctcgactggctggagaagcatggggctgaacgccttaaacggatggccatttctggagacgattgtgtggtcaagcccatcgacgatagattcgctaccgccctgacagcgctcaacgacatgggcaaagtgcgcaaggatatccctcagtgggagcccagcaaagggtggaatgactggcagcaggtgcctttttgctcccaccacttccatcaactgattatgaaggatggccgggaaatcgttgtgccctgtagaaaccaggacgagctggtcggacgcgcccgggtgagccagggcgctgggtggtctctcagagagaccgcctgcctgggaaagtcctatgctcaaatgtggcagcttatgtactttcaccgccgggatctgagactcgccgctaatgccatttgtagcgcggttccggtggactgggtccctacgtctcgcacaacctggtccatccatgcccaccaccagtggatgaccacagaagatatgctgagcgtgtggaaccgggtctggattgaggaaaatccctggatggaggacaaaacccatgtgtcctcttgggaagaggttccctatcttggcaagagagaggaccagtggtgcgggagcctgatcggactcacagctcgggccacgtgggccaccaacattcaagtggctatcaatcaggtcagacgcctgatcggcaacgaaaattacctggattacatgacatccatgaaacggttcaagaacgagagcgaccctgaaggggccctctggtga

SEQ ID NO: 18697 - RNA, 9879 nt, synthetic construct
  misc_feature 1..9879: note = derived and/or modified CDS sequence (opt5) from DENV-1__KF973454__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcatgacatgtatcgctgtcggcatggtgaccctgtacctgggggttatggtgcaggccgactctggatgcgtcattaactggaaaggccgcgaactcaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgccttgaaaatattatgtggaaacagatcagcaacgagctgaatcacatcctcctggaaaacgacatgaagtttaccgtcgtggtgggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggcttaagctccgcgatagctacacccagatgtgcgaccatcggctgatgtccgcggccatcaaagatagcaaggctgttcacgccgacatgggctattggattgaatctgagaaaaatgaaacatggaagctggccagagcttcctttatcgaggtgaagacctgtacatggcccaaaagccataccctctggtctaacggggtgctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtcgtggttgatgagcattgcggaaaccggggcccctctctgagaacaaccacggtgacaggcaagatcattcacgaatggtgttgccggagctgtacccttcctcccctccgctttagaggggaggacggatgctggtacggcatggagatccggccggtcaaagaaaaggaggaaaatctggtgagatccatggttagcgcggggtctggagaggtggactccttcagcctgggcatcctctgtgtctccattatgatcgaagaggtgatgcgctctcggtggagcagaaagatgctgatgacagggacccttgctgtttttctgctcctgattatgggacagctgacctggaacgatcttatccgcctgtgcattatggtgggcgccaatgcctccgacagaatgggcatggggacaacgtatctcgctctgatggccaccttcaaactccggcctatgtttgcggtcggaatcctgttccgcagacttacatctcgggaggtgctgctcctgaccattggcctgagccttgtggcttccgtcgaactgcccaactctctcgaggaactgggggatggactcgccatgggcatcatgatgctgaagcttctgacagagtttcagccccatcaactctggaccacgctgctgagccttacattcatcaaaaccaccctgtccctcgactacgcctggaagacaaccgctatggccctgagcattgtttctctctttcctatctgtctgtccacaacgagccagaaaaccacatggcttccggtgctgctggggtctttcggatgcaagcccctcaccatgtatctgattacagaaaacaagatctggggccgcaaatcctggcctattaatgagggcatcatggctatcgggattgtgagcatccttctgtcttccctcctgaagaacgatgtccccctcgccggacctctgattgcgggcgggatgcttatcgcctgttacgtgattagcggatccagcgctgacctgtctctggagaaagccgctgaagttagctgggagcaggaagccgagcactccggcacctctcataatatcctcgtggaagtccaggatgacgggacgatgagaatcaaggatgaggagaaagacgataccctgacaattcttctgaaggccaccctcctggctgtgagcggagtttatcccatgtccatccctgcgacactctttgtgtggtacttctggcaaaaaaagaagcagcggtctggcgtcctgtgggacacccccagcccgcctgaagtggagcgcgccgtccttgatgacggcatttatagaatcctgcagcgggggctgctcggacgctcccaggtgggcgttggggtgtttcaagacggagtcttccacacaatgtggcacgtgacgagaggcgctgttctgatgtaccaggggaaacggcttgaaccctcttgggccagcgtgaagaaagatctgatttcctacggaggcggctggagattccaggggagctggaacaccggagaggaggtccaggtgatcgccgtggaacctggcaagaatcccaaaaacgttcaaacaaccccggggacctttaagacacctgagggagaagtcggcgctattgccctcgacttcaagcccgggacgtctggatcccctatcgtgaatcgcgagggcaaaatcgtgggcctgtatgggaacggagtcgtgaccacaagcggcacctacgtttctgcgattgctcaggccaaggcctcccaggaagggcccctccccgagatcgaggatgaagtgtttaaaaagcggaatctgacaattatggaccttcatcctggaagcggcaaaaccagacgctatctgccggctatcgtccgggaggccattaagagaaagctgcgcacgctcatcctggcgcccacacgggtggttgcttccgaaatggccgaggcccttaaagggatgcctatcagataccaaaccaccgctgtgaagtctgaacacacaggccgcgagattgtcgatctgatgtgccatgccaccttcacaatgcggctcctgagccccgtgagagttcctaactataatatgatcattatggacgaggctcactttaccgatcccgcctccatcgcggcccggggatacattagcacgcgcgtgggcatgggggaagctgccgctatcttcatgacagccacccctccgggatctgtcgaggcctttccccagtccaacgctgtgatccaggacgaagagagagatattcctgaacggagctggaattctggctatgactggatcacagatttccccgggaaaaccgtgtggtttgtccctagcattaagtccggaaacgacatcgcgaattgtctgcgcaaaaacggcaagagagttattcagctctctcggaagacgttcgacaccgagtaccaaaaaacaaagaacaatgattgggactacgtggtgaccacagatatcagcgagatgggggccaactttagagctgaccgcgtcattgatccccggagatgccttaaaccggtgatcctgaaggacggccctgaacgcgttatcctggccggacccatgcccgtgaccgtcgcctccgctgcccagcggagaggccgcattgggcggaatcagaacaaagagggagatcagtatgtgtacatgggccaacctctcaataacgacgaagatcatgcgcactggacagaggctaagatgctgcttgacaatatcaacacccccgaggggattatccctgccctgttcgaaccggagagagaaaagtctgccgctattgatggagagtatcgcctcagaggcgaagcccggaaaacgttcgttgagctgatgcgcagaggggacctgcccgtgtggctcagctacaaggtcgcgtccgagggctttcagtatagcgatcggcgctggtgcttcgacggagaaagaaataaccaggtgcttgaggaaaatatggacgtcgagatctggacaaaagaaggcgagcggaagaaactgagacctcgctggctggatgcccggacctactctgaccccctcgctctgagagagtttaaggaattcgccgctgggcgccggtccgtgagcggagatcttatcctggagattggcaaactccctcagcacctgaccctgagagcccaatccgctctcgacaaccttgttatgctgcataattctgaacaggggggaaaggcctatcggcacgcgatggaggaactgcccgatacaatcgagaccctcatgctgcttgccctgattgctgtgctcacaggcggcgtgatgctgtttttcctgagcgggaagggactcggcaaaacgtccatcgggcttctgtgtgtcaccgcctctagcgctctgctctggatggcctccgttgagccgcattggattgccgctagcatcatcctggaatttttccttatggtgctgctcattcctgagcccgaccgccagagaacacctcaggataaccaactggcgtacgtggtcatcggactgctctttatgattcttaccgtggccgctaatgaaatgggcctgctggagacaaccaagcgggacctcgggatcggacacgttgccgccgagaaccaccagcatgctacgatgctggatgtggaccttcgccccgcctctgcgtggaccctgtacgccgtcgctacaaccgtgattacacctatgatgagacacaccatcgaaaacacgacagccaatatttccctcaccgctatcgccaaccaggcggccatcctgatgggcctggataaaggctggcccattagcaagatggacatcggggtcccgctccttgctctgggatgctattctcaagtgaatcctctgacactcaccgccgctgttctgatgcttgtggcccattacgctattatcggccccgggctgcaggccaaagcgacccgggaggcccagaagcgcacagctgccggaattatgaagaaccccacggtcgatggcatcgtggctatcgacctcgaccctgttgtgtatgatgccaaattcgaaaagcagctggggcaaattatgctgctcatcctttgtacctcccagattctgctgatgagaacaacctgggccctctgcgagagcatcacactggcgaccggaccgcttacgacactgtgggaaggctctcccggcaaattttggaataccaccattgctgtcagcatggccaacatcttccgggggtcctacctcgctggagccggcctggccttttctctgatgaagagcctcgggggaggccgcagagggacaggagctcagggcgagacccttggcgagaaatggaagcggcagctgaatcaactgtccaagcctgaattcaacacatataaaagaagcgggatcatggaggtggaccgctccgaagccaaggagggactcaaacggggcgaaacgaccaagcacgcggtgtctagagggacagccaaactgcgctggttcgttgagcggaatcttgtcaagcccgagggaaaggtgattgatctgggctgtgggagaggaggctggagctactattgcgctggcctcaaaaaggtgaccgaagtcaaagggtacacaaagggaggccctgggcatgaggaacccatccctatggccacctacggatggaacctggttaaactgcactccggcaaggacgtgtttttcatgccgcccgagaaatgtgatacgctcctttgcgacattggggaatctagccctaatcccaccatcgaggagggacgcacactgcgggtgctgaagatggtcgaaccttggctcagaggcaaccagttttgtattaagatcctgaatccctatatgccgtccgtggttgagacccttgaacagatgcagcgcaaacacggcgggatgctggtgcggaaccctctctctagaaatagcacacatgagatgtactgggtctcctgcggaaccggcaacattgtgagcgctgttaatatgacatctcgcatgctgctgaaccggttcaccatggcccacagaaagcccacgtatgagcgcgatgtggacctcggggcgggaacaagacatgtcaccgtggaacccgaggtggccaacctggatatcatcggccaacggattgaaaatatcaaaaacgagcacaagtccacctggcactacgacgaagataatccttataaaacatgggcttaccatgggagctatgaggtcaagccctctggatccgccagctctatggttaacggcgtggtgcgccttctgacgaagccttgggacgtcattccgatggtgacccagatcgctatgacagacaccacaccctttggccagcaaagagttttcaaagagaaggtggatacccggacacctagagccaaacgggggaccacgcagattatggaagtcaccgctaagtggctctggggatttctgtcccgcaataaaaagcccagaatctgtacacgggaggaattcacccgcaaggtgagaagcaacgccgcgatcggcgccgtttttgtggacgagaatcagtggaactccgctaaagaagccgtcgaggatgagcggttctgggaccttgtgcaccgcgaaagagagctgcataagcaggggaaatgcgctacatgcgtttacaatatgatgggaaagcgggaaaaaaagctcggcgagtttgggaaggccaaaggcagccgcgccatttggtacatgtggctgggagcgagattcctggaatttgaggctctcggcttcatgaacgaggatcactggttctctcgggaaaatagcctgtccggggtggagggagaaggccttcataagctggggtatatcctccgcgacatttctaaaatccctggaggcaacatgtacgccgatgacaccgccgggtgggatacgagaattacagaggacgatctgcaaaatgaggctaagatcaccgacatcatggaacccgagcacgcccttctggctacaagcatttttaaactcacctatcagaacaaggtcgtgcgggtccagcgcccggccaaaaatggcacggtgatggatgttatctccagacgggaccagagaggatctggccaagtggggacctacggactgaacacattcaccaacatggaagtccagctgattcgccagatggagagcgaaggcatctttctcccttccgagctggagacacccaatcttgcggaacgggtgctggactggctcgagaagcacggggccgaaagactgaagcgcatggctatttctggagatgactgtgtggttaaacctatcgatgaccggttcgccaccgctcttacagccctgaacgatatgggcaaggtgagaaaagacatcccccagtgggagcctagcaaggggtggaatgattggcaacaggtccccttttgctcccatcacttccatcagctcattatgaaagacggccgcgaaatcgtggttccgtgtcggaaccaggatgagctggtgggaagagcgcgcgtcagccaaggcgccgggtggtctctgcgggagaccgcttgcctcggaaagtcctatgcccagatgtggcagctgatgtactttcacagacgcgaccttcggctggctgccaatgctatttgtagcgccgtgcctgtcgattgggtgcccacgtctagaacaacctggtccatccacgcgcatcaccaatggatgaccacagaagacatgctcagcgtttggaaccgggtgtggattgaggaaaatccctggatggaggacaagacccatgtctcctcttgggaagaggtgccttatctgggcaaaagagaggatcagtggtgcgggagccttatcggactgacagcccgcgctacgtgggccaccaacattcaggttgccatcaatcaggtgcggagactcatcggcaacgaaaattacctggactacatgacatccatgaagcgcttcaaaaacgagagcgatccggaaggggtcctgtggtga

SEQ ID NO: 18698 - RNA, 9879 nt, synthetic construct
  misc_feature 1..9879: note = derived and/or modified CDS sequence (opt5) from DENV-1__KF973455__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcatgacatgtatcgctgtcggcatggtgaccctgtacctgggggttatggtgcaggccgactctggatgcgtcattaactggaaaggccgcgaactcaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgccttgaaaatattatgtggaaacagatcagcaacgagctgaatcacatcctcctggaaaacgacatgaagtttaccgtcgtggtgggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggcttaagctccgcgatagctacacccagatgtgcgaccatcggctgatgtccgcggccatcaaagatagcaaggctgttcacgccgacatgggctattggattgaatctgagaaaaatgaaacatggaagctggccagagcttcctttatcgaggtgaagacctgtacatggcccaaaagccataccctctggtctaacggggtgctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtcgtggttgatgagcattgcggaaaccggggcccctctctgagaacaaccacggtgacaggcaagatcattcacgaatggtgttgccggagctgtacccttcctcccctccgctttagaggggaggacggatgctggtacggcatggagatccggccggtcaaagaaaaggaggaaaatctggtgagatccatggttagcgcggggtctggagaggtggactccttcagcctgggcatcctctgtgtctccattatgatcgaagaggtgatgcgctctcggtggagcagaaagatgctgatgacagggacccttgctgtttttctgctcctgattatgggacagctgacctggaacgatcttatccgcctgtgcattatggtgggcgccaatgcctccgacagaatgggcatggggacaacgtatctcgctctgatggccaccttcaaactccggcctatgtttgcggtcggaatcctgttccgcagacttacatctcgggaggtgctgctcctgaccattggcctgagccttgtggcttccgtcgaactgcccaactctctcgaggaactgggggatggactcgccatgggcatcatgatgctgaagcttctgacagagtttcagccccatcaactctggaccacgctgctgagccttacattcatcaaaaccaccctgtccctcgactacgcctggaagacaaccgctatggccctgagcattgtttctctctttcctatctgtctgtccacaacgagccagaaaaccacatggcttccggtgctgctggggtctttcggatgcaagcccctcaccatgtatctgattacagaaaacaagatctggggccgcaaatcctggcctattaatgagggcatcatggctatcgggattgtgagcatccttctgtcttccctcctgaagaacgatgtccccctcgccggacctctgattgcgggcgggatgcttatcgcctgttacgtgattagcggatccagcgctgacctgtctctggagaaagccgctgaagttagctgggagcaggaagccgagcactccggcacctctcataatatcctcgtggaagtccaggatgacgggacgatgagaatcaaggatgaggagaaagacgataccctgacaattcttctgaaggccaccctcctggctgtgagcggagtttatcccatgtccatccctgcgacactctttgtgtggtacttctggcaaaaaaagaagcagcggtctggcgtcctgtgggacacccccagcccgcctgaagtggagcgcgccgtccttgatgacggcatttatagaatcctgcagcgggggctgctcggacgctcccaggtgggcgttggggtgtttcaagacggagtcttccacacaatgtggcacgtgacgagaggcgctgttctgatgtaccaggggaaacggcttgaaccctcttgggccagcgtgaagaaagatctgatttcctacggaggcggctggagattccaggggagctggaacaccggagaggaggtccaggtgatcgccgtggaacctggcaagaatcccaaaaacgttcaaacaaccccggggacctttaagacacctgagggagaagtcggcgctattgccctcgacttcaagcccgggacgtctggatcccctatcgtgaatcgcgagggcaaaatcgtgggcctgtatgggaacggagtcgtgaccacaagcggcacctacgtttctgcgattgctcaggccaaggcctcccaggaagggcccctccccgagatcgaggatgaagtgtttaaaaagcggaatctgacaattatggaccttcatcctggaagcggcaaaaccagacgctatctgccggctatcgtccgggaggccattaagagaaagctgcgcacgctcatcctggcgcccacacgggtggttgcttccgaaatggccgaggcccttaaagggatgcctatcagataccaaaccaccgctgtgaagtctgaacacacaggccgcgagattgtcgatctgatgtgccatgccaccttcacaatgcggctcctgagccccgtgagagttcctaactataatatgatcattatggacgaggctcactttaccgatcccgcctccatcgcggcccggggatacattagcacgcgcgtgggcatgggggaagctgccgctatcttcatgacagccacccctccgggatctgtcgaggcctttccccagtccaacgctgtgatccaggacgaagagagagatattcctgaacggagctggaattctggctatgactggatcacagatttccccgggaaaaccgtgtggtttgtccctagcattaagtccggaaacgacatcgcgaattgtctgcgcaaaaacggcaagagagttattcagctctctcggaagacgttcgacaccgagtaccaaaaaacaaagaacaatgattgggactacgtggtgaccacagatatcagcgagatgggggccaactttagagctgaccgcgtcattgatccccggagatgccttaaaccggtgatcctgaaggacggccctgaacgcgttatcctggccggacccatgcccgtgaccgtcgcctccgctgcccagcggagaggccgcattgggcggaatcagaacaaagagggagatcagtatgtgtacatgggccaacctctcaataacgacgaagatcatgcgcactggacagaggctaagatgctgcttgacaatatcaacacccccgaggggattatccctgccctgttcgaaccggagagagaaaagtctgccgctattgatggagagtatcgcctcagaggcgaagcccggaaaacgttcgttgagctgatgcgcagaggggacctgcccgtgtggctcagctacaaggtcgcgtccgagggctttcagtatagcgatcggcgctggtgcttcgacggagaaagaaataaccaggtgcttgaggaaaatatggacgtcgagatctggacaaaagaaggcgagcggaagaaactgagacctcgctggctggatgcccggacctactctgaccccctcgctctgagagagtttaaggaattcgccgctgggcgccggtccgtgagcggagatcttatcctggagattggcaaactccctcagcacctgaccctgagagcccaaaacgctctcgacaatcttgttatgctgcataactccgaacaggggggaaaggcctatcggcacgcgatggaggaactgcccgatacaatcgagaccctcatgctgcttgccctgattgctgtgctcacaggcggcgtgatgctgtttttcctgtctgggaagggactcggcaaaacgagcatcgggcttctgtgtgtcaccgcctcctctgctctgctctggatggccagcgttgagccgcattggattgccgcttccatcatcctggaatttttccttatggtgctgctcattcctgagcccgaccgccagagaacacctcaggataatcaactggcgtacgtggtcatcggactgctctttatgattcttaccgtggccgctaacgaaatgggcctgctggagacaaccaagcgggacctcgggatcggacacgttgccgccgagaaccaccagcatgctacgatgctggatgtggaccttcaccccgccagcgcgtggaccctgtacgccgtcgctacaaccgtgattacacctatgatgcgccataccatcgaaaatacgacagccaacatttctctcaccgctatcgccaatcaggcggccatcctgatgggcctggataaaggctggcccatttccaagatggacatcggggtcccgctccttgctctgggatgctatagccaagtgaaccctctgacactcaccgccgctgttctgatgcttgtggcccactacgctattatcggccccgggctgcaggccaaagcgaccagagaggcccagaagcggacagctgccggaattatgaagaatcccacggtcgatggcatcgtggctatcgacctcgaccctgttgtgtatgatgccaaattcgaaaagcagctggggcaaattatgctgctcatcctttgtacctctcagattctgctgatgcgcacaacctgggccctctgcgagtccatcacactggcgaccggaccgcttacgacactgtgggaaggcagccccggcaaattttggaacaccaccattgctgtctctatggccaatatcttcagagggagctacctcgctggagccggcctggccttttccctgatgaagtctctcgggggaggccggcgcgggacaggagctcagggcgagacccttggcgagaaatggaagagacagctgaaccaactgagcaagcctgaattcaatacatataaacggtccgggatcatggaggtggacagaagcgaagccaaggagggactcaaacgcggcgaaacgaccaagcatgcggtgtcccgggggacagccaaactgagatggttcgttgagcgcaaccttgtcaagcccgagggaaaggtgattgatctgggctgtgggcggggaggctggtcttactattgcgctggcctcaaaaaggtgaccgaagtcaaagggtacacaaagggaggccctgggcacgaggaacccatccctatggccacctacggatggaatctggttaaactgcacagcggcaaggacgtgtttttcatgccgcccgagaaatgtgatacgctcctttgcgacattggggaatcctctcctaaccccaccatcgaggagggaagaacactgcgcgtgctgaagatggtcgaaccttggctccggggcaatcagttttgtattaagatcctgaacccctatatgccgagcgtggttgagacccttgaacagatgcagagaaaacatggcgggatgctggtgcgcaatcctctctcccggaactctacacacgagatgtactgggtcagctgcggaaccggcaatattgtgtccgctgttaacatgacaagcagaatgctgctgaaccgcttcaccatggcccatcggaagcccacgtatgagagagatgtggacctcggggcgggaacacgccacgtcaccgtggaacccgaggtggccaatctggatatcatcggccaaagaattgaaaacatcaaaaatgagcacaagtctacctggcattacgacgaagataacccttataaaacatgggcttaccacgggtcctatgaggtcaagcccagcggatctgcctccagcatggttaatggcgtggtgcggcttctgacgaagccttgggacgtcattccgatggtgacccagatcgctatgacagacaccacaccctttggccagcaacgcgttttcaaagagaaggtggataccagaacacctcgggccaaaagagggaccacgcagattatggaagtcaccgctaagtggctctggggatttctgtctcggaacaaaaagccccgcatctgtacaagagaggaattcacccggaaggtgcgctccaatgccgcgatcggcgccgtttttgtggacgagaaccagtggaatagcgctaaagaagccgtcgaggatgagagattctgggaccttgtgcatcgggaacgcgagctgcacaagcaggggaaatgcgctacatgcgtttacaacatgatgggaaagagagaaaaaaagctcggcgagtttgggaaggccaaaggctcccgggccatttggtacatgtggctgggagcgcgcttcctggaatttgaggctctcggcttcatgaatgaggatcattggttcagcagagaaaactctctgagcggggtggagggagaaggccttcacaagctggggtatatcctccgggacatttccaaaatccctggaggcaatatgtacgccgatgacaccgccgggtgggatacgcgcattacagaggacgatctgcaaaacgaggctaagatcaccgacatcatggaacccgagcacgcccttctggctacatctatttttaaactcacctatcagaataaggtcgtgagagtccagcggccggccaaaaacggcacggtgatggatgttatcagccgcagagaccagcggggatccggccaagtggggacctacggactgaacacattcaccaatatggaagtccagctgattagacagatggagtctgaaggcatctttctccctagcgagctggagacacccaaccttgcggaacgcgtgctggactggctcgagaagcatggggccgaacggctgaagagaatggctatttccggagatgactgtgtggttaaacctatcgatgaccgcttcgccaccgctcttacagccctgaatgatatgggcaaggtgcggaaagacatcccccagtgggagccttctaaggggtggaacgattggcaacaggtccccttttgcagccaccatttccaccagctcattatgaaagacggcagagaaatcgtggttccgtgtcgcaatcaggatgagctggtgggacgggcgagagtctcccaaggcgccgggtggagcctgcgcgagaccgcttgcctcggaaagtcttatgcccagatgtggcagctgatgtactttcaccggagagaccttcgcctggctgccaacgctatttgttccgccgtgcctgtcgattgggtgcccacgagccggacaacctggtctatccatgcgcaccatcaatggatgaccacagaagacatgctctccgtttggaatagagtgtggattgaggaaaacccctggatggaggacaagacccacgtcagctcctgggaagaggtgccttatctgggcaaacgggaggatcagtggtgcgggtctcttatcggactgacagccagagctacgtgggccaccaatattcaggttgccatcaaccaggtgcgccggctcatcggcaatgaaaactacctggactacatgacaagcatgaagagattcaaaaatgagtccgatccggaaggggctctgtggtga

SEQ ID NO: 18699 - RNA, 9879 nt, synthetic construct
  misc_feature 1..9879: note = derived and/or modified CDS sequence (opt5) from DENV-1__KF973456__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcatgacatgtatcgctgtcggcatggtgaccctgtacctgggggttatggtgcaggccgactctggatgcgtcattaactggaaaggccgcgaactcaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgccttgaaaatattatgtggaaacagatcagcaacgagctgaatcacatcctcctggaaaacgacatgaagtttaccgtcgtggtgggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggcttaagctccgcgatagctacacccagatgtgcgaccatcggctgatgtccgcggccatcaaagatagcaaggctgttcacgccgacatgggctattggattgaatctgagaaaaatgaaacatggaagctggccagagcttcctttatcgaggtgaagacctgtacatggcccaaaagccataccctctggtctaacggggtgctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtcgtggttgatgagcattgcggaaaccggggcccctctctgagaacaaccacggtgacaggcaagatcattcacgaatggtgttgccggagctgtacccttcctcccctccgctttagaggggaggacggatgctggtacggcatggagatccggccggtcaaagaaaaggaggaaaatctggtgagatccatggttagcgcggggtctggagaggtggactccttcagcctgggcatcctctgtgtctccattatgatcgaagaggtgatgcgctctcggtggagcagaaagatgctgatgacagggacccttgctgtttttctgctcctgattatgggacagctgacctggaacgatcttatccgcctgtgcattatggtgggcgccaatgcctccgacagaatgggcatggggacaacgtatctcgctctgatggccaccttcaaactccggcctatgtttgcggtcggaatcctgttccgcagacttacatctcgggaggtgctgctcctgaccattggcctgagccttgtggcttccgtcgaactgcccaactctctcgaggaactgggggatggactcgccatgggcatcatgatgctgaagcttctgacagagtttcagccccatcaactctggaccacgctgctgagccttacattcatcaaaaccaccctgtccctcgactacgcctggaagacaaccgctatggccctgagcattgtttctctctttcctatctgtctgtccacaacgagccagaaaaccacatggcttccggtgctgctggggtctttcggatgcaagcccctcaccatgtatctgattacagaaaacaagatctggggccgcaaatcctggcctattaatgagggcatcatggctatcgggattgtgagcatccttctgtcttccctcctgaagaacgatgtccccctcgccggacctctgattgcgggcgggatgcttatcgcctgttacgtgattagcggatccagcgctgacctgtctctggagaaagccgctgaagttagctgggagcaggaagccgagcactccggcacctctcataatatcctcgtggaagtccaggatgacgggacgatgagaatcaaggatgaggagaaagacgataccctgacaattcttctgaaggccaccctcctggctgtgagcggagtttatcccatgtccatccctgcgacactctttgtgtggtacttctggcaaaaaaagaagcagcggtctggcgtcctgtgggacacccccagcccgcctgaagtggagcgcgccgtccttgatgacggcatttatagaatcctgcagcgggggctgctcggacgctcccaggtgggcgttggggtgtttcaagacggagtcttccacacaatgtggcacgtgacgagaggcgctgttctgatgtaccaggggaaacggcttgaaccctcttgggccagcgtgaagaaagatctgatttcctacggaggcggctggagattccaggggagctggaacaccggagaggaggtccaggtgatcgccgtggaacctggcaagaatcccaaaaacgttcaaacaaccccggggacctttaagacacctgagggagaagtcggcgctattgccctcgacttcaagcccgggacgtctggatcccctatcgtgaatcgcgagggcaaaatcgtgggcctgtatgggaacggagtcgtgaccacaagcggcacctacgtttctgcgattgctcaggccaaggcctcccaggaagggcccctccccgagatcgaggatgaagtgtttaaaaagcggaatctgacaattatggaccttcatcctggaagcggcaaaaccagacgctatctgccggctatcgtccgggaggccattaagagaaagctgcgcacgctcatcctggcgcccacacgggtggttgcttccgaaatggccgaggcccttaaagggatgcctatcagataccaaaccaccgctgtgaagtctgaacacacaggccgcgagattgtcgatctgatgtgccatgccaccttcacaatgcggctcctgagccccgtgagagttcctaactataatatgatcattatggacgaggctcactttaccgatcccgcctccatcgcggcccggggatacattagcacgcgcgtgggcatgggggaagctgccgctatcttcatgacagccacccctccgggatctgtcgaggcctttccccagtccaacgctgtgatccaggacgaagagagagatattcctgaacggagctggaattctggctatgactggatcacagatttccccgggaaaaccgtgtggtttgtccctagcattaagtccggaaacgacatcgcgaattgtctgcgcaaaaacggcaagagagttattcagctctctcggaagacgttcgacaccgagtaccaaaaaacaaagaacaatgattgggactacgtggtgaccacagatatcagcgagatgggggccaactttagagctgaccgcgtcattgatccccggagatgccttaaaccggtgatcctgaaggacggccctgaacgcgttatcctggccggacccatgcccgtgaccgtcgcctccgctgcccagcggagaggccgcattgggcggaatcagaacaaagagggagatcagtatgtgtacatgggccaacctctcaataacgacgaagatcatgcgcactggacagaggctaagatgctgcttgacaatatcaacacccccgaggggattatccctgccctgttcgaaccggagagagaaaagtctgccgctattgatggagagtatcgcctcagaggcgaagcccggaaaacgttcgttgagctgatgcgcagaggggacctgcccgtgtggctcagctacaaggtcgcgtccgagggctttcagtatagcgatcggcgctggtgcttcgacggagaaagaaataaccaggtgcttgaggaaaatatggacgtcgagatctggacaaaagaaggcgagcggaagaaactgagacctcgctggctggatgcccggacctactctgaccccctcgctctgagagagtttaaggaattcgccgctgggcgccggtccgtgagcggagatcttatcctggagattggcaaactccctcagcacctgaccctgagagcccaaaacgctctcgacaatcttgttatgctgcataactccgaacaggggggaaaggcctatcggcacgcgatggaggaactgcccgatacaatcgagaccctcatgctgcttgccctgattgctgtgctcacaggcggcgtgatgctgtttttcctgtctgggaagggactcggcaaaacgagcatcgggcttctgtgtgtcaccgcctcctctgctctgctctggatggccagcgttgagccgcattggattgccgcttccatcatcctggaatttttccttatggtgctgctcattcctgagcccgaccgccagagaacacctcaggataatcaactggcgtacgtggtcatcggactgctctttatgattcttaccgtggccgctaacgaaatgggcctgctggagacaaccaagcgggacctcgggatcggacacgttgccgccgagaaccaccagcatgctacgatgctggatgtggaccttcgccccgccagcgcgtggaccctgtacgccgtcgctacaaccgtgattacacctatgatgagacacaccatcgaaaatacgacagccaacatttctctcaccgctatcgccaatcaggcggccatcctgatgggcctggataaaggctggcccatttccaagatggacatcggggtcccgctccttgctctgggatgctatagccaagtgaaccctctgacactcaccgccgctgttctgatgcttgtggcccattacgctattatcggccccgggctgcaggccaaagcgacccgggaggcccagaagcgcacagctgccggaattatgaagaatcccacggtcgatggcatcgtggctatcgacctcgaccctgttgtgtatgatgccaaattcgaaaagcagctggggcaaattatgctgctcatcctttgtacctctcagattctgctgatgagaacaacctgggccctctgcgagtccatcacactggcgaccggaccgcttacgacactgtgggaaggcagccccggcaaattttggaacaccaccattgctgtctctatggccaatatcttccgggggagctacctcgctggagccggcctggccttttccctgatgaagtctctcgggggaggccgcagagggacaggagctcagggcgagacccttggcgagaaatggaagcggcagctgaaccaactgagcaagcctgaattcaatacatataaaagatccgggatcatggaggtggaccgcagcgaagccaaggagggactcaaacggggcgaaacgaccaagcacgcggtgtccagagggacagccaaactgcgctggttcgttgagcggaaccttgtcaagcccgagggaaaggtgattgatctgggctgtgggagaggaggctggtcttactattgcgctggcctcaaaaaggtgaccgaagtcaaagggtacacaaagggaggccctgggcatgaggaacccatccctatggccacctacggatggaatctggttaaactgcacagcggcaaggacgtgtttttcatgccgcccgagaaatgtgatacgctcctttgcgacattggggaatcctctcctaaccccaccatcgaggagggacgcacactgcgggtgctgaagatggtcgaaccttggctcagaggcaatcagttttgtattaagatcctgaacccctatatgccgagcgtggttgagacccttgaacagatgcagcgcaaacacggcgggatgctggtgcggaatcctctctccagaaactctacacatgagatgtactgggtcagctgcggaaccggcaatattgtgtccgctgttaacatgacaagccgcatgctgctgaaccggttcaccatggcccacagaaagcccacgtatgagcgcgatgtggacctcggggcgggaacaagacatgtcaccgtggaacccgaggtggccaatctggatatcatcggccaacggattgaaaacatcaaaaatgagcacaagtctacctggcactacgacgaagataacccttataaaacatgggcttaccatgggtcctatgaggtcaagcccagcggatctgcctccagcatggttaatggcgtggtgcgccttctgacgaagccttgggacgtcattccgatggtgacccagatcgctatgacagacaccacaccctttggccagcaaagagttttcaaagagaaggtggatacccggacacctagagccaaacgggggaccacgcagattatggaagtcaccgctaagtggctctggggatttctgtctcgcaacaaaaagcccagaatctgtacacgggaggaattcacccgcaaggtgagatccaatgccgcgatcggcgccgtttttgtggacgagaaccagtggaatagcgctaaagaagccgtcgaggatgagcggttctgggaccttgtgcaccgcgaaagagagctgcataagcaggggaaatgcgctacatgcgtttacaacatgatgggaaagcgggaaaaaaagctcggcgagtttgggaaggccaaaggctcccgcgccatttggtacatgtggctgggagcgagattcctggaatttgaggctctcggcttcatgaatgaggatcactggttcagccgggaaaactctctgagcggggtggagggagaaggccttcataagctggggtatatcctccgcgacatttccaaaatccctggaggcaatatgtacgccgatgacaccgccgggtgggatacgagaattacagaggacgatctgcaaaacgaggctaagatcaccgacatcatggaacccgagcacgcccttctggctacatctatttttaaactcacctatcagaataaggtcgtgcgggtccagcgcccggccaaaaacggcacggtgatggatgttatcagcagacgggaccagagaggatccggccaagtggggacctacggactgaacacattcaccaatatggaagtccagctgattcgccagatggagtctgaaggcatctttctccctagcgagctggagacacccaaccttgcggaacgggtgctggactggctcgagaagcacggggccgaaagactgaagcgcatggctatttccggagatgactgtgtggttaaacctatcgatgaccggttcgccaccgctcttacagccctgaatgatatgggcaaggtgagaaaagacatcccccagtgggagccttctaaggggtggaacgattggcaacaggtccccttttgcagccatcacttccatcagctcattatgaaagacggccgcgaaatcgtggttccgtgtcggaatcaggatgagctggtgggaagagcgcgcgtctcccaaggcgccgggtggagcctgcgggagaccgcttgcctcggaaagtcttatgcccagatgtggcagctgatgtactttcacagacgcgaccttcggctggctgccaacgctatttgttccgccgtgcctgtcgattgggtgcccacgagcagaacaacctggtctatccacgcgcatcaccaatggatgaccacagaagacatgctctccgtttggaatcgggtgtggattgaggaaaacccctggatggaggacaagacccatgtcagctcctgggaagaggtgccttatctgggcaaaagagaggatcagtggtgcgggtctcttatcggactgacagcccgcgctacgtgggccaccaatattcaggttgccatcaaccaggtgcggagactcatcggcaatgaaaactacctggactacatgacaagcatgaagcgcttcaaaaatgagtccgatccggaaggggctctgtggtga

SEQ ID NO: 18700 - RNA, 9879 nt, synthetic construct
  misc_feature 1..9879: note = derived and/or modified CDS sequence (opt5) from DENV-1__KF973459__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacactgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctcgctcctcatgtggggctgggacttgagacacgcaccgaaacgtggatgagctccgagggcgcctggaaacagattcagagagttgaaacatgggctctgcggcaccccggcttcaccgtgatcgccctctttctggcgcatgccattgggacatctatcacccaaaagggaatcattttcatccttctgatgctcgtcacccctagcatggctatgcgctgcgtgggcattgggaacagagattttgttgagggactgtccggcgccacatgggtggacgtcgtgctggagcacgggagctgtgtgacgaccatggctaagaataaacccacactcgatatcgaactgcttaagaccgaggtcacaaaccctgccattctgcggaaactctgcatcgaagcgaagatttctaataccacgacagactcccgctgtccgacccagggagaggccaccctggttgaagagcaggatgctaacttcgtgtgcagacggacatttgtggaccgcggctggggcaatgggtgtggacttttcggcaaagggagcctgctcacctgcgccaagtttaagtgcgtcacaaaactggagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctcacagactacggcgccctgacccttgactgtagccccagaacaggcctggatttcaacgaaatggttctcctgaccatgaaggagaaatcttggcttgtgcataagcaatggtttctggacctccctctgccctggacgtccggggctagcacatcccaggagacctggaatcggcaggatctgctcgtcacattcaaaaccgcgcacgccaagaagcaagaagtggtcgtgctgggatctcaggagggcgctatgcacaccgcccttacaggggccacggaaatccagaccagcggaacaaccacaatttttgctggccatctgaaatgccgcctcaagatggacaaactgaccctgaaggggacgtcctatgttatgtgtacaggcagcttcaaacttgagaaggaagtggccgagacccagcacggaaccgtcctcgtgcaagttaagtacgagggcacagatgcgccgtgcaaaatccctttctctacccaggacgaaaagggggtgacacagaacggaagactgatcacggctaatcccattgtcaccgataaagagaagcctgtgaacatcgaaacagagcccccctttggcgagtcctatattgtggttggggccggagaaaaagccctgaagctcagctggttcaagaaaggctctagcatcgggaagatgtttgaggctaccgcccggggcgctagacgcatggccattctgggagacacagcgtgggatttcggctccatcgggggagtctttacctctgtgggcaaacttgtgcatcaggtcttcgggacggcctacggagtgctgtttagcggcgtttcctggaccatgaagatcgggattggcatcctcctgacatggctgggacttaatagccggtctacctccctcagcatgacatgtattgctgtgggcatggtcaccctgtacctgggggtgatggttcaagccgactctggatgcgtgatcaactggaaaggcagagaactcaagtgtgggtccggaattttcgtcacaaacgaggtgcacacctggacggaacagtataagtttcaggctgatagccctaaacgcctgtccgccgcgatcggcaaggcctgggaggagggggtttgcggcattcggtctgctacaagacttgaaaatatcatgtggaaacagatcagcaacgagctgaatcatattctcctggaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggcttaagctcagagacagctacacccaagtctgcgatcaccgcctgatgtccgcggccattaaagacagcaaggctgttcatgccgatatgggctattggatcgaatctgagaaaaacgaaacatggaagctggcccgggcttccttcatcgaggtgaagacctgtacatggcccaaaagccacaccctctggtctaatggggtgctggaatccgagatgattatcccgaagatttacggaggccctatcagccagcataactatagacccgggtacttcacgcagaccgccggaccttggcaccttggcaaactggagctcgactttgatctgtgcgaagggacaaccgtcgtggttgacgagcactgcggaaatcgcggcccctctctgcggacaaccacggtgacaggcaagattatccatgaatggtgttgcagaagctgtacccttcctcccctccggttccgcggggaggatggatgctggtacggcatggagatcagaccggtcaaagaaaaggaggaaaacctggtgcggtccatggttagcgcggggtctggagaggtggactccctgagcctcggcattctgtgtgcttccatcatgattgaagaggtcatgagatctcgctggagccggaagatgcttatgacagggaccctggccgtgtttctcctgctgatcatgggacaacttacctggaatgacctgattagactctgcatcatggttggcgccaacgcttccgatcgcatgggcatggggacaacgtatctggccctcatggcgaccttcaaaatgagacctatgtttgctgtgggactgcttttccggcgcctgacatctagagaggtcctcctgctgaccattggccttagcctggtggcctccgtggaactccccaactctctggaggaactcggggacggactggccatgggcatcatgatgcttaagctgctcacagagtttcagccccaccagctgtggaccacgctgcttagcctgacattcatcaaaaccaccctctccctggattacgcttggaagacaaccgccatggctctcagcattatctctctgtttcctctttgtctgtccacaacgagccagaaaaccacatggctgccggtcctcctggggtctttcggatgcaagccccttaccatgtttctgattacagaaaataagatctggggccggaaatcctggcctctcaacgagggcattatggccatcgggatcgttagcattctgctctcttccctgcttaagaatgacgtgcccctggcgggacctctgatcgccggcgggatgctcattgcttgttatgtgatcagcggatccagcgccgatctgtctcttgagaaagctgccgaagtcagctgggagcaagaagccgagcattccggcacctctcacaacattctggtggaagttcaggacgatgggacgatgaagatcaaagacgaggagcgcgatgacaccctcacaatcctgctcaaggctaccctgcttgcggtgagcggagtctaccccatgtccattcctgccacactgttcgtgtggtatttttggcagaaaaagaagcagagatctggcgttctgtgggatacccccagcccgcctgaagtggagcgggctgtcctcgacgatggcatctaccgcattctgcaaagagggcttctgggacggtcccaggtgggcgtcggggtgttccaggacggagttttccatacaatgtggcacgtgacgcgcggcgccgtcctcatgtatcaggggaaaagactggaaccctcttgggccagcgtgaagaaagacctcatctcctacggaggcggctggcggtttcaagggagctggaataccggagaggaggttcaggtgattgctgtcgaacctggcaagaaccccaaaaatgtgcagacaaccccggggaccttcaagacacctgagggagaagtgggcgccatcgcgctggattttaagcccgggacgtctggatcccctattgttaacagagagggcaaaatcgtcggcctttacgggaatggagtggtgaccacaagcggcacctatgtctctgctatcgcccaagccaaggtgtcccaggaagggcccctgcccgagattgaggacgaagttttcaaaaagcgcaacctgacaatcatggatctccaccctggaagcggcaaaacccggagatacctgccggctattgtgcgcgaggccatcaagcggaagcttagaacgctgattctcgcgcccacacgcgtcgtggcttccgaaatggccgaggccctgaaagggatgcctatccggtatcagaccaccgctgttaagtctgaacatacaggcagagagatcgtggacctgatgtgccacgccacctttacaatgcgcctccttagccccgtccgggtgcctaattacaacatgattatcatggatgaggctcatttcaccgaccccgcctccattgcggccagaggatatatcagcacgcgggttggcatgggggaagctgccgctatttttatgacagccacccctccgggatctgtggaggccttcccccagtccaatgctgtcatccaagatgaagagcgcgacatccctgaaagaagctggaactctggctacgattggattacagactttcccgggaaaaccgtgtggttcgtgcctagcatcaagtccggaaatgatattgcgaactgtctgcggaaaaacggcaagcgcgtcatccagctgtctagaaagacgtttgacaccgagtatcagaaaacaaagaataacgactgggattacgttgtgaccacagacattagcgagatgggggccaatttccgggctgatagagtgatcgacccccgccggtgcctcaaaccggtcattctgaaggatggccctgaaagagtgatccttgccggacccatgcccgttaccgtggcctccgctgcccagcgccggggcagaatcgggcgcaaccaaaataaagagggagaccagtacgtctatatgggccagcctctgaacaatgatgaagaccacgcgcattggacagaggctaagatgctcctggataacattaatacccccgaggggatcattcctgccctgttcgaaccggagcgggaaaagtctgccgctatcgacggagagtacagactccgcggcgaagccagaaaaacgtttgtggagcttatgcggcgcggggatctgcccgtttggctgagctataaggtggcgtccgagggcttccagtacagcgacagacggtggtgctttgatggagaacgcaacaatcaagtcctcgaggaaaacatggacgtggagatttggacaaaagaaggcgagagaaagaaactgcggcctagatggcttgacgcccgcacctattctgatcccctggctctccgggagttcaaggaatttgccgctgggagacgctccgtcagcggagacctgatcctggagatcggcaaactccctcagcaccttaccctgcgggcccagaatgctctggataacctcgtgatgctgcacaattccgaacaggggggaaaggcctacagacatgcgatggaggaacttcccgacacaattgagaccctgatgctcctggccctgatcgctgttctcacaggcggcgtgacgcttttctttctgtctgggaagggactgggcaaaaccagcattgggctcctgtgtgtgacagcctcctctgctcttctgtggatggccagcgtcgagccgcactggatcgccgcttccattatcctcgaattctttctgatggttctgctcatccctgagcccgatcggcaacgcacccctcaggacaaccagcttgcgtatgtggtgattggactgctgttcatgatcctcacagtcgccgctaacgaaatgggcctgcttgagaccacgaagaaagatctggggattggacatgtggccgccgagaatcaccaacacgctaccatgctcgacgttgatctgagacccgccagcgcgtggacactgtacgccgtggctaccacagtcatcacccctatgatgcggcatacgattgaaaacacaaccgccaatatctctctcacagctattgccaaccaggcggccatccttatgggcctggacaagggctggcccatctccaaaatggatattggggtgccgctgctcgctctgggatgctacagccaggtcaatcctcttaccctgaccgccgctgtgctcatgctggttgcccactatgctatcattggccccgggctgcaggccaaggcgacacgcgaggcccaaaagagaacggctgccggaatcatgaaaaaccccaccgtggacggcattgtcgctatcgatctcgaccctgtggtttacgacacaaagtttgaaaaacagcttgggcagatcatgctgctgattctctgtacctctcagatcctgcttatgcggacaacctgggccctgtgcgagtccattacgctcgccacaggaccgctgaccaccctgtgggaaggcagccccggcaagttctggaatacaaccatcgcggtgtctatggctaacatttttcgcgggagctatctcgccggagctggccttgccttctccctgatgaaatctctggggggaggcagacgggggacaggagcccaaggcgagacgctcggcgagaagtggaagcgccagctgaatcagcttagcaaatccgaattcaacatctacaagagaagcgggatcatggaggtcgatcggtccgaagctaaagagggactgaagagaggcgaaaccacaaaacatgccgtgtctcgcgggaccgcgaagctccggtggtttgtggagagaaatctggttaagcctgagggaaaagtcattgacctgggctgtgggcgcggaggctggagctattactgcgccggcctcaagaaagtgacagaagtgaaggggtataccaaaggaggccccgggcacgaggaacctatccccatggctacgtacggatggaaccttgtcaagctgcattccggcaaagatgttttctttatgcctccggagaagtgtgacaccctgctctgcgatattggggaatctagccccaatcctacaatcgaggagggacggaccctgagagtgcttaagatggtggaaccctggctgcgcggcaaccagttctgtattaaaatcctcaatccttacatgccctccgtcgtggagacactggaacaaatgcagcggaagtatggcgggatgctggttagaaacccgctctctcgcaatagcacccacgagatgtactgggtgtcctgcggaacaggcaacattgtcagcgccgtgaacatgacctctcggatgctgcttaatagatttacgatggctcaccgcaaacctacatatgagcgggacgttgatctgggggccggaaccagacatgtggcggtcgaacccgaggtggccaacctcgacatcatcggccagcgcattgaaaatatcaagaacgagcacaaatccacctggcattacgatgaagacaatccctataagacatgggcttaccacgggagctatgaggtgaagccttctggatccgccagctctatggtcaacggcgttgtgagactgcttacgaaaccctgggatgtgattcctatggtcacccaaatcgctatgacagacaccacaccgttcggccagcagcgggtgtttaaggagaaagttgacacccgcacacccagagccaagcgggggaccacgcagattatggaagtgaccgctaaatggctgtggggattcctctccagaaataagaagcctcggatctgtacacgcgaggaatttaccagaaaagtccggagcaacgccgcgatcggcgccgtgttcgttgatgagaatcaatggaactccgctaaggaagccgtggaggacgagcgcttttgggatctggtccacagagaacgggagctgcataaacaggggaagtgcgctacatgcgtgtacaatatgatgggaaaacgcgaaaagaagctcggcgagttcgggaaagccaagggcagcagagccatttggtacatgtggctgggagcgcggtttcttgaattcgaggctctgggcttcatgaacgaggaccactggttttctcgcgaaaatagcctctccggggttgagggagaaggcctgcataaacttgggtatatcctgagagatatttctaagatccccggaggcaacatgtacgccgacgataccgccgggtgggacacgcggattacagaggatgacctccagaatgaggctaaaatcaccgatatcatggaacctgagcacgccctgctggctacaagcattttcaagctcacctatcagaacaaagtggtccgcgtgcaaagacccgccaagaacggcacggtcatggacgtgatctcccggcgcgatcagagaggatctggccaggttgggacctacggactgaatacatttaccaacatggaagtgcagcttattcggcaaatggagagcgaaggcatcttcctgccgtccgagctcgagacacctaatctggcgaagagagtccttgactggctggaaaaacatggggccgagcgcctcaagcggatggctatttctggagacgattgtgtggtgaaacccatcgacgatagatttgccaccgctctgacagccctgaacgacatgggcaaggttcgcaaagatatccctcagtgggaacccagcaaggggtggaatgactggcagcaggtgcctttctgctcccaccactttcatcaactcattatgaaggatggccgggagatcgtcgtgccctgtagaaaccaggacgaactggttggacgcgcgcgggtgagccagggcgccgggtggtctcttagagagaccgcttgcctgggaaaatcctatgcccaaatgtggcagctcatgtacttccaccgccgggatctgagacttgctgccaatgctatttgtagcgccgtcccggtggactgggtccctacgtctcgcacaacctggtccatccatgcgcaccaccagtggatgaccacagaggatatgctgagcgtgtggaaccgggtttggattgaagagaatccctggatggaagacaagacccatgtgtcctcttgggaggaagtcccctatctcggcaaaagagaggaccagtggtgcgggagcctgatcggactgacagcccgggctacgtgggccaccaacattcaagtggccatcaatcaggttagacgcctcatcggcaacgagaattacctggattacatgacatccatgaagcggtttaaaaacgaaagcgaccctgagggggctctttggtga

SEQ ID NO: 18701 - RNA, 9879 nt, synthetic construct
  misc_feature 1..9879: note = derived and/or modified CDS sequence (opt5) from DENV-1__KF973460__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcatgacatgtatcgctgtcggcatggtgaccctgtacctgggggttatggtgcaggccgactctggatgcgtcattaactggaaaggccgcgaactcaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgccttgaaaatattatgtggaaacagatcagcaacgagctgaatcacatcctcctggaaaacgacatgaagtttaccgtcgtggtgggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggcttaagctccgcgatagctacacccagatgtgcgaccatcggctgatgtccgcggccatcaaagatagcaaggctgttcacgccgacatgggctattggattgaatctgagaaaaatgaaacatggaagctggccagagcttcctttatcgaggtgaagacctgtacatggcccaaaagccataccctctggtctaacggggtgctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtcgtggttgatgagcattgcggaaaccggggcccctctctgagaacaaccacggtgacaggcaagatcattcacgaatggtgttgccggagctgtacccttcctcccctccgctttagaggggaggacggatgctggtacggcatggagatccggccggtcaaagaaaaggaggaaaatctggtgagatccatggttagcgcggggtctggagaggtggactccctgagcctcggcatcctgtgtgtctccattatgatcgaagaggtgatgcgctctcggtggagcagaaagatgcttatgacagggaccctggctgttttcctcctgctgattatgggacagcttacctggaacgatctgatccgcctctgcattatggtgggcgccaatgcctccgacagaatgggcatggggacaacgtatctggctctcatggccacctttaaactgcggcctatgttcgcggtcggaatcctttttcgcagactgacatctcgggaggtgctcctgctgaccattggccttagcctggtggcttccgtcgaactccccaactctctggaggaactcggggatggactggccatgggcatcatgatgcttaagctgctcacagagttccagccccatcaactgtggaccacgctgcttagcctgacatttatcaaaaccaccctctccctggactacgcctggaagacaaccgctatggccctcagcattgtttctctgttccctctttgtctgtccacaacgagccagaaaaccacatggctgccggtgctcctggggtcttttggatgcaagccccttaccatgtatttcatcacagaaaacaagatttggggccgcaaatcctggcctatcaatgagggcattatggctatcgggatcgtgagcattctgctctcttccctgctcaagaacgatgtccccctggccggacctcttatcgcgggcgggatgctgattgcctgttacgtgatcagcggatccagcgctgacctgtctctcgagaaagccgctgaagttagctgggagcaggaagccgagcactccggcacctctcataatattctggtggaagtccaggatgacgggacgatgagaatcaaggatgaggagaaagacgatacccttacaatcctgctcaaggccaccctgctcgctgtgagcggagtttatcccatgtccattcctgcgacactgtttgtgtggtacttctggcaaaaaaagaagcagcggtctggcgtcctttgggacacccccagcccgcctgaagtggagcgcgccgtcctggatgacggcatctatagaattctgcagcgggggctcctgggacgctcccaggtgggcgttggggtgtttcaagacggagtcttccacacaatgtggcacgtgacgagaggcgctgttcttatgtaccaggggaaacggctggaaccctcttgggccagcgtgaagaaagatctcatctcctacggaggcggctggagattccaggggagctggaacaccggagaggaggtccaggtgattgccgtggaacctggcaagaatcccaaaaacgttcaaacaaccccggggacctttaagacacctgagggagaagtcggcgctatcgccctggacttcaagcccgggacgtctggatcccctattgtgaatcgcgagggcaaaatcgtgggcctctatgggaacggagtcgtgaccacaagcggcacctacgtttctgcgatcgctcaggccaaggcctcccaggaagggcccctgcccgagattgaggatgaagtgtttaaaaagcggaatcttacaatcatggacctgcatcctggaagcggcaaaaccagacgctatctgccggctattgtccgggaggccatcaagagaaagctccgcacgctgattcttgcgcccacacgggtggttgcttccgaaatggccgaggccctgaaagggatgcctatcagataccaaaccaccgctgtgaagtctgaacacacaggccgcgagatcgtcgatctcatgtgccatgccaccttcacaatgcggctgctgagccccgtgagagttcctaactataatatgattatcatggacgaggctcactttaccgatcccgcctccattgcggcccggggatacatcagcacgcgcgtgggcatgggggaagctgccgctattttcatgacagccacccctccgggatctgtcgaggcctttccccagtccaacgctgtgatccaggacgaagagagagatatccctgaacggagctggaattctggctatgactggattacagatttccccgggaaaaccgtgtggtttgtccctagcatcaagtccggaaacgacattgcgaattgtctccgcaaaaacggcaagagagttatccagctttctcggaagacgttcgacaccgagtaccaaaaaacaaagaacaatgattgggactacgtggtgaccacagatattagcgagatgggggccaactttagagctgaccgcgtcatcgatccccggagatgcctgaaaccggtgattctgaaggacggccctgaacgcgttatcctcgccggacccatgcccgtgaccgtcgcctccgctgcccagcggagaggccgcatcgggcggaatcagaacaaagagggagatcagtatgtgtacatgggccaacctctgaataacgacgaagatcatgcgcactggacagaggctaagatgcttctggacaatattaacacccccgaggggatcattcctgccctcttcgaaccggagagagaaaagtctgccgctatcgatggagagtatcgcctgagaggcgaagcccggaaaacgttcgttgagctgatgcgcagaggggacctccccgtgtggcttagctacaaggtcgcgtccgagggctttcagtatagcgatcggcgctggtgcttcgacggagaaagaaataaccaggtgctggaggaaaatatggacgtcgagatttggacaaaagaaggcgagcggaagaaactgagacctcgctggctcgatgcccggacctactctgaccccctggctcttagagagtttaaggaattcgccgctgggcgccggtccgtgagcggagatctgatcctcgagatcggcaaactgcctcagcacctgaccctcagagcccaaaacgctcttgacaatctggttatgctgcataactccgaacaggggggaaaggcctatcggcacgcgatggaggaactccccgatacaattgagaccctgatgcttctggccctcatcgctgtgctgacaggcggcgtgacgctgtttttcctctctgggaagggacttggcaaaaccagcattgggctgctgtgtgtcacagcctcctctgctctcctgtggatggccagcgttgagccgcattggatcgccgcttccattatccttgaatttttcctgatggtgctcctgatccctgagcccgaccgccagagaacccctcaggataatcaactggcgtacgtggtcattggactcctttttatgatcctgacagtggccgctaacgaaatgggcctgctcgagaccacgaagcgggacctggggattggacacgttgccgccgagaaccaccagcatgctaccatgcttgatgtggacctgcgccccgccagcgcgtggacactctacgccgtcgctaccacagtgatcacccctatgatgagacacacgattgaaaatacaaccgccaacatctctctgacagctattgccaatcaggcggccatcctgatgggcctcgataaaggctggcccatctccaagatggacattggggtcccgcttctggctctgggatgctatagccaagtgaaccctctcaccctgaccgccgctgttcttatgctggtggcccattacgctatcattggccccgggctccaggccaaagcgacacgggaggcccagaagcgcacggctgccggaatcatgaagaatcccaccgtcgatggcattgtggctatcgacctggaccctgttgtgtatgatgccaaattcgaaaagcagctggggcaaatcatgctccttattctgtgtatctctcagattctgctcatgagaacaacctgggccctgtgcgagtccatcacacttgcgaccggaccgctgacgacactctgggaaggcagccccggcaaattttggaacaccaccattgctgtctctatggccaatatcttccgggggagctacctggctggagccggcctggccttttccctcatgaagtctcttgggggaggccgcagagggacaggagctcagggcgagaccctgggcgagaaatggaagcggcagctgaaccaactcagcaagcctgaattcaatacatataaaagatccgggatcatggaggtggaccgcagcgaagccaaggagggactgaaacggggcgaaacgaccaagcacgcggtgtccagagggacagccaaacttcgctggttcgttgagcggaacctggtcaagcccgagggaaaggtgattgatctcggctgtgggagaggaggctggtcttactattgcgctggcctgaaaaaggtgaccgaagtcaaagggtacacaaagggaggccctgggcatgaggaacccatccctatggccacctacggatggaatctggttaaactccacagcggcaaggacgtgtttttcatgccgcccgagaaatgtgatacgcttctgtgcgacattggggaatcctctcctaaccccaccatcgaggagggacgcacactgcgggtgctcaagatggtcgaaccttggctgagaggcaatcagttttgtattaagatccttaacccctatatgccgagcgtggttgagaccctggaacagatgcagcgcaaacacggcgggatgctcgtgcggaatcctctgtccagaaactctacacatgagatgtactgggtcagctgcggaaccggcaatattgtgtccgctgttaacatgacaagccgcatgctgctcaaccggttcaccatggcccacagaaagcccacgtatgagcgcgatgtggacctgggggcgggaacaagacatgtcgccgtggaacccgaggtggctaatcttgatatcatcggccaacggattgaaaacatcaaaaatgagcacaagtctacctggcactacgacgaagataacccttataaaacctgggcctaccatgggtcctatgaggtcaagcccagcggatctgcttccagcatggttaatggcgtggtgcgcctgctcacaaagccttgggacgtcattccgatggtgacgcagatcgccatgaccgacacaaccccctttggccagcaaagagttttcaaagagaaggtggatacacggacccctagagctaaacgggggacaacccagattatggaagtcacggccaagtggctgtggggatttctttctcgcaacaaaaagcccagaatctgtacccgggaggaattcacacgcaaggtgagatccaatgcggccatcggcgctgtttttgtggacgagaaccagtggaatagcgccaaagaagctgtcgaggatgagcggttctgggacctggtgcaccgcgaaagagagctccataagcaggggaaatgcgccacctgcgtttacaacatgatgggaaagcgggaaaaaaagctgggcgagtttgggaaggccaaaggctcccgcgcgatttggtacatgtggctgggagctagattcctcgaatttgaggccctgggcttcatgaatgaggatcactggttcagccgggaaaactctcttagcggggtggagggagaaggcctgcataagctcgggtatatcctgcgcgacatttccaaaatccctggaggcaatatgtacgccgatgacacagctgggtgggataccagaattacggaggacgatcttcaaaacgaggccaagatcacagacatcatggaacccgagcacgctctgctcgccacctctatttttaaactgacatatcagaataaggtcgtgcgggtccagcgcccggcgaaaaacggcaccgtgatggatgttatcagcagacgggaccagagaggatccggccaagtggggacgtacggactgaacaccttcacaaatatggaagtccagctcattcgccagatggagtctgaaggcatctttctgcctagcgagcttgagacccccaacctggccgaacgggtgctcgactggctggagaagcacggggctgaaagacttaagcgcatggccatttccggagatgactgtgtggttaaacctatcgatgaccggttcgctacagccctgaccgcgctcaatgatatgggcaaggtgagaaaagacatcccccagtgggagccttctaaggggtggaacgattggcaacaggtccccttttgcagccatcacttccatcagctgattatgaaagacggccgcgaaatcgtggttccgtgtcggaatcaggatgagctggtgggaagagcccgcgtctcccaaggcgctgggtggagcctccgggagacagcctgcctgggaaagtcttatgctcagatgtggcagcttatgtactttcacagacgcgacctgcggctcgccgctaacgccatttgttccgcggtgcctgtcgattgggtgcccaccagcagaacgacatggtctatccacgcccatcaccaatggatgaccaccgaagacatgctgtccgtttggaatcgggtgtggattgaggaaaacccctggatggaggacaagacacatgtcagctcctgggaagaggtgccttatcttggcaaaagagaggatcagtggtgcgggtctctgatcggactcaccgctcgcgccacatgggccacgaatattcaggttgctatcaaccaggtgcggagactgatcggcaatgaaagctacctggactacatgacctccatgaagcgcttcaaaaacgagagcgatccggaaggggccctctggtga

SEQ ID NO: 18702 - RNA, 9879 nt, synthetic construct
  misc_feature 1..9879: note = derived and/or modified CDS sequence (opt5) from DENV-1__KF973461__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatggggggagtctttacctctgtgggcaaactggtgcatcaggtcttcgggacggcctacggagtgctttttagcggcgtttcctggaccatgaagatcgggatcggcattctgctcacatggctgggactgaatagccggtctacctcccttagcatgacatgtatcgctgtgggcatggtcaccctctacctgggggtgatggttcaagccgactctggatgcgtgattaactggaaaggcagagaactgaagtgtgggtccggaatcttcgtcacaaacgaggtgcacacctggacggaacagtataagtttcaggctgatagccctaaacgcctctccgccgcgattggcaaggcctgggaggagggggtttgcggcatccggtctgctacaagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacaccacatttatcatcgacgggcctgatacccccgaatgtcctgacaatcagcgggcttggaacatttgggaggtggaggattatggattcggcatctttacgacaaatatttggctgaagcttagagacagctacacccaaatgtgcgatcaccgcctcatgtccgcggccatcaaagacagcaaggctgtccatgccgatatgggctattggattgaatctgagaaaaacgaaacatggaagctggcccgggcttccttcatcgaggttaagacctgtacatggcccaaaagccacaccctgtggtctaatggggtgctcgaatccgagatgatcattccgaagatctacggaggccctattagccagcataactatagacccgggtacttcacgcagaccgccggaccttggcacctgggcaaacttgagctggactttgaactctgcgaggggacaaccgtggtcgtggatgaacactgcggaaatcgcggcccctctctgcggacaaccacggttacaggcaagatcattcatgagtggtgttgcagaagctgtaccctgcctccccttcggttccgcggggaggacggatgctggtacggcatggaaatcagaccggtgaaagagaaggaagagaacctcgtccggtccatggtgagcgcggggtctggagaagttgattcctttagcctgggcatcctgtgtgcttccattatgatcgaggaggtgatgagatctcgctggagccggaagatgctcatgacagggaccctggccgtcttccttctgctcattatgggacaactgacctggaatgacctgatcagactttgcattatggtgggcgccaacgcttccgaccgcatgggcatggggacaacgtatctggccctcatggcgacctttaaaatgagacctatgttcgctgttggactgctctttcggcgcctgacatctagagaagtgcttctgctcaccatcggcctgagcctggtcgcctccgtggagcttcccaactctctggaagagctcggggatggactggccatgggcattatgatgctcaagctgcttacagaattccagccccaccagctgtggaccacgctcctgagcctgacatttatcaaaaccaccctttccctggactacgcttggaagatcacagccatggctctcagcattatctctctgttccctctctgtctgtccaccacaagccagaaaacgacctggcttccggtgctgctggggtcttttggatgcaagcccctcacaatgttcctgattaccgagaataagatctggggccggaaatcctggcctcttaacgagggcattatggccatcgggatcgtcagcattctgctctcttccctgctcaagaatgatgttcccctggcgggacctcttatcgccggcgggatgctgattgcttgttatgtgatcagcggatccagcgccgacctgtctctcgaaaaagctgccgaggtgagctgggaacaagaggccgaacattccggcacatctcacaacattctggtcgaggtgcaggatgacgggaccatgaagatcaaagatgaggaacgcgacgatacgcttaccatcctgctcaaggctacactgctcgcggttagcggagtgtaccccatgtccattcctgccaccctgtttgtctggtatttctggcagaaaaagaagcagagatctggcgtgctttgggacacacccagcccgcctgaggttgaacgggctgtgctggatgacggcatctaccgcattctgcaaagagggctcctgggacggtcccaggtcggcgtgggggtcttccaggatggagtgtttcataccatgtggcacgttacacgcggcgccgtgcttatgtatcaggggaaaagactggagccctcttgggccagcgtcaagaaagacctcatctcctacggaggcggctggcggttccaagggagctggaatacgggagaggaagtgcaggttattgctgtggagcctggcaagaaccccaaaaatgtccagaccacaccggggacctttaagacccctgaaggagaggtgggcgccatcgcgctggacttcaagcccgggacatctggatcccctattgtgaacagagaaggcaaaatcgttggcctctacgggaatggagtcgtgacgaccagcggcacatatgtgtctgctatcgcccaagccaaggcttcccaggaggggcccctgcccgagattgaagatgaggtctttaaaaagcgcaaccttaccatcatggacctgcaccctggaagcggcaaaacacggagatacctgccggccattgtgcgcgaagcgatcaagcggaagctcagaaccctgattcttgctcccacgcgcgttgtggcctccgagatggccgaagctctgaaagggatgcctatccggtatcagacaaccgccgtcaagtctgagcataccggcagagagatcgtggatctcatgtgccacgctacattcaccatgcgcctgctgagccccgttcgggtgcctaattacaacatgattatcatggacgaagcccattttacagatcccgcgtccattgccgctagaggatatatcagcacccgggtcggcatgggggaggccgctgccattttcatgacggccacacctccgggatctgtggaagcttttccccagtccaatgcggttatccaagacgaggaacgcgatatccctgagagaagctggaactctggctacgactggattaccgatttccccgggaaaacagtgtggtttgtccctagcatcaagtccggaaatgacattgccaactgtctccggaaaaacggcaagcgcgtgatccagctttctagaaagaccttcgatacggagtatcagaaaaccaagaataacgactgggactacgtggtcacaaccgatattagcgaaatgggggctaatttccgggccgacagagttatcgatccccgccggtgcctgaaaccggtgattctgaaggacggccctgagagagtgatcctcgccggacccatgcccgtcacagtggcttccgccgcgcagcgccggggcagaatcgggcgcaaccaaaataaagaaggagatcagtacgtttatatgggccagcctctgaacaatgacgaggatcacgctcattggaccgaggccaagatgcttctggacaacattaatacacccgaagggatcattcctgccctctttgagccggaacgggagaagtctgctgccatcgatggagaatacagactgcgcggcgaggcgagaaaaaccttcgtggagctgatgcggcgcggggacctccccgtctggcttagctataaggtggcctccgaaggctttcagtacagcgatagacggtggtgcttcgacggagagcgcaacaatcaagttctggaagagaacatggatgtggaaatttggacgaaagagggcgagagaaagaaactgcggcctagatggctcgacgctcgcacatattctgaccccctggcccttcgggaatttaaggagttcgctgccgggagacgctccgtcagcggagatctgatcctcgaaatcggcaaactgcctcagcacctgaccctccgggctcagaatgcccttgacaacctggtgatgctgcacaattccgagcaggggggaaaggcgtacagacatgccatggaagagctccccgataccattgagacactgatgcttctggctctcatcgccgtcctgaccggcggcgtgacactgtttttcctctctgggaagggacttggcaaaacgagcattgggctgctgtgtgttaccgcttcctctgccctcctgtggatggccagcgtggaaccgcactggatcgctgcgtccattatccttgagtttttcctgatggtgctcctgatccctgaacccgaccggcaacgcacacctcaggataaccagctggcctatgtcgttattggactcctttttatgatcctgaccgtggctgccaacgagatgggcctgctcgagacaaccaagaaagacctggggattggacatgtggccgctgaaaatcaccaacacgccacgatgcttgatgtcgacctgagacccgcgagcgcctggaccctctacgctgtggccacaaccgttatcacacctatgatgcggcataccattgagaacacgacagctaatatctctctgaccgccattgcgaaccaggccgctatcctgatgggcctcgataagggctggcccatctccaaaatggacattggggtgccgcttctggccctgggatgctacagccaggtcaatcctctcacactgaccgctgccgtgcttatgctggtcgctcactatgccatcattggccccgggctccaggcgaaggccacccgcgaagctcaaaagagaacagccgctggaatcatgaaaaaccccacggtggatggcattgttgccatcgacctggatcctgtggtctacgacaccaagttcgagaaacagctggggcagatcatgctccttattctgtgtacatctcagatcctgctcatgcggaccacatgggccctgtgcgaatccattacccttgcgacgggaccgctgacaaccctctgggagggcagccccggcaagttttggaataccacaatcgctgtgtctatggccaacattttccgcgggagctatctggctggagccggcctggccttctccctcatgaaatctcttgggggaggcagacgggggaccggagctcaaggcgagacactgggcgaaaagtggaagcgccagctgaatcagctcagcaaatccgagtttaacatctacaagagaagcgggatcatggaagttgaccggtccgaggccaaagaaggactgaagagaggcgagacgaccaaacatgcggtgtctcgcgggacagccaagcttcggtggttcgtcgagagaaatctggtgaagcctgaaggaaaagtgattgatctcggctgtgggcgcggaggctggagctattactgcgctggcctgaagaaagttaccgaggtcaaggggtatacaaaaggaggccccgggcacgaagagcctatccccatggccacctacggatggaacctggtgaagctccattccggcaaagacgtgtttttcatgcctccggaaaagtgtgatacgcttctgtgcgacattggggagtctagccccaatcctaccatcgaggaaggacggacactgagagtcctcaagatggttgagccctggctgcgcggcaaccagttttgtattaaaatccttaatccttacatgccctccgtggtggaaaccctggagcaaatgcagcggaagtatggcgggatgctcgtcagaaacccgctgtctcgcaatagcacacacgagatgtactgggtgtcctgcggaaccggcaacattgttagcgctgtgaacatgacatctcggatgctgctcaatagattcaccatggcccaccgcaaacctacgtatgaacgggatgtcgacctgggggcgggaacaagacatgtggccgttgagcccgaagtggctaaccttgatatcatcggccagcgcattgagaatatcaagaacgaacacaaatccacctggcattacgacgaggataatccctataagacctgggcctaccacgggagctatgaggtcaagccttctggatccgctagctctatggtgaacggcgtggtcagactgctcacaaaaccctgggacgttattcctatggtgacgcaaatcgccatgaccgatacaaccccgtttggccagcagcgggtgttcaaggaaaaagtcgacacacgcacccccagagctaagcgggggacaacccagattatggaggtgacggccaaatggctgtggggatttctttccagaaataagaagcctcggatctgtacccgcgaagagttcacaagaaaagttcggagcaacgcggccatcggcgctgtgtttgtcgacgaaaatcaatggaactccgccaaggaggctgtggaggatgaacgcttctgggacctggttagacgggagcgcgaactccacaaacaggggaagtgcgccacctgcgtgtacaatatgatgggaaaaagagagaagaagctgggcgaatttgggaaagccaagggcagccgggcgatttggtacatgtggctgggagctcgcttcctcgagttcgaggccctgggctttatgaacgaagatcattggttctctagagagaatagcctttccggggtcgaaggagagggcctgcacaaactcgggtatatcctgcgggacatttctaagatccccggaggcaacatgtacgccgatgacacagctgggtgggatacccgcattacggaggacgatcttcagaatgaagccaaaatcacagacatcatggagcctgaacatgctctgctcgccaccagcatttttaagctgacatatcagaacaaagtggttagagtgcaacggcccgcgaagaacggcaccgtcatggatgtgatctcccgcagagaccagcggggatctggccaggtcgggacgtacggactgaataccttcacaaacatggaggtgcagctcattagacaaatggaaagcgagggcatctttctgccgtccgagcttgaaacccctaatctggccgagcgcgttctcgattggctggaaaagcacggggctgagcggcttaaaagaatggccatttctggagacgactgtgtggtcaagcccatcgatgaccgcttcgctacagccctgaccgcgctcaacgatatgggcaaagtgcggaaggacatccctcagtgggaacccagcaaagggtggaatgattggcagcaggtgcctttttgctcccatcacttccaccaactgattatgaaggacggcagagagatcgttgtgccctgtcgcaaccaggatgagctggtcggacgggccagagtgagccagggcgctgggtggtctctccgcgaaacagcctgcctgggaaagtcctatgctcaaatgtggcagcttatgtactttcatcggagagacctgcgcctcgccgctaatgccatttgtagcgcggttccggtggattgggtccctacctctcggacgacatggtccatccacgcccatcaccagtggatgaccaccgaggacatgctgagcgtgtggaacagagtctggattgaagagaatccctggatggaagataaaacacacgtgtcctcttgggaggaggttccctatcttggcaagcgggaagaccagtggtgcgggagcctgatcggactcaccgctagagccacatgggccacgaacattcaagtggctatcaatcaggtccgccggctgatcggcaacgagaattacctggactacatgacctccatgaaaagattcaagaacgaaagcgatcctgagggggccctctggtga

SEQ ID NO: 18703 - RNA, 9879 nt, synthetic construct
  misc_feature 1..9879: note = derived and/or modified CDS sequence (opt5) from DENV-1__KF973462__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacactgacctacaaatgcccgcaaatcattgaggctgaacccgacgatgtggactgttggtgcaatgccacagatacctgggtgacgtatggaacctgttcccagacaggcgagcaccgcagagacaagcggtctgtcgccctcgctcctcatgtggggctgggacttgagacccgcacagaaacctggatgagctccgagggcgcctggaaacagatccagagagttgaaacgtgggctctgcggcaccccggcttcacagtgattgccctctttctggcgcatgccatcgggacctctatcacacaaaagggaattatcttcattcttctgatgctcgtcacccctagcatggctatgcgctgcgtgggcatcgggaacagagattttgttgagggactgtccggcgccacctgggtggacgtcgtgctggagcacgggagctgtgtgacaacgatggctaagaataaacccaccctcgatattgaactgcttaagacagaggtcaccaaccctgccatcctgcggaaactctgcattgaagcgaagatctctaatacaaccacggactcccgctgtccgacacagggagaggccaccctggttgaagagcaggatgctaacttcgtgtgcagacggacctttgtggaccgcggctggggcaatgggtgtggacttttcggcaaagggagcctgctcacatgcgccaagtttaagtgcgtcaccaaactggagggaaagatcgtgcagtacgaaaacctgaaatattctgttattgtgacagtccacacgggcgatcaacatcaggtggggaatgagaccacagaacacggaaccatcgctacaattaccccccaggcccctacgtccgagatccagctcaccgactacggcgccctgacacttgactgtagccccagaaccggcctggatttcaacgaaatggttctcctgacaatgaaggagaaatcttggcttgtgcataagcaatggtttctggacctccctctgccctggacctccggggctagcacgtcccaggagacatggaatcggcaggatctgctcgtcaccttcaaaacagcgcacgccaagaagcaagaagtggtcgtgctgggatctcaggagggcgctatgcacaccgcccttaccggggccacagaaattcagacgagcggaaccacaaccatctttgctggccatctgaaatgccgcctcaagatggacaaactgacactgaaggggacctcctatgttatgtgtacgggcagcttcaaacttgagaaggaaatggccgagacacagcacggaaccgtgctcgtccaagtgaagtacgagggcaccgatgcgccgtgcaaaatccctttctctacacaggacgaaaagggggttacccagaacggaagactgattacagctaatcccatcgtgacggataaagagaagcctgtcaacattgaaaccgagcccccctttggcgagtcctatatcgtggtgggggccggagaaaaagccctgaagctcagctggttcaagaaaggctctagcattgggaagatgtttgaggctacagcccggggcgctagacgcatggccatcctgggagacaccgcgtgggatttcggctccatcgggggagtttttacatctgtcggcaaacttgtgcatcaggtgttcgggaccgcctacggagtcctgtttagcggcgtgtcctggacgatgaagattgggatcggcattctcctgacctggctgggacttaatagccggtctacatccctcagcatgacctgtatcgctgttggcatggtgacactgtacctgggggtcatggtgcaagccgactctggatgcgttattaactggaaaggcagagaactcaagtgtgggtccggaatcttcgtgaccaacgaggtccacacatggaccgaacagtataagtttcaggctgatagccctaaacgcctgtccgccgcgattggcaaggcctgggaggagggggtgtgcggcatccggtctgctacgagacttgaaaatatcatgtggaaacagattagcaacgagctgaatcatatcctcctggaaaacgacatgaagttcacagttgtggtcggagacgccaatggcattctggctcaagggaaaaagatgatccgcccgcagcccatggagcacaaatactcctggaagtcttggggaaaggccaaaattatcggcgccgatatccagaacaccacctttattatcgacgggcctgatacacccgaatgtcctgacaatcagcgggcttggaacatttgggaggtggaggattatggattcggcatctttaccacgaatatttggcttaagctcagagacagctacacacaagtgtgcgatcaccgcctgatgtccgcggccatcaaagacagcaaggctgtccatgccgatatgggctattggatcgaatctgagaaaaacgaaacctggaagctggcccgggcttccttcattgaggttaagacatgtacctggcccaaaagccacacactctggtctaatggggtgctggaatccgagatgatcattccgaagatctacggaggccctattagccagcataactatagacccgggtacttcacccagacggccggaccttggcaccttggcaaactggagctcgactttgatctgtgcgaagggaccacagtggtcgtggacgagcactgcggaaatcgcggcccctctctgcggaccacaaccgttacgggcaagatcatccatgaatggtgttgcagaagctgtacacttcctcccctccggttccgcggggaggatggatgctggtacggcatggagattagaccggtgaaagaaaaggaggaaaacctggtccggtccatggtgagcgcggggtctggagaggttgactcctttagcctgggcatcctctgtgcttccattatgatcgaagaggtgatgagatctcgctggagccggaagatgctgatgaccgggacacttgccgtcttcctgctcctgattatgggacaactgacctggaatgaccttatcagactgtgcattatggtgggcgccaacgcttccgatcgcatgggcatggggaccacatatctcgccctgatggcgacgtttaaaatgagacctatgttcgctgttggactcctgtttcggcgccttacctctagagaggtgctgctcctgacaatcggcctgagccttgtcgcctccgtggaactgcccaactctctcgaggaactgggggacggactcgccatgggcatcatgatgctgaagcttctgaccgagttccagccccaccagctctggacaaccctgctgagccttacgtttattaaaacaaccctgtccctcgattacgcttggaagaccacagccatggctctgagcatcatttctctcttccctctgtgtctttccaccacaagccagaaaacgacctggctgccggtgctgctcgggtcttttggatgcaagcccctgacaatgttccttatcaccgaaaataagatttggggccggaaatcctggcctctgaacgagggcatcatggccatcgggattgtcagcatcctcctgtcttccctcctgaagaatgacgttccccttgcgggacctctgattgccggcgggatgctgatcgcttgttatgtgattagcggatccagcgccgatctctctctggagaaagctgccgaagtgagctgggagcaagaagccgagcattccggcacatctcacaacatccttgtcgaagtgcaggacgatgggaccatgaagatcaaagacgaggagcgcgatgacacgctgaccattctcctgaaggctacactcctggcggttagcggagtgtaccccatgtccatccctgccaccctttttgtctggtatttctggcagaaaaagaagcagagatctggcgtgctgtgggatacacccagcccgcctgaagttgagcgggctgtgctggacgatggcatttaccgcatcctccaaagagggctgcttggacggtcccaggtcggcgtgggggtcttccaggacggagtgtttcataccatgtggcacgttacacgcggcgccgtgctgatgtatcaggggaaaagactcgaaccctcttgggccagcgtcaagaaagacctgatttcctacggaggcggctggcggttccaagggagctggaatacgggagaggaggtgcaggttatcgctgtggaacctggcaagaaccccaaaaatgtccagaccacaccggggacctttaagacccctgagggagaagtgggcgccattgcgctcgatttcaagcccgggacatctggatcccctatcgtgaacagagagggcaaaatcgttggcctgtacgggaatggagtcgtgacgaccagcggcacatatgtgtctgctattgcccaagccaaggtctcccaggaagggccccttcccgagatcgaggacgaagtgtttaaaaagcgcaacctgaccattatggatctgcaccctggaagcggcaaaacacggagatacctcccggctatcgttcgcgaggccattaagcggaagctgagaacccttatcctggcgcccacgcgcgtggtcgcttccgaaatggccgaggccctcaaagggatgcctatccggtatcagacaaccgctgtgaagtctgaacataccggcagagagattgttgacctgatgtgccacgccacattcaccatgcgcctgctcagccccgtgcgggtccctaattacaacatgatcattatggatgaggctcattttacagaccccgcctccatcgcggccagaggatatattagcacccgggtgggcatgggggaagctgccgctatcttcatgacggccacacctccgggatctgttgaggcctttccccagtccaatgctgtgatccaagatgaagagcgcgacattcctgaaagaagctggaactctggctacgattggatcaccgacttccccgggaaaacagtctggtttgtgcctagcattaagtccggaaatgatatcgcgaactgtcttcggaaaaacggcaagcgcgtgattcagctgtctagaaagaccttcgacacggagtatcagaaaaccaagaataacgactgggattacgtcgttacaaccgacatcagcgagatgggggccaatttccgggctgatagagtgattgacccccgccggtgcctgaaaccggtgatcctcaaggatggccctgaaagagtcatcctggccggacccatgcccgtgacagttgcctccgctgcccagcgccggggcagaattgggcgcaaccaaaataaagagggagaccagtacgtgtatatgggccagcctcttaacaatgatgaagaccacgcgcattggaccgaggctaagatgctgctcgataacatcaatacacccgaggggattatccctgccctgtttgaaccggagcgggaaaagtctgccgctattgacggagagtacagactgcgcggcgaagccagaaaaaccttcgtcgagctcatgcggcgcggggatcttcccgtgtggctgagctataaggttgcgtccgagggctttcagtacagcgacagacggtggtgcttcgatggagaacgcaacaatcaagtgctggaggaaaacatggacgtcgagatctggacgaaagaaggcgagagaaagaaactccggcctagatggctggacgcccgcacatattctgatccccttgctctgcgggagtttaaggaattcgccgctgggagacgctccgtgagcggagacctcatcctggagattggcaaactgcctcagcacctcacccttcgggcccagaatgctctggataacctggtcatgctccacaattccgaacaggggggaaaggcctacagacatgcgatggaggaactgcccgacaccatcgagacacttatgctgctcgccctgattgctgtgctgaccggcggcgttacactctttttcctttctgggaagggactgggcaaaacgagcatcgggctgctctgtgtgaccgcctcctctgctctgctttggatggccagcgtggagccgcactggattgccgcttccatcatcctggaatttttcctcatggtcctgctgattcctgagcccgatcggcaacgcacacctcaggacaaccagctcgcgtatgttgtgatcggacttctgtttatgattctgaccgtggccgctaacgaaatgggcctcctggagacaaccaagaaagatcttgggatcggacatgtcgccgccgagaatcaccaacacgctacgatgctggacgtggatctcagacccgccagcgcgtggaccctgtacgccgttgctacaaccgtgattacacctatgatgcggcataccatcgaaaacacgacagccaatatttctctgaccgctatcgccaaccaggcggccatcctcatgggccttgacaagggctggcccatttccaaaatggatatcggggtcccgctgctggctctcggatgctacagccaggtgaatcctctgacacttaccgccgctgtcctgatgctcgtggcccactatgctattatcggccccgggctgcaggccaaggcgacccgcgaggcccaaaagagaacagctgccggaattatgaaaaaccccacggttgacggcatcgtggctatcgatctggaccctgtcgtgtacgacaccaagttcgaaaaacagctcgggcagattatgcttctgatcctgtgtacatctcagattctcctgatgcggaccacatgggccctttgcgagtccatcaccctggccacgggaccgctcacaaccctgtgggaaggcagccccggcaagttttggaataccacaattgcggtttctatggctaacatcttccgcgggagctatctggccggagctggcctcgccttctcccttatgaaatctctggggggaggcagacgggggaccggagcccaaggcgagacactgggcgagaagtggaagcgccagctcaatcagctgagcaaatccgaatttaacatctacaagagaagcgggattatggaggtggatcggtccgaagctaaagagggacttaagagaggcgaaacgaccaaacatgccgtctctcgcgggacagcgaagctgcggtggttcgtggagagaaatctcgtgaagcctgagggaaaagttatcgacctgggctgtgggcgcggaggctggagctattactgcgccggcctgaagaaagtcaccgaagtgaaggggtatacaaaaggaggccccgggcacgaggaacctattcccatggctacctacggatggaacctcgtgcggcttcattccggcaaggatgtctttttcatgcctccggagaaatgtgacacgctgctgtgcgatatcggggaatctagccccaatcctaccattgaggagggaagaacactccgcgttctgaagatggtggaaccctggcttcggggcaaccagttttgtatcaagattctgaatccttacatgccctccgtggtcgagaccctcgaacaaatgcagagaaaatatggcgggatgctggtgcgcaacccgctgtctcggaatagcacacacgagatgtactgggtttcctgcggaaccggcaacatcgtgagcgccgtcaacatgacatctagaatgctcctgaatcgcttcaccatggctcaccggaagcctacgtatgagagagacgtggatcttggggccggaacacgccatgttgcggtggaacccgaggtcgccaacctggacatcattggccagagaatcgaaaatattaaaaacgagcacaagtccacctggcattacgatgaagacaatccctataaaacctgggcttaccacgggagctatgaggtgaagccttctggatccgccagctctatggtgaacggcgtcgttcggctcctgacaaagccctgggatgtgatccctatggtgacgcaaattgctatgaccgacacaaccccgtttggccagcagcgcgtcttcaaagagaaggtggacacaagaaccccccgggccaaaagagggacaacccagatcatggaagttacggctaagtggctttggggatttctgtcccggaataaaaagcctcgcatctgtaccagagaggaattcacacggaaggtgcgcagcaacgccgcgattggcgccgtctttgtggatgagaatcaatggaactccgctaaagaagccgttgaggacgagagattctgggatctcgtgcaccgggaacgcgagctgcataagcaggggaaatgcgctacctgcgtctacaatatgatgggaaagagagaaaaaaagctgggcgagtttgggaaggccaaaggcagccgggccatctggtacatgtggctcggagcgcgcttcctggaattcgaggctcttggctttatgaacgaggaccactggttctctagagaaaatagcctgtccggggtggagggagaaggcctccataagctggggtatattcttcgggatatctctaaaattcccggaggcaacatgtacgccgacgatacagccgggtgggacacccgcatcacggaggatgacctgcagaatgaggctaagatcacagatattatggaacctgagcacgccctcctggctaccagcatctttaaactgacatatcagaacaaggttgtgagagtccaacggcccgccaaaaacggcaccgtgatggacgtcatttcccgcagagatcagcggggatctggccaggtggggacgtacggactcaataccttcacaaacatggaagttcagctgatcagacaaatggagagcgaaggcatttttcttccgtccgagctggagacccctaatctcgcgaagcgcgtgctggactggcttgaaaagcatggggccgagcggctgaaaagaatggctatctctggagacgattgtgtcgtgaagcccatcgacgatcgcttcgccacagctctcaccgccctgaacgacatgggcaaaattcggaaggatatccctcagtgggaacccagcaaagggtggaatgactggcagcaggtgcctttttgctcccaccacttccatcaactgattatgaaggatggcagagagatcgttgtgccctgtcgcaaccaggacgaactcgtcggacgggcgagagtgagccagggcgccgggtggtctctgcgcgagacagcttgccttggaaagtcctatgcccaaatgtggcagctgatgtactttcaccggagagatctccgcctggctgccaatgctatttgtagcgccgttccggtggactgggtccctacctctcggacgacatggtccatccatgcgcaccaccagtggatgaccaccgaggatatgcttagcgtgtggaacagagtctggattgaagagaatccctggatggaagacaaaacacatgtgtcctcttgggaggaagttccctatctgggcaagcgggaggaccagtggtgcgggagcctcatcggactgaccgccagagctacatgggccacgaacatccaagtggccattaatcaggtccgccggctgatcggcaacgagaattacctcgattacatgacctccatgaaaagattcaagaacgaaagcgaccctgagggggctctgtggtga

SEQ ID NO: 18704 - RNA, 9879 nt, synthetic construct
  misc_feature 1..9879: note = derived and/or modified CDS sequence (opt5) from DENV-1__KF973463__SS-prME
  source 1..9879: mol_type = other RNA
tccgtgaccatgctgctgatgctgatgcccaccgcccttgctttccacctgacgacccggggcggggaacctcatatgatcgtctccaagcacgaacggggaaaagccctgctgtttaagacctctaccggcgttaatatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccagacaggcgagcatagacgggacaagcgctccgtcgccctggctcctcacgtggggctgggactcgagaccagaacggaaacatggatgtctagcgagggcgcctggaaacaaattcagcgggttgaaacctgggctctgcgccatcccggcttcacagtgatcgccctttttctggcgcacgccattgggacctccatcacccagaagggaatcattttcatcctcctgatgcttgtcacaccttctatggctatgagatgcgtgggcattgggaaccgggattttgttgagggactgagcggcgccacgtgggtggacgtcgtgctcgagcacgggtcctgtgtgaccacaatggctaagaataaacccaccctggatatcgaactgctcaagacagaggtcaccaaccctgccgttctgcgcaaactttgcattgaagcgaagatcagcaatacgacaaccgactctagatgtccgacccagggagaggccacactggtggaagaacaagatgctaacttcgtgtgccggcgcacctttgtcgacagaggctggggcaatgggtgtggactcttcggcaaagggtccctgcttacatgcgccaagtttaagtgcgtgacgaaactggagggaaagattgttcagtacgaaaacctcaaatatagcgtgatcgtcaccgtgcatacaggcgatcagcaccaggttgggaatgagaccacagaacatggaaccatcgctacgattacaccccaagcccctacatctgagatccagctgaccgactacggcgccctgacactcgactgtagcccccggaccggcctggatttcaacgaaatggtgcttctgacgatgaaggagaaaagctggctcgtccacaagcagtggtttctggaccttcctctgccctggacatctggggcttccaccagccaggagacatggaatcgccaagatctcctggtgaccttcaaaaccgcgcacgccaagaagcaggaagtcgtggttctgggatcccaggagggcgctatgcatacagccctcacgggggccaccgaaattcaaacatctggaaccacaaccatctttgctggccacctgaaatgcagacttaagatggacaaactgacgctcaaggggacaagctatgtgatgtgtaccggctccttcaaactggagaaggaagtcgccgagacccagcatggaacagtgctggttcaggtgaagtacgagggcaccgatgcgccgtgcaaaattcctttcagcacacaggacgaaaagggggtcacgcaaaacggacggcttatcaccgctaatcccatcgtgacagataaagagaagcctgtgaacattgaaaccgagccgccctttggcgagtcttatatcgttgtcggggccggagaaaaagccctcaagctgtcctggttcaagaaaggcagctctattgggaagatgtttgaggctacagccagaggcgctcgccggatggccatcctgggagacaccgcgtgggatttcggcagcattgggggagtgtttacgtccgtgggcaaactcgtccaccaggtgttcgggaccgcctacggagttctgttttctggcgtgagctggacaatgaagatcgggatcggcattcttctgacctggctcggactcaattccagaagcacatctctgtccatgacctgtatcgctgtcggcatggtgacactttacctcggggttatggtgcaggccgacagcggatgcgtcattaactggaaaggccgcgaactgaagtgtgggtctggaatcttcgtgaccaacgaggttcatacgtggacagaacagtataagtttcaagctgattcccctaaacggctgagcgccgcgattggcaaggcctgggaggagggggtgtgcggcatcagatccgctacccgcctcgaaaatattatgtggaaacagatctctaacgagctgaatcacatccttctggaaaacgacatgaagttcaccgtcgtggtgggagacgccaatggcattctcgctcaggggaaaaagatgatccggccgcagcccatggagcacaaatacagctggaagtcctggggaaaggccaaaattatcggcgccgatattcaaaacacaacctttatcatcgacgggcctgatacgcccgaatgtcctgacgatcagagagcttggaatatttgggaggtcgaggactatggattcggcatctttacaaccaacatttggctgaagctgcgcgattcttacacacagatgtgcgaccatcggcttatgagcgcggccatcaaagattccaaggctgttcacgccgacatgggctattggattgaaagcgagaaaaatgaaacctggaagctcgccagagcttctttcatcgaggtgaagacatgtacctggcccaaatcccatacgctgtggagcaacggggtgctggaatctgagatgatcattccgaagatctacggaggccctatttcccagcacaattatcgccccgggtacttcacccaaacagccggaccttggcacctcggcaaactggagcttgattttgacctgtgcgaagggaccacagtcgtggttgatgagcattgcggaaaccggggccccagcctcagaaccacgacagtgaccggcaagatcattcacgaatggtgttgccggtcttgtacactgcctcccctgcgcttcagaggggaggacggatgctggtacggcatggagatccggccggtcaaagaaaaggaggaaaatcttgtgagaagcatggtttccgcggggagcggagaggtggactctttttccctcggcatcctgtgtgtcagcattatgatcgaagaggtgatgcgctcccggtggtctagaaagatgctgatgaccgggaccctcgctgttttcctgcttctgattatgggacagctcacatggaacgatctgatccgcctgtgcattatggtgggcgccaatgccagcgacaaaatgggcatggggacgacctatcttgctctgatggccacatttaagatgagacctatgttcgcggtcggaatcctctttcggcgcctgacctccagagaggtgctcctgcttacaattggcctgtctctcgtggctagcgtcgaactgcccaactccctggaggaacttggggatggactggccatgggcatcatgatgctcaaactgctcaccgagttccagccccatcaactgtggacgacacttctgtctctcacctttatcaagaccacactgagcctggactacgcctggaaaaccacagctatggccctttccattgttagcctgttccctctctgtctgtctacgacctcccagaagacaacctggctcccggtgctgcttgggagctttggatgcaagcccctgacaatgttcctgatcaccgaaaacaaaatttggggccggaagtcttggcctatcaatgagggcattatggctatcgggatcgtgtccattctcctgagctctcttctgaaaaacgatgtccccctcgccggacctctgatcgcgggcgggatgctcattgcctgttatgtgatctccggaagctccgctgacctgagccttgagaaggccgctgaagtttcttgggagcaggaagccgagcacagcggcacgtcccataatattctggtggaagtccaggatgacgggaccatgcgcatcaaagatgaggagaaggacgatacactgaccatcctcctgaaagccacacttctggctgtgtctggagtttaccccatgagcattcctgcgaccctctttgtgtggtatttctggcaaaagaagaaacagagatccggcgtcctgtgggacacaccctctccgcctgaagtggagcgggccgtcctcgatgacggcatctaccgcattctgcagagagggcttctgggacggagccaggtgggcgttggggtgttccaagacggagtctttcacacgatgtggcacgtgacccgcggcgctgttctgatgtatcaggggaagagactcgaaccctcctgggcctctgtgaaaaaggatctgatcagctacggaggcggctggcggttccaggggtcctggaacacaggagaggaggtccaggtgattgccgtggaacctggcaaaaatcccaagaacgttcaaaccaccccggggacatttaagacgagcgagggagaagtcggcgctatcgcccttgacttcaaacctgggacctctggatcccccattgtgaatagagagggcaagatcgtgggcctgtacgggaacggagtcgtgacaaccagcggcacatatgtttctgcgatcgctcaggccaaaacctcccaggaagggcctctccccgagattgaggatgaagtgtttaagaaacgcaatctgacgatcatggacctccatcccggaagcggcaagacacggagatacctgcctgccattgtccgcgaggctatcaagaagaaacttcggaccctgattctggccccgaccagagtggttgcgtccgaaatggctgaggccctcaaagggatgcccatccgctatcaaacaaccgccgtgaaatctgaacacacaggccgggagatcgtcgatctgatgtgccatgctaccttcacgatgagacttctgagccctgtgcgcgttcccaactacaatatgattatcatggacgaggcccactttacagatcctgcttccattgccgcgcggggatatatcagcaccagagtgggcatgggggaagccgctgccattttcatgacagctacaccccctggatctgtcgaggcctttccgcagtccaacgccgtgatccaggacgaagaacgggatatccccgaacgcagctggaactctggctacgactggattacggatttccctgggaaaaccgtgtggtttgtccccagcatcaagtccggaaacgacattgctaattgtctcagaaagaacggcaaacgggttatccagctgtctcgcaagacattcgacaccgagtatcagaagaccaagaacaatgattgggactacgtggtgaccacagatattagcgagatgggggcgaacttcagagccgaccgggtcatcgatcctagacgctgcctgaaacccgtgattctcaaggacggcccggaacgggttatccttgctggacctatgcccgtgaccgtcgcctccgccgctcagagacgcggccggatcgggagaaatcagaacaaggagggagatcagtacgtgtatatgggccaacccctgaataacgacgaagatcatgcccactggacggaggcgaaaatgctgctcgacaatattaacacacctgaggggatcattcccgctctgtttgaacctgagcgcgaaaagtctgccgccatcgatggagagtaccggcttagaggcgaagctcgcaaaaccttcgttgagctgatgagaagaggggacctcccggtgtggctgagctataaggtcgcctccgagggctttcagtacagcgatcgcagatggtgcttcgacggagaacggaataaccaggtgctggaggaaaatatggacgtcgagatttggaccaaagaaggcgagcgcaagaaactcagaccccggtggcttgatgcgagaacatattctgaccctctggccctgcgcgagtttaaggagttcgctgccgggcggagatccgtgagcggagatctcatcctggagatcggcaaacttccccagcacctgaccctccgcgctcaaaacgccctggacaatctggttatgctccataactccgaacaagggggaaaggcttaccggcacgccatggaggaacttcctgatacaattgagacgctgatgctgctcgcgctgatcgccgtgcttaccggcggcgtgacactgtttttcctctctgggaagggactgggcaaaaccagcattgggctgctctgtgtcacagcttcctctgcccttctgtggatggctagcgttgagccccattggatcgccgcctccattatcctggaatttttcctcatggtgctgcttatcccggagcctgacagacagcggacaccccaggataatcaactggcttatgtggtcattggactcctgtttatgatcctgacggtggcggccaacgaaatgggcctccttgagaccacaaagcgcgacctggggattggacacgttgctgccgagaaccaccagcatgccaccatgctggatgtggacctcagacctgctagcgcctggacactgtacgcggtcgccaccacggtgatcacacccatgatgcggcacaccattgaaaatacaaccgctaacatctctcttaccgccattgctaatcaggccgcgatcctgatgggcctcgataaaggctggcctatctccaagatggacattggggtccccctgctggccctcggatgctacagccaagtgaacccgcttacactgacggctgccgttctgatgctcgtggctcattatgccatcattggccctgggctgcaggctaaggccacccgcgaggcgcagaaaagaacagccgctggaatcatgaagaatcccaccgtcgatggcattgtggccatcgaccttgaccccgttgtgtacgatgctaaattcgaaaagcagctggggcaaatcatgctcctgattctgtgtacatctcagatcctccttatgcggaccacgtgggccctgtgcgagtccattacactggccaccggacctctcaccacactgtgggaaggcagcccgggcaaattttggaacaccacaatcgcggtctctatggctaatattttccgcgggagctatcttgccggagctggcctggccttctccctcatgaagtctctcgggggaggcagacgggggacgggagcccagggcgagaccctgggcgagaagtggaaacgccagctcaaccaacttagcaagcccgaatttaatacatacaaaagatccgggatcatggaggtggaccggagcgaagctaaggagggactgaaaagaggcgaaaccacaaagcacgccgtgtcccgcgggaccgcgaagctgcggtggttcgttgagagaaacctcgtcaaacctgagggaaaggtgatcgatctgggctgtgggcgcggaggctggtcttattactgcgccggccttaaaaaggtgacggaagtcaaagggtataccaagggaggccccgggcatgaggaacctattcccatggctacatacggatggaatctggttaaactccacagcggcaaggacgtgtttttcatgcctccggagaagtgtgataccctgctgtgcgacatcggggaatcctctcccaaccctacaattgaggagggacggaccctcagagtgcttaaaatggtcgaaccctggctgcgcggcaatcagttttgtatcaagattctgaacccttacatgcccagcgtggttgagacactcgaacagatgcagcggaaacacggcgggatgctggtgagaaatccgctttcccgcaactctacccatgagatgtattgggtcagctgcggaacgggcaatatcgtgtccgccgttaacatgacaagccggatgctgctcaacagattcaccatggctcaccgcaagcctacctacgagcgggatgtggacctgggggccggaacaagacatgtcgcggtggaacccgaggtggccaatctggatattatcggccaacgcatcgaaaacattaaaaatgagcacaagtctacgtggcactatgacgaagataacccctacaagacctgggcttatcatgggtcctacgaggtcaaacctagcggatctgcctccagcatggttaatggcgtggtgagactcctgacaaagccctgggacgtcatccctatggtgacccagattgctatgacagacaccacaccgtttggccagcaacgggttttcaaagagaaggtggatacccgcacgcccagagccaaacgggggaccacacagatcatggaagtcaccgctaagtggctttggggatttctgtctagaaacaagaaacctcggatttgtacacgcgaggagttcaccagaaaggtgcggtccaatgccgcgatcggcgccgtttttgtggacgagaaccagtggaatagcgctaaagaagccgtcgaggatgagcgcttctgggacctcgtgcacagagaacgggagctgcataagcaggggaaatgcgctacgtgcgtttataacatgatgggaaagcgcgaaaagaaacttggcgagtttgggaaggccaaaggctccagagccatctggtacatgtggctgggagcgcggttcctcgagttcgaggctctgggctttatgaatgaggatcactggttcagccgcgaaaactctctgagcggggtggagggagaaggcctccataagctggggtacattcttagagacatctccaaaattcccggaggcaatatgtatgccgatgacacagccgggtgggatacccggatcacagaggacgatctgcaaaacgaggctaagattaccgacatcatggaacctgagcacgccctcctggctacgtctatctttaaacttacctaccagaataaggtcgtgcgcgtccagagacccgccaagaacggcacagtgatggatgttattagccggcgcgaccagagaggatccggccaagtggggacctatggactgaacacattcaccaatatggaagtccagctcatccggcagatggagtctgaaggcatttttctgccgagcgagctggagacacctaacctcgcggaaagagtgctggactggcttgagaaacacggggccgaacgcctgaagcggatggctatctccggagatgactgtgtggttaaacccattgatgacagattcgccaccgctctcacggccctgaatgatatgggcaaggtgcgcaaagacatccctcagtgggagccctctaaggggtggaacgattggcaacaggtccctttttgcagccatcacttccatcagcttatcatgaaggacggccgggaaattgtggttccctgtagaaatcaggatgagctggtgggacgcgcgcgggtctcccaaggcgccgggtggagcctcagagagacagcttgcctgggaaaatcttacgcccagatgtggcagctgatgtattttcaccgccgggacctcagactggctgccaacgctatctgttccgccgtgccggtcgattgggtgcctaccagccgcaccacatggtctattcacgcgcatcaccaatggatgaccacagaagacatgctttccgtttggaatcgggtgtggatcgaggaaaacccctggatggaggacaagacgcatgtcagctcctgggaagaggtgccctacctgggcaaaagagaggatcagtggtgcgggtctctcattggactgaccgcccgggctacatgggccaccaatatccaggttgccattaaccaggtgagacgccttatcggcaatgaaaactatctggactacatgacaagcatgaagcggttcaaaaatgagtccgatcctgaaggggctctctggtga

SEQ ID NO: 18705 - RNA, 9879 nt, synthetic construct
  misc_feature 1..9879: note = derived and/or modified CDS sequence (opt5) from DENV-1__KF973464__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaagcttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggaccctggccgtcttccttctgctcatcatgggacaactgacctggaatgacctgattagactttgcatcatggtgggcgccaacgcttccgatcgcatgggcatggggacaacgtatctggccctcatggcgacctttaaaatgagacctatgttcgctgttggactgctctttcggcgcctgacatctagagaggtgcttctgctcaccattggcctgagcctggtcgcctccgtggaacttcccaactctctggaggaactcggggacggactggccatgggcatcatgatgctcaagctgcttacagagttccagccccaccagctgtggaccacgctcctgagcctgacatttatcaaaaccaccctttccctggattacgcttggaagacaaccgccatggctctcagcattatctctctgttccctctctgtctgtccacaacgagccagaaaaccacatggcttccggtgctgctggggtcttttggatgcaagcccctcaccatgttcctgattacagaaaataagatctggggccggaaatcctggcctcttaacgagggcattatggccatcgggatcgtcagcattctgctctcttccctgctcaagaatgacgttcccctggcgggacctcttatcgccggcgggatgctgattgcttgttatgtgatcagcggatccagcgccgatctgtctctcgagaaagctgccgaagtgagctgggagcaagaagccgagcattccggcacctctcacaacattctggtcgaagtgcaggacgatgggacgatgaagatcaaagacgaggagcgcgatgacacccttacaatcctgctcaaggctaccctgctcgcggttagcggagtgtaccccatgtccattcctgccacactgtttgtctggtatttctggcagaaaaagaagcagagatctggcgtgctttgggatacccccagcccgcctgaagttgagcgggctgtgctggacgatggcatctaccgcattctgcaaagagggctcctgggacggtcccaggtcggcgtgggggtcttccaggacggagtgtttcatacaatgtggcacgttacgcgcggcgccgtgcttatgtatcaggggaaaagactggaaccctcttgggccagcgtcaagaaagacctcatctcctacggaggcggctggcggttccaagggagctggaataccggagaggaggtgcaggttattgctgtggaacctggcaagaaccccaaaaatgtccagacaaccccggggatctttaagacccctgagggagaagtgggcgccattgcgctggatttcaagcccgggacatctggatcccctatcgtgaacagagagggcaaaatcgttggcctctacgggaatggagtcgtgacgaccagcggcacatatgtgtctgctattgcccaagccaaggcttcccaggaagggcccctgcccgagatcgaggacgaagtctttaaaaagcgcaaccttaccattatggatctgcaccctggaagcggcaaaacacggagatacctgccggccatggtgcgcgaggcgatcaagcggaagctcagaaccctgattcttgctcccacgcgcgttgtggcctccgaaatggccgaggctctgaaagggatgcctatccggtatcagacaaccgccgtcaagtctgaacataccggcagagagatcgtggacctcatgtgccacgctacattcaccatgcgcctgctgagccccgttcgggtgcctaattacaacatgattatcatggatgaggcccattttacagaccccgcgtccattgccgctagaggatatatcagcacccgggtcggcatgggggaagccgctgccattttcatgacggccacacctccgggatctgtggaggcttttccccagtccaatgcggttatccaagatgaagagcgcgacatccctgaaagaagctggaactctggctacgattggattaccgacttccccgggaaaacagtgtggtttgtccctagcatcaagtccggaaatgatattgccaactgtctccggaaaaacggcaagcgcgtgatccagctttctagaaagaccttcgacacggagtatcagaaaaccaagaataacgactgggattacgtggtcacaaccgacattagcgagatgggggctaatttccgggccgatagagttatcgacccccgccggtgcctgaaaccggtgattctgaaggatggccctgaaagagtgatcctcgccggacccatgcccgtcacagtggcttccgccgcgcagcgccggggcagaatcgggcgcaaccaaaataaagagggagaccagtacgtttatatgggccagcctctgaacaatgatgaagaccacgctcattggaccgaggccaagatgcttctggataacattaatacacccgaggggatcattcctgccctctttgaaccggagcgggaaaagtctgctgccatcgacggagagtacagactgcgcggcgaagcgagaaaaaccttcgtggagctgatgcggcgcggggatctccccgtctggcttagctataaggtggcctccgagggctttcagtacagcgacagacggtggtgcttcgatggagaacgcaacaatcaagttctggaggaaaacatggacgtggagatttggacgaaagaaggcgagagaaagaaactgcggcctagatggctcgacgctcgcacatattctgatcccctggcccttcgggagtttaaggaattcgctgccgggagacgctccgtcagcggagacctgatcctcgagatcggcaaactgcctcagcacctgaccctccgggctcagaatgcccttgataacctggtgatgctgcacaattccgaacaggggggaaaggcgtacagacatgccatggaggaactccccgacaccattgagacactgatgcttctggctctcatcgccgtcctgaccggcggcgtgacactgtttttcctctctgggaagggacttggcaaaacgagcattgggctgctgtgtgttaccgcttcctctgccctcctgtggatggccagcgtggagccgcactggatcgctgcgtccattatccttgaatttttcctgatggtgctcctgatccctgagcccgatcggcaacgcacacctcaggacaaccagctggcctatgtcgttattggactcctttttatgatcctgaccgtggctgccaacgaaatgggcctgctcgagacaaccaagaaagatctggggattggacatgtggccgctgagaatcaccaacacgccacgatgcttgacgtcgatctgagacccgcgagcgcctggaccctctacgctgtggccacaaccgttatcacacctatgatgcggcataccattgaaaacacgacagctaatatctctctgaccgccattgcgaaccaggccgctatcctgatgggcctcgacaagggctggcccatctccaaaatggatattggggtgccgcttctggccctgggatgctacagccaggtcaatcctctcacactgaccgctgccgtgcttatgctggtcgctcactatgccatcattggccccgggctccaggcgaaggccacccgcgaggctcaaaagagaacagccgctggaatcatgaaaaaccccacggtggacggcattgttgccatcgatctggaccctgtggtctacgacaccaagttcgaaaaacagctggggcagatcatgctccttattctgtgtacatctcagatcctgctcatgcggaccacatgggccctgtgcgagtccattacccttgcgacgggaccgctgacaaccctctgggaaggcagccccggcaagttttggaataccacaatcgctgtgtctatggccaacattttccgcgggagctatctggctggagccggcctggccttctccctcatgaaatctcttgggggaggcagacgggggaccggagctcaaggcgagacactgggcgagaagtggaagcgccagctgaatcagctcagcaaatccgaatttaacatctacaagagaagcgggatcatggaggttgatcggtccgaagccaaagagggactgaagagaggcgaaacgaccaaacatgcggtgtctcgcgggacagccaagcttcggtggttcgtcgagagaaatctggtgaagcctgagggaaaagtgattgacctcggctgtgggcgcggaggctggagctattactgcgctggcctgaagaaagttaccgaagtcaaggggtatacaaaaggaggccccgggcacgaggaacctatccccatggccacctacggatggaacctggtgaagctccattccggcaaagatgtgtttttcatgcctccggagaagtgtgacacgcttctgtgcgatattggggaatctagccccaatcctaccatcgaggagggacggacactgagagtcctcaagatggttgaaccctggctgcgcggcaaccagttttgtattaaaatccttaatccttacatgccctccgtggtggagaccctggaacaaatgcagcggaagtatggcgggatgctcgtcagaaacccgctgtctcgcaatagcacacacgagatgtactgggtgtcctgcggaaccggcaacattgttagcgctgtgaacatgacatctcggatgctgctcaatagattcaccatggcccaccgcaaacctacgtatgagcgggacgtcgatctgggggcgggaacaagacatgtggccgttgaacccgaggtggctaaccttgacatcatcggccagcgcattgaaaatatcaagaacgagcacaaatccacctggcattacgatgaagacaatccctataagacctgggcctaccacgggagctatgaggtcaagccttctggatccgctagctctatggtgaacggcgtggtcagactgctcacaaaaccctgggatgttattcctatggtgacgcaaatcgccatgaccgacacaaccccgtttggccagcagcgggtgttcaaggagaaagtcgacacacgcacccccagagctaagcgggggacaacccagattatggaagtgacggccaaatggctgtggggatttctttccagaaataagaagcctcggatctgtacccgcgaggaattcacaagaaaagttcggagcaacgcggccatcggcgctgtgtttgtcgatgagaatcaatggaactccgccaaggaagctgtggaggacgagcgcttctgggatctggttcacagagaacgggagctccataaacaggggaagtgcgccacctgcgtgtacaatatgatgggaaaacgcgaaaagaagctgggcgagtttgggaaagccaagggcagcagagcgatttggtacatgtggctgggagctcggttcctcgaattcgaggccctgggctttatgaacgaggaccactggttctctcgcgaaaatagcctttccggggtcgagggagaaggcctgcataaactcgggtatatcctgagagatatttctaagatccccggaggcaacatgtacgccgacgatacagctgggtgggacacccggattacggaggatgaccttcagaatgaggccaaaatcacagatatcatggaacctgagcacgctctgctcgccaccagcatttttaagctgacatatcagaacaaagtggttcgcgtgcaaagacccgcgaagaacggcaccgtcatggacgtgatctcccggcgcgatcagagaggatctggccaggtcgggacgtacggactgaataccttcacaaacatggaagtgcagctcattcggcaaatggagagcgaaggcatctttctgccgtccgagcttgagacccctaatctggccgaaagagttctcgactggctggagaagcatggggctgaacgccttaaacggatggccatttctggagacgattgtgtggtcaagcccatcgacgatagattcgctacagccctgaccgcgctcaacgacatgggcaaagtgcgcaaggatatccctcagtgggagcccagcaaagggtggaatgactggcagcaggtgcctttttgctcccaccacttccatcaactgattatgaaggatggccgggaaatcgttgtgccctgtagaaaccaggacgagctggtcggacgcgcccgggtgagccagggcgctgggtggtctctcagagagacagcctgcctgggaaagtcctatgctcaaatgtggcagcttatgtactttcaccgccgggatctgagactcgccgctaatgccatttgtagcgcggttccggtggactgggtccctacctctcgcacgacatggtccatccatgcccaccaccagtggatgaccaccgaagatatgctgagcgtgtggaaccgggtctggattgaggaaaatccctggatggaggacaaaacacatgtgtcctcttgggaagaggttccctatcttggcaagagagaggaccagtggtgcgggagcctgatcggactcaccgctcgggccacatgggccacgaacattcaagtggctatcaatcaggtcagacgcctgatcggcaacgaaaattacctggattacatgacctccatgaaacggttcaagaacgagagcgaccctgaaggggccctctggtga

SEQ ID NO: 18706 - RNA, 9879 nt, synthetic construct
  misc_feature 1..9879: note = derived and/or modified CDS sequence (opt5) from DENV-1__KF973465__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcaaatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggctcttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagagcaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagcccccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatggggggagtctttacctctgtgggcaaactggtgcatcaggtcttcgggacggcctacggagtgctttttagcggcgtttcctggaccatgaagatcgggatcggcattctgctcacatggctgggactgaatagccggtctacctcccttagcatgacatgtatcgctgtgggcatggtcaccctctacctgggggtgatggttcaagccgactctggatgcgtgattaactggaaaggcagagaactgaagtgtgggtccggaatcttcgtcacaaacgaggtgcacacctggacggaacagtataagtttcaggctgatagccctaaacgcctctccgccgcgattggcaaggcctgggaggagggggtttgcggcatccggtctgctacaagactggaaaatattatgtggaaacagatcagcaacgagcttaatcatatcctgctcgaaaacgacatgaagttcaccgtggtcgtgggagacgccaatggcattctggctcaagggaaaaagatgatccgcccgcagcccatggagcacaaatactcctggaagtcttggggaaaggccaaaattatcggcgccgatattcagaacaccacatttatcatcgacgggcctgatacccccgaatgtcctgacaatcagcgggcttggaacatttgggaggtggaggattatggattcggcatctttacgacaaatatttggctgaagcttagagacagctacacccaaatgtgcgatcaccgcctcatgtccgcggccatcaaagacagcaaggctgtccatgccgatatgggctattggattgaatctgagaaaaacgaaacatggaagctggcccgggcttccttcatcgaggttaagacctgtacatggcccaaaagccacaccctgtggtctaatggggtgctcgaatccgagatgatcattccgaagatctacggaggccctattagccagcataactatagacccgggtacttcacgcagaccgccggaccttggcacctgggcaaacttgagctggactttgaactctgcgaggggacaaccgtggtcgtggatgaacactgcggaaatcgcggcccctctctgcggacaaccacggttacaggcaagatcattcatgagtggtgttgcagaagctgtaccctgcctccccttcggttccgcggggaggacggatgctggtacggcatggaaatcagaccggtgaaagagaaggaagagaacctcgtccggtccatggtgagcgcggggtctggagaagttgattcctttagcctgggcatcctgtgtgcttccattatgatcgaggaggtgatgagatctcgctggagccggaagatgctcatgacagggaccctggccgtcttccttctgctcattatgggacaactgacctggaatgacctgatcagactttgcattatggtgggcgccaacgcttccgaccgcatgggcatggggacaacgtatctggccctcatggcgacctttaaaatgagacctatgttcgctgttggactgctctttcggcgcctgacatctagagaagtgcttctgctcaccatcggcctgagcctggtcgcctccgtggagcttcccaactctctggaagagctcggggatggactggccatgggcattatgatgctcaagctgcttacagaattccagccccaccagctgtggaccacgctcctgagcctgacatttatcaaaaccaccctttccctggactacgcttggaagacaaccgccatggctctcagcatcatttctctgttccctctctgtctgtccacaacgagccagaaaaccacatggcttccggtgctgctggggtcttttggatgcaagcccctcaccatgttcctgatcacagagaataagatttggggccggaaatcctggcctcttaacgagggcatcatggccattgggatcgtcagcatcctgctctcttccctgctcaagaatgatgttcccctggcgggacctcttattgccggcgggatgctgatcgcttgttatgtgattagcggatccagcgccgacctgtctctcgaaaaagctgccgaggtgagctgggaacaagaggccgaacattccggcacctctcacaacatcctggtcgaggtgcaggatgacgggacgatgaagattaaagatgaggaacgcgacgatacccttacaatcctgctcaaggctaccctgctcgcggttagcggagtgtaccccatgtccatccctgccacactgtttgtctggtatttctggcagaaaaagaagcagagatctggcgtgctttgggacacccccagcccgcctgaggttgaacgggctgtgctggatgacggcatttaccgcatcctgcaaagagggctcctgggacggtcccaggtcggcgtgggggtcttccaggatggagtgtttcatacaatgtggcacgttacgcgcggcgccgtgcttatgtatcaggggaaaagactggagccctcttgggccagcgtcaagaaagacctcatttcctacggaggcggctggcggttccaagggagctggaataccggagaggaagtgcaggttatcgctgtggagcctggcaagaaccccaaaaatgtccagacaaccccggggacctttaagacacctgaaggagaggtgggcgccattgcgctggacttcaagcccgggacgtctggatcccctatcgtgaacagagaaggcaaaattgttggcctctacgggaatggagtcgtgaccacaagcggcacctatgtgtctgctatcgcccaagccaaggcttcccaggaggggcccctgcccgagatcgaagatgaggtctttaaaaagcgcaaccttacaattatggacctgcaccctggaagcggcaaaacccggagatacctgccggccatcgtgcgcgaagcgattaagcggaagctcagaacgctgatccttgctcccacacgcgttgtggcctccgagatggccgaagctctgaaagggatgcctattcggtatcagaccaccgccgtcaagtctgagcatacaggcagagagatcgtggatctcatgtgccacgctaccttcacaatgcgcctgctgagccccgttcgggtgcctaattacaacatgatcattatggacgaagcccattttaccgatcccgcgtccatcgccgctagaggatatattagcacgcgggtcggcatgggggaggccgctgccatcttcatgacagccacccctccgggatctgtggaagcttttccccagtccaatgcggttattcaagacgaggaacgcgatatccctgagagaagctggaactctggctacgactggatcacagatttccccgggaaaaccgtgtggtttgtccctagcattaagtccggaaatgacatcgccaactgtctccggaaaaacggcaagcgcgtgattcagctttctagaaagacgttcgataccgagtatcagaaaacaaagaataacgactgggactacgtggtcaccacagatatcagcgaaatgggggctaatttccgggccgacagagttattgatccccgccggtgcctgaaaccggtgatcctgaaggacggccctgagagagtgattctcgccggacccatgcccgtcaccgtggcttccgccgcgcagcgccggggcagaatcgggcgcaaccaaaataaagaaggagatcagtacgtttatatgggccagcctctgaacaatgacgaggatcacgctcattggacagaggccaagatgcttctggacaacatcaatacccccgaagggattatccctgccctctttgagccggaacgggagaagtctgctgccattgatggagaatacagactgcgcggcgaggcgagaaaaacgttcgtggagctgatgcggcgcggggacctccccgtctggcttagctataaggtggcctccgaaggctttcagtacagcgatagacggtggtgcttcgacggagagcgcaacaatcaagttctggaagagaacatggatgtggaaatctggacaaaagagggcgagagaaagaaactgcggcctagatggctcgacgctcgcacctattctgaccccctggcccttcgggaatttaaggagttcgctgccgggagacgctccgtcagcggagatctgattctcgaaatcggcaaactgcctcagcacctgaccctccgggctcagaatgcccttgacaacctggtgatgctgcacaattccgagcaggggggaaaggcgtacagacatgccatggaagagctccccgatacaatcgagaccctgatgcttctggctctcattgccgtcctgacaggcggcgtgacgctgtttttcctctctgggaagggacttggcaaaaccagcatcgggctgctgtgtgttacagcttcctctgccctcctgtggatggccagcgtggaaccgcactggattgctgcgtccatcattcttgagtttttcctgatggtgctcctgatccctgaacccgaccggcaacgcacccctcaggataaccagctggcctatgtcgttatcggactcctttttatgattctgacagtggctgccaacgagatgggcctgctcgagaccacgaagaaagacctggggatcggacatgtggccgctgaaaatcaccaacacgccaccatgcttgatgtcgacctgagacccgcgagcgcctggacactctacgctgtggccaccacagttattacccctatgatgcggcatacgatcgagaacacaaccgctaatatttctctgacagccatcgcgaaccaggccgctattctgatgggcctcgataagggctggcccatctccaaaatggacatcggggtgccgcttctggccctgggatgctacagccaggtcaatcctctcaccctgaccgctgccgtgcttatgctggtcgctcactatgccattatcggccccgggctccaggcgaaggccacacgcgaagctcaaaagagaacggccgctggaattatgaaaaaccccaccgtggatggcatcgttgccattgacctggatcctgtggtctacgacacaaagttcgagaaacagctggggcagatcatgctccttatcctgtgtacctctcagattctgctcatgcggacaacctgggccctgtgcgaatccatcacgcttgcgacaggaccgctgaccaccctctgggagggcagccccggcaagttttggaatacaaccattgctgtgtctatggccaacatcttccgcgggagctatctggctggagccggcctggccttctccctcatgaaatctcttgggggaggcagacgggggacaggagctcaaggcgagacgctgggcgaaaagtggaagcgccagctgaatcagctcagcaaatccgagtttaacatttacaagagaagcgggatcatggaagttgaccggtccgaggccaaagaaggactgaagagaggcgagaccacaaaacatgcggtgtctcgcgggaccgccaagcttcggtggttcgtcgagagaaatctggtgaagcctgaaggaaaagtgatcgatctcggctgtgggcgcggaggctggagctattactgcgctggcctgaagaaagttacagaggtcaaggggtataccaaaggaggccccgggcacgaagagcctattcccatggccacgtacggatggaacctggtgaagctccattccggcaaagacgtgtttttcatgcctccggaaaagtgtgatacccttctgtgcgacatcggggagtctagccccaatcctacaattgaggaaggacggaccctgagagtcctcaagatggttgagccctggctgcgcggcaaccagttttgtatcaaaattcttaatccttacatgccctccgtggtggaaacactggagcaaatgcagcggaagtatggcgggatgctcgtcagaaacccgctgtctcgcaatagcacccacgagatgtactgggtgtcctgcggaacaggcaacatcgttagcgctgtgaacatgacctctcggatgctgctcaatagattcacgatggcccaccgcaaacctacatatgaacgggatgtcgacctgggggcgggaaccagacatgtggccgttgagcccgaagtggctaaccttgatattatcggccagcgcatcgagaatattaagaacgaacacaaatccacctggcattacgacgaggataatccctataagacatgggcctaccacgggagctatgaggtcaagccttctggatccgctagctctatggtgaacggcgtggtcagactgctcacgaaaccctgggacgttatccctatggtgacccaaattgccatgacagataccacaccgtttggccagcagcgggtgttcaaggaaaaagtcgacacccgcacacccagagctaagcgggggaccacgcagatcatggaggtgaccgccaaatggctgtggggatttctttccagaaataagaagcctcggatttgtacacgcgaagagttcaccagaaaagttcggagcaacgcggccatcggcgctgtgtttgtcgacgaaaatcaatggaactccgccaaggaggctgtggaggatgaacgcttctgggacctggttagacgggagcgcgaactccacaaacaggggaagtgcgccacatgcgtgtacaatatgatgggaaaaagagagaagaagctgggcgaatttgggaaagccaagggcagccgggcgatctggtacatgtggctgggagctcgcttcctcgagttcgaggccctgggctttatgaacgaagatcattggttctctagagagaatagcctttccggggtcgaaggagagggcctgcacaaactcgggtatattctgcgggacatctctaagattcccggaggcaacatgtacgccgatgacaccgctgggtgggatacgcgcatcacagaggacgatcttcagaatgaagccaaaattaccgacatcatggagcctgaacatgctctgctcgccacaagcatctttaagctgacctatcagaacaaagtggttagagtgcaacggcccgcgaagaacggcacggtcatggatgtgatttcccgcagagaccagcggggatctggccaggtcgggacctacggactgaatacattcaccaacatggaggtgcagctcatcagacaaatggaaagcgagggcatttttctgccgtccgagcttgaaacacctaatctggccgagcgcgttctcgattggctggaaaagcacggggctgagcggcttaaaagaatggccatctctggagacgactgtgtggtcaagcccattgatgaccgcttcgctaccgccctgacagcgctcaacgatatgggcaaagtgcggaaggacatccctcagtgggaacccagcaaagggtggaatgattggcagcaggtgcctttttgctcccatcacttccaccaactgatcatgaaggacggcagagagattgttgtgccctgtcgcaaccaggatgagctggtcggacgggccagagtgagccagggcgctgggtggtctctccgcgaaaccgcctgcctgggaaagtcctatgctcaaatgtggcagcttatgtactttcatcggagagacctgcgcctcgccgctaatgccatctgtagcgcggttccggtggattgggtccctacgtctcggacaacctggtccattcacgcccatcaccagtggatgaccacagaggacatgctgagcgtgtggaacagagtctggatcgaagagaatccctggatggaagataaaacccacgtgtcctcttgggaggaggttccctatcttggcaagcgggaagaccagtggtgcgggagcctgattggactcacagctagagccacgtgggccaccaacatccaagtggctattaatcaggtccgccggctgatcggcaacgagaattacctggactacatgacatccatgaaaagattcaagaacgaaagcgatcctgagggggccctctggtga

SEQ ID NO: 18707 - RNA, 9879 nt, synthetic construct
  misc_feature 1..9879: note = derived and/or modified CDS sequence (opt5) from DENV-1__KF973466__SS-prME
  source 1..9879: mol_type = other RNA
tccgtgaccatgctgctgatgctgatgcccacagcccttgctttccacctgacgaccagaggaggggaacctcatatgatcgtctccaagcacgaacggggaaaagccctgctgtttaagacctctaccggcgttaatatgtgcacacttattgcgatggacctgggggaactctgtgaagataccatgacatacaaatgccccagaatcaccgaagctgaacccgacgatgtggactgttggtgcaatgccacggatacctgggtgacatatggaacctgtagccagacaggcgagcatagacgggacaagcgctccgtcgccctggctcctcacgtggggctgggactcgagaccagaacggaaacatggatgtctagcgagggcgcctggaaacaaattcagcgggttgaaacctgggctctgcgccatcccggcttcacagtgatcgccctttttctggcgcacgccattgggacctccatcacccagaagggaatcattttcatcctcctgatgcttgtcacaccttctatggctatgagatgcgtgggcattgggaaccgggattttgttgagggactgagcggcgccacgtgggtggacgtcgtgctcgagcacgggtcctgtgtgaccacaatggctaagaataaacccaccctggatatcgaactgctcaagacagaggtcaccaaccctgccgttctgcgcaaactttgcattgaagcgaagatcagcaatacgacaaccgactctagatgtccgacccagggagaggccacactggtggaagaacaagatgctaacttcgtgtgccggcgcacctttgtcgacagaggctggggcaatgggtgtggactcttcggcaaagggtccctgcttacatgcgccaagtttaagtgcgtgacgaaactggagggaaagattgttcagtacgaaaacctcaaatatagcgtgatcgtcaccgtgcatacaggcgatcagcaccaggttgggaatgagaccacagaacatggaaccatcgctacgattacaccccaagcccctacatctgagatccagctgaccgactacggcgccctgacactcgactgtagcccccggaccggcctggatttcaacgaaatggtgcttctgacgatgaaggagaaaagctggctcgtccacaagcagtggtttctggaccttcctctgccctggacatctggggcttccaccagccaggagacatggaatcgccaagatctcctggtgaccttcaaaaccgcgcacgccaagaagcaggaagtcgtggttctgggatcccaggagggcgctatgcatacagccctcacgggggccaccgaaattcaaacatctggaaccacaaccatctttgctggccacctgaaatgcagacttaagatggacaaactgacgctcaaggggacaagctatgtgatgtgtaccggctccttcaaactggagaaggaagtcgccgagacccagcatggaacagtgctggttcaggtgaagtacgagggcaccgatgcgccgtgcaaaattcctttcagcacacaggacgaaaagggggtcacgcaaaacggacggcttatcaccgctaatcccatcgtgacagataaagagaagcctgtgaacattgaaaccgagccgccctttggcgagtcttatatcgttgtcggggccggagaaaaagccctcaagctgtcctggttcaagaaaggcagctctattgggaagatgtttgaggctacagccagaggcgctcgccggatggccatcctgggagacaccgcgtgggatttcggcagcattgggggagtgtttacgtccgtgggcaaactcgtccaccaggtgttcgggaccgcctacggagttctgttttctggcgtgagctggacaatgaagatcgggatcggcattcttctgacctggctcggactcaattccagaagcacatctctgtccatgacctgtatcgctgtcggcatggtgacactttacctcggggttatggtgcaggccgacagcggatgcgtcattaactggaaaggccgcgaactgaagtgtgggtctggaatcttcgtgaccaacgaggttcatacgtggacagaacagtataagtttcaagctgattcccctaaacggctgagcgccgcgattggcaaggcctgggaggagggggtgtgcggcatcagatccgctacccgcctcgaaaatattatgtggaaacagatctctaacgagctgaatcacatccttctggaaaacgacatgaagttcaccgtcgtggtgggagacgccaatggcattctcgctcaggggaaaaagatgatccggccgcagcccatggagcacaaatacagctggaagtcctggggaaaggccaaaattatcggcgccgatattcaaaacacaacctttatcatcgacgggcctgatacgcccgaatgtcctgacgatcagagagcttggaatatttgggaggtcgaggactatggattcggcatctttacaaccaacatttggctgaagctgcgcgattcttacacacagatgtgcgaccatcggcttatgagcgcggccatcaaagattccaaggctgttcacgccgacatgggctattggattgaaagcgagaaaaatgaaacctggaagctcgccagagcttctttcatcgaggtgaagacatgtacctggcccaaatcccatacgctgtggagcaacggggtgctggaatctgagatgatcattccgaagatctacggaggccctatttcccagcacaattatcgccccgggtacttcacccaaacagccggaccttggcacctcggcaaactggagcttgattttgacctgtgcgaagggaccacagtcgtggttgatgagcattgcggaaaccggggccccagcctcagaaccacgacagtgaccggcaagatcattcacgaatggtgttgccggtcttgtacactgcctcccctgcgcttcagaggggaggacggatgctggtacggcatggagatccggccggtcaaagaaaaggaggaaaatcttgtgagaagcatggtttccgcggggagcggagaggtggactctttttccctcggcatcctgtgtgtcagcattatgatcgaagaggtgatgcgctcccggtggtctagaaagatgctgatgaccgggaccctcgctgttttcctgcttctgattatgggacagctcacatggaacgatctgatccgcctgtgcattatggtgggcgccaatgccagcgacagaatgggcatggggacgacctatcttgctctgatggccacatttaaaatgcggcctatgttcgcggtcggaatcctctttcgcagactgacctcccgggaggtgctcctgcttacaattggcctgtctctcgtggctagcgtcgaactgcccaactccctggaggaacttggggatggactggccatgggcatcatgatgctcaagctgctcaccgagttccagccccatcaactgtggacgacacttctgtctctcacctttatcaaaaccacactgagcctggactacgcctggaagaccacagctatggccctttccattgttagcctgttccctctctgtctgtctacgacctcccagaaaacaacctggctcccggtgctgcttgggagctttggatgcaagcccctgacaatgttcctgatcaccgaaaacaagatttggggccgcaaatcttggcctatcaatgagggcattatggctatcgggatcgtgtccattctcctgagctctcttctgaagaacgatgtccccctcgccggacctctgatcgcgggcgggatgctcattgcctgttatgtgatctccggaagctccgctgacctgagccttgagaaagccgctgaagtttcttgggagcaggaagccgagcacagcggcacgtcccataatattctggtggaagtccaggatgacgggaccatgagaatcaaggatgaggagaaagacgatacactgaccatcctcctgaaggccacacttctggctgtgtctggagtttaccccatgagcattcctgcgaccctctttgtgtggtatttctggcagaagaagaagcagcggtccggcgtcctgtgggacacaccctctccgcctgaagtggagcgcgccgtcctcgatgacggcatctaccgcattctgcagcgggggcttctgggacgcagccaggtgggcgttggggtgttccaagacggagtctttcacacgatgtggcacgtgaccagaggcgctgttctgatgtatcaggggaaacggctcgaaccctcctgggcctctgtgaagaaagatctgatcagctacggaggcggctggagattccaggggtcctggaacacaggagaggaggtccaggtgattgccgtggaacctggcaagaatcccaaaaacgttcaaaccaccccggggacatttaagacgagcgagggagaagtcggcgctatcgcccttgacttcaagcctgggacctctggatcccccattgtgaatcgcgagggcaaaatcgtgggcctgtacgggaacggagtcgtgacaaccagcggcacatatgtttctgcgatcgctcaggccaagacctcccaggaagggcctctccccgagattgaggatgaagtgtttaaaaagcggaatctgacgatcatggacctccatcccggaagcggcaaaacaagacgctacctgcctgccattgtccgggaggctatcaagagaaaacttcgcaccctgattctggccccgacccgggtggttgcgtccgaaatggctgaggccctcaaagggatgcccatcagatatcaaacaaccgccgtgaagtctgaacacacaggccgcgagatcgtcgatctgatgtgccatgctaccttcacgatgcggcttctgagccctgtgagagttcccaactacaatatgattatcatggacgaggcccactttacagatcctgcttccattgccgcgcggggatatatcagcacccgcgtgggcatgggggaagccgctgccattttcatgacagctacaccccctggatctgtcgaggcctttccgcagtccaacgccgtgatccaggacgaagagagagatatccccgaacggagctggaactctggctacgactggattacggatttccctgggaaaaccgtgtggtttgtccccagcatcaagtccggaaacgacattgctaattgtctccgcaaaaacggcaagagagttatccagctgtctcggaagacattcgacaccgagtatcagaagaccaagaacaatgattgggactacgtggtgaccacagatattagcgagatgggggcgaacttcagagccgaccgcgtcatcgatcctcggagatgcctgaaacccgtgattctcaaggacggcccggaacgcgttatccttgctggacctatgcccgtgaccgtcgcctccgccgctcagcggagaggccgcatcgggcggaatcagaacaaagagggagatcagtacgtgtatatgggccaacccctgaataacgacgaagatcatgcccactggacggaggcgaagatgctgctcgacaatattaacacacctgaggggatcattcccgctctgtttgaacctgagagagaaaagtctgccgccatcgatggagagtaccgccttagaggcgaagctcggaaaaccttcgttgagctgatgcgcagaggggacctcccggtgtggctgagctataaggtcgcctccgagggctttcagtacagcgatcggcgctggtgcttcgacggagaaagaaataaccaggtgctggaggaaaatatggacgtcgagatttggaccaaagaaggcgagcggaagaaactcagaccccgctggcttgatgcgcggacatattctgaccctctggccctgagagagtttaaggagttcgctgccgggcgccggtccgtgagcggagatctcatcctggagatcggcaaacttccccagcacctgaccctcagagctcaaaacgccctggacaatctggttatgctccataactccgaacaagggggaaaggcttaccggcacgccatggaggaacttcctgatacaattgagacgctgatgctgctcgcgctgatcgccgtgcttaccggcggcgtgacactgtttttcctctctgggaagggactgggcaaaaccagcattgggctgctctgtgtcacagcttcctctgcccttctgtggatggctagcgttgagccccattggatcgccgcctccattatcctggaatttttcctcatggtgctgcttatcccggagcctgaccgccagagaacgccccaagataatcaactggcttatgtggtcattggactcctgtttatgatcctgaccgtggcggccaacgaaatgggcctccttgagaccacaaagcgggacctggggattggacacgttgctgccgagaaccaccagcatgccaccatgctggatgtggacctccgccctgctagcgcctggacactgtacgcggtcgccaccacggtgatcacacccatgatgagacacaccattgaaaatacaaccgctaacatctctcttaccgccattgctaatcaggccgcgatcctgatgggcctcgataaaggctggcctatctccaagatggacattggggtccccctgctggccctcggatgctacagccaagtgaacccgcttacactgacggctgccgttctgatgctcgtggctcattatgccatcattggccctgggctgcaggctaaagccacccgggaggcgcagaagcgcacagccgctggaatcatgaagaatcccaccgtcgatggcattgtggccatcgaccttgaccccgttgtgtacgatgctaaattcgaaaagcagctggggcaaatcatgctcctgattctgtgtacatctcagatcctccttatgagaaccacgtgggccctgtgcgagtccattacactggccaccggacctctcaccacactgtgggaaggcagcccgggcaaattttggaacaccacaatcgcggtctctatggctaatattttccgggggagctatcttgccggagctggcctggccttctccctcatgaagtctctcgggggaggccgcagagggacgggagcccagggcgagaccctgggcgagaaatggaagcggcagctcaaccaacttagcaagcccgaatttaatacatacaaaagatccgggatcatggaggtggaccgcagcgaagctaaggagggactgaaacggggcgaaaccacaaagcacgccgtgtccagagggaccgcgaaactgcgctggttcgttgagcggaacctcgtcaagcctgagggaaaggtgatcgatctgggctgtgggagaggaggctggtcttattactgcgccggccttaaaaaggtgacggaagtcaaagggtataccaagggaggccccgggcatgaggaacctattcccatggctacatacggatggaatctggttaaactccacagcggcaaggacgtgtttttcatgcctccggagaaatgtgataccctgctgtgcgacatcggggaatcctctcccaaccctacaattgaggagggacgcaccctccgggtgcttaagatggtcgaaccctggctgagaggcaatcagttttgtatcaagattctgaacccttacatgcccagcgtggttgagacactcgaacagatgcagcgcaaacacggcgggatgctggtgcggaatccgctttccagaaactctacccatgagatgtattgggtcagctgcggaacgggcaatatcgtgtccgccgttaacatgacaagccgcatgctgctcaaccggttcaccatggctcacagaaagcctacctacgagcgcgatgtggacctgggggccggaacaagacatgtcgcggtggaacccgaggtggccaatctggatattatcggccaacggatcgaaaacattaaaaatgagcacaagtctacgtggcactatgacgaagataacccctacaaaacctgggcttatcatgggtcctacgaggtcaagcctagcggatctgcctccagcatggttaatggcgtggtgcgcctcctgacaaagccctgggacgtcatccctatggtgacccagattgctatgacagacaccacaccgtttggccagcaaagagttttcaaagagaaggtggatacccggacgcccagagccaaacgggggaccacacagatcatggaagtcaccgctaagtggctttggggatttctgtctcgcaacaaaaagcctagaatttgtacacgggaggagttcacccgcaaggtgagatccaatgccgcgatcggcgccgtttttgtggacgagaaccagtggaatagcgctaaagaagccgtcgaggatgagcggttctgggacctcgtgcaccgcgaaagagagctgcataagcaggggaaatgcgctacgtgcgtttataacatgatgggaaagcgggagaagaaacttggcgagtttgggaaagccaaaggctcccgcgccatctggtacatgtggctgggagcgagattcctcgagttcgaggctctgggctttatgaatgaggatcactggttcagccgggaaaactctctgagcggggtggagggagaaggcctccataagctggggtacattcttcgcgacatctccaaaattcccggaggcaatatgtatgccgatgacacagccgggtgggataccagaatcacagaggacgatctgcaaaacgaggctaagattaccgacatcatggaacctgagcacgccctcctggctacgtctatctttaaacttacctaccagaataaggtcgtgcgggtccagcgccccgccaaaaacggcacagtgatggatgttattagcagacgggaccagagaggatccggccaagtggggacctatggactgaacacattcaccaatatggaagtccagctcatccgccagatggagtctgaaggcatttttctgccgagcgagctggagacacctaacctcgcggaacgggtgctggactggcttgagaagcacggggccgaaagactgaagcgcatggctatctccggagatgactgtgtggttaaacccattgatgaccggttcgccaccgctctcacggccctgaatgatatgggcaaggtgagaaaagacatccctcagtgggagccctctaaggggtggaacgattggcaacaggtccctttttgcagccatcacttccatcagcttatcatgaaagacggccgcgaaattgtggttccctgtcggaatcaggatgagctggtgggcagagcgcgcgtctcccaaggcgccgggtggagcctccgggagacagcttgcctgggaaagtcttacgcccagatgtggcagctgatgtattttcacagacgcgacctccggctggctgccaacgctatctgttccgccgtgccggtcgattgggtgcctaccagcagaaccacatggtctattcacgcgcatcaccaatggatgaccacagaagacatgctttccgtttggaatcgggtgtggatcgaggaaaacccctggatggaggacaagacgcatgtcagctcctgggaagaggtgccctacctgggcaaaagagaggatcagtggtgcgggtctctcattggactgaccgcccgcgctacatgggccaccaatatccaggttgccattaaccaggtgcggagacttatcggcaatgaaaactatctggactacatgacaagcatgaagcgcttcaaaaatgagtccgatcctgaaggggctctctggtga

SEQ ID NO: 18708 - RNA, 9879 nt, synthetic construct
  misc_feature 1..9879: note = derived and/or modified CDS sequence (opt5) from DENV-1__KF973471__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaacatgtgcaccctgattgcgatggacctcggggagctgtgtgaagatacaatgacctacaaatgcccccagatcacagaggctgaacccgacgatgtggactgttggtgcaatgccaccgatacgtgggtgacctatggaacatgttcccagaccggcgagcaccgcagagacaagcggtctgtcgccctggctcctcatgtggggctcggactggagacacgcaccgaaacgtggatgagctccgagggcgcctggaaacagattcagagagttgaaacatgggcccttcggcaccccggcttcaccgtgatcgccctgtttctcgcgcatgccattgggacatctatcacccaaaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaagaataaacccacactggatatcgaactcctgaagaccgaggtcacaaaccctgccattcttcggaaactgtgcatcgaagcgaagatttctaataccacgacagactcccgctgtccgacccagggagaggccaccctcgttgaagaacaggatgctaacttcgtgtgcagacggacatttgtggaccgcggctggggcaatgggtgtggactgttcggcaaagggagccttctgacctgcgccaagtttaagtgcgtcacaaaactcgagggaaagatcgtgcagtacgaaaacctgaaatattctgttatcgtgacggtccacaccggcgatcaacatcaggtggggaatgagacaaccgaacacggaacaattgctaccatcacgccccaggcccctacctccgagattcagctgacagactacggcgccctcaccctggactgtagccccagaacaggccttgatttcaacgaaatggttctgctcaccatgaaggagaaatcttggctggtgcataagcaatggtttcttgacctgcctctcccctggacgtccggggctagcacatcccaggagacctggaatcggcaggatctgctggtcacattcaaaaccgcgcacgccaagaagcaagaagtggtcgtgctcggatctcaggagggcgctatgcacaccgccctgacaggggccacggaaatccagaccagcggaacaaccacaatttttgctggccatcttaaatgccgcctgaagatggacaaactcaccctgaaggggacgtcctatgttatgtgtacaggcagcttcaaactggagaaggaagtggccgagacccagcacggaaccgtccttgtgcaagttaagtacgagggcacagatgcgccgtgcaaaatccctttctctacccaggacgaaaagggggtgacacagaacggaagactcatcacggctaatcccattgtcaccgataaagagaagcctgtgaacatcgaaacagagccgccctttggcgagtcctatattgtggttggggccggagaaaaagccctgaagctgagctggttcaagaaaggctctagcatcgggaagatgtttgaggctaccgcccggggcgctagacgcatggccattctcggagacacagcgtgggatttcggctccatcgggggagtctttacctctgtgggcaaactggtgcatcaggtcttcgggacggcctacggagtgctttttagcggcgtttcctggaccatgaagatcgggattggcatcctgctcacatggctgggactgaatagccggtctacctcccttagcatgacatgtattgctgtgggcatggtcaccctctacctgggggtgatggttcaagccgactctggatgcgtgatcaactggaaaggcagagaactgaagtgtgggtccggaattttcgtcacaaacgaggtgcacacctggacggaacagtataagtttcaggctgatagccctaaacgcctctccgccgcgatcggcaaggcctgggaggagggggtttgcggcattcggtctgctacaagactggaaaatatcatgtggaaacagatcagcaacgagcttaatcatattctgctcgaaaacgacatgaagttcaccgtggtcgtgggagacgccaatggcatcctggctcaagggaaaaagatgattcgcccgcagcccatggagcacaaatactcctggaagtcttggggaaaggccaaaatcattggcgccgatatccagaacaccacatttatcattgacgggcctgatacccccgaatgtcctgacaatcagcgggcttggaacatctgggaggtggaggattatggattcggcatttttacgacaaatatctggctgaaacttagagacagctacacccaaatgtgcgatcaccgcctcatgtccgcggccattaaagacagcaaggctgtccatgccgatatgggctattggatcgaatctgagaaaaacgaaacatggaagctggcccgggcttccttcatcgaggttaagacctgtacatggcccaaaagccacaccctgtggtctaatggggtgctcgaatccgagatgattatcccgaagatttacggaggccctatcagccagcataactatagacccgggtacttcacgcagaccgccggaccttggcacctgggcaaacttgagctggactttgatctctgcgaagggacaaccgtggtcgtggacgagcactgcggaaatcgcggcccctctctgcggacaaccacggttacaggcaagattatccatgaatggtgttgcagaagctgtaccctgcctccccttcggttccgcggggaggatggatgctggtacggcatggagatcagaccggtgaaagaaaaggaggaaaacctcgtccggtccatggtgagcgcggggtctggagaggttgactcctttagcctgggcattctgtgtgcttccatcatgattgaagaggtgatgagatctcgctggagccggaagatgctcatgacagggacccctgccgtcttcctgcttctgatcatgggacaactcacctggaatgacctgattagactgtgcatcatggtgggcgccaacgcttccgatcgcatgggcatggggacaacgtatcttgccctgatggcgacctttaaaatgagacccatgttcgctgttggactcctgtttcggcgcctcacatctagagaggtgctgcttctgaccattggcctcagcctggtcgcctccgtggaactgcccaactctcttgaggaactgggggacggactcgccatgggcatcatgatgctgaagctcctgacagagttccagcctcaccagctttggaccacgctgctcagcctgacatttatcaaaaccaccctgtcccttgattacgcttggaagacaaccgccatggctctgagcattatctctctcttcccgctgtgtctctccacaacgagccagaaaaccacatggctgcccgtgcttctggggtcttttggatgcaagcctctgaccatgttcctcattacagaaaataagatctggggccggaaatcctggcccctgaacgagggcattatggccatcgggatcgtcagcattcttctgtcttccctcctgaagaatgacgttcctctcgcgggacccctgaccgccggcgggatgcttatcgcttgttatgtgattagcggatccagcgccgatctgtctctggagaaagctgccgaagtgagctgggagcaagaagccgagcattccggcacgtctcacaacatcctcgtcgaagtgcaggacgatgggaccatgaagattaaagacgaggagcgcgatgacacactgaccatccttctgaaggctacactcctggcggttagcggagtgtaccctatgtccatccccgccaccctctttgtctggtatttctggcagaaaaagaagcagagatctggcgtgctgtgggatacaccgagccctcccgaagttgagcgggctgtgcttgacgatggcatttaccgcatcctgcaaagagggctgctcggacggtcccaggtcggcgtgggggtcttccaggacggagtgtttcatacgatgtggcacgttacccgcggcgccgtgctgatgtatcaggggaaaagacttgaaccttcttgggccagcgtcaagaaagacctgatttcctacggaggcggctggcggttccaagggagctggaatacaggagaggaggtgcaggttatcgctgtggaacccggcaagaacccgaaaaatgtccagaccacccctgggacatttaagacgcccgagggagaagtgggcgccattgcgctcgatttcaagcctgggacctctggatcccccatcgtgaacagagagggcaaaattgttggcctgtacgggaatggagtcgtgacaaccagcggcacatatgtgtctgctatcgcccaagccaaggcttcccaggaagggcccctccctgagatcgaggacgaagtctttaaaaagcgcaacctgaccattatggatcttcacccgggaagcggcaaaacgcggagatacctgcccgccatcgtgcgcgaggcgattaagcggaagctgagaacactcatcctggctcctacccgcgttgtggcctccgaaatggccgaggctcttaaagggatgcccattcggtatcagaccacagccgtcaagtctgaacataccggcagagagatcgtggacctgatgtgccacgctacattcaccatgcgcctcctgagccctgttcgggtgcccaattacaacatgatcattatggatgaggcccattttacggaccctgcgtccatcgccgctagaggatatattagcacacgggtcggcatgggggaagccgctgccatcttcatgaccgccacaccgcccggatctgtggaggcttttcctcagtccaatgcggttattcaagatgaagaacgcgacatccccgaaagaagctggaactctggctacgattggatcaccgacttccctgggaaaacggtgtggtttgtccccagcattaagtccggaaatgatatcgccaactgtctgcggaaaaacggcaagcgcgtgattcagctctctagaaagaccttcgacacagagtatcagaaaaccaagaataacgactgggattacgtggtcacaaccgacatcagcgagatgggggctaatttccgggccgatagagttattgacccgcgccggtgccttaaacctgtgatcctgaaggatggccccgaaagagtgattctggccggacccatgcctgtcacagtggcttccgccgcgcagcgccggggcagaatcgggcgcaaccaaaataaagagggagaccagtacgtttatatgggccagcccctcaacaatgatgaagaccacgctcattggaccgaggccaagatgctgcttgataacatcaatacgcctgaggggattatcccggccctgtttgaacccgagcgggaaaagtctgctgccattgacggagagtacagactccgcggcgaagcgagaaaaacattcgtggagctgatgcggcgcggggatctgcctgtctggctcagctataaggtggcctccgagggctttcagtacagcgacagacggtggtgcttcgatggagaacgcaacaatcaagttcttgaggaaaacatggacgtggagatctggaccaaagaaggcgagagaaagaaactgcggcccagatggctggacgctcgcacctattctgatcctctcgccctgcgggagtttaaggagttcgctgccgggagacgctccgtcagcggagaccttattctggagatcggcaaactcccccagcacctgacactgcgggctcagaatgccctcgataaccttgtgatgctgcacaattccgaacaagggggaaaggcgtacagacatgccatggaggaactgccggacaccatcgagacactcatgctgcttgctctgattgccgtcctcacgggcggcgtgaccctgtttttcctgtctgggaagggactcggcaaaacaagcatcgggcttctgtgtgttaccgcttcctctgccctgctctggatggccagcgtggagcctcactggattgctgcgtccatcattctggaatttttccttatggtgctgctcatccccgagcctgatcggcaacgcacaccccaggacaaccagctggcctatgtcgttatcggactgctctttatgattcttaccgtggctgccaacgaaatgggcctgctggagacgaccaagaaagatctcgggatcggacatgtggccgctgagaatcaccaacacgccacaatgctggacgtcgatcttagacctgcgagcgcctggaccctgtacgctgtggccacaaccgttattacgcccatgatgcggcatacaatcgaaaacaccacagctaatatttctctcaccgccatcgcgaaccaggccgctattctgatgggcctggacaagggctggccgatctccaaaatggatatcggggtgcctctccttgccctgggatgctacagccaggtcaatcccctgaccctcacagctgccgtgctgatgcttgtcgctcactatgccattatcggccccgggctgcaggcgaaggccacgcgcgaggctcaaaagagaaccgccgctggaattatgaaaaaccctacagtggacggcatcgttgccattgatctcgacccggtggtctacgacaccaagttcgaaaaacagctggggcagatcatgctgctcatcctttgtacatctcagattctgctgatgcggaccacgtgggccctctgcgagtccatcacactggcgaccggaccccttaccacactgtgggaaggcagccctggcaagttttggaataccacaattgctgtgtctatggccaacatcttccgcgggagctatctcgctggagccggcctggccttctccctgatgaaatctctcgggggaggcagacgggggacgggagctcaaggcgagacccttggcgagaagtggaagcgccagctgaatcagctgagcaaatccgaatttaacatttacaagagaagcgggatcatggaggttgatcggtccgaagccaaagagggactcaagagaggcgaaacaaccaaacatgcggtgtctcgcgggacagccaagctgcggtggttcgtcgagagaaatcttgtgaagcccgagggaaaagtgatcgacctgggctgtgggcgcggaggctggagctattactgcgctggcctcaagaaagttaccgaagtcaaggggtatacgaaaggaggccctgggcacgaggaacccattcctatggccacctacggatggaacctggtgaagctgcattccggcaaagatgtgtttttcatgccgcccgagaagtgtgacacactcctttgcgatatcggggaatctagccctaatcccaccgtcgaggagggacggacactgagagttctgaagatggtggaaccttggctcaaaggcaaccagttttgtattaagatcctgaatccctacatgccgtccgtggtcgagacccttgaacaaatgcagcgcaaatatggcgggatgctggtgcggaaccctctctctagaaatagcacacacgagatgtactgggtttcctgcggaaccggcaacattgtgagcgctgtcaacatgacgtctcgcatgctgctgaatcggttcacaatggcccacagaaagcccacctatgagcgcgacgtggatctcggggcgggaacccggcatgttgccgtggaacccgaggtcgctaacctggacatcattggccagagaatcgaaaatatcaaaaacgagcacaagtccacatggcattacgatgaagacaatccttataagacgtgggcctaccacgggagctatgaggtgaaaccctctggatccgctagctctatggtgaacggcgtcgttcgccttctgaccaagccttgggatgtgattccgatggtgacacaaatcgccatgaccgacacaaccccctttggccagcagagagtcttcaaagagaaggtggacacacggacccctcgcgctaaaagagggacgacccagattatggaagttacagccaagtggctctggggatttctgtcccggaataagaaacccagaatctgtacccgggaggagttcacacgcaaggtgagaagcaacgcggccattggcgctgtctttgtggatgagaatcaatggaactccgccaaagaagctgttgaggacgagcggttctgggatcttgtgcaccgcgaaagagagctgcataagcaggggaaatgcgctacctgcgtctacaatatgatgggaaagcgggaaaagaaactcggcgagtttgggaaggccaaaggcagccgcgcgatctggtacatgtggctgggagctagattcctggagttcgaggccctcggctttatgaacgaggaccactggttctctcgggaaaatagcctgtccggggtggagggagaaggccttcataagctggggtatatcctccgcgatatttctaaaatccctggaggcaacatgtacgccgacgatacggctgggtgggacacaagaattaccgaggatgacctgcagaatgaggccaagatcacagatattatggaacccgagcacgcccttctggccaccagcatctttaaactcacgtatcagaacaaggttgtgcgggtccaacgcccggcgaagaacggcaccgtgatggacgtcatctccagacgggatcagcgcggatctggccaggtggggacatacggactgaataccttcacaaacatggaagttcagctgattagacaaatggagagcgaaggcatctttctcccttccgagctggagacccccaatcttgccgaacgggtgctggactggctcgagaaacatggggctgaaagactgaagcgcatggccatttctggagacgattgtgtcgtgaaacctatcgacgatcggttcgctacagcccttaccgcgctgaacgacatgggcaaggtgagaaaagatattccccagtgggagcctagcaaggggtggaatgactggcagcaggttcccttttgctcccaccacttccatcaactcatcatgaaggatggccgcgaaatcgtggtcccgtgtcggaaccaggacgagctggtgggcagagctcgcgttagccagggagctgggtggtctctgcgggagacggcctgcctcggaaaatcctatgctcaaatgtggcagctgatgtactttcacagacgcgatcttcggctggccgctaatgccatttgtagcgcggtgcctgtcgactgggtgcccacatctagaaccacctggtccatccatgcccaccaccagtggatgacaaccgaagatatgctcagcgtctggaaccgcgtgtggattgaggaaaatccctggatggaggacaagacacatgtttcctcttgggaagaggtgccttatctgggcaaacgggaggaccagtggtgcgggagccttatcggactgacggctagagccacctgggccacaaacattcaagtcgctatcaatcaggtgcggagactcattggcaacgaaaattacctggattacatgacctccatgaagcgcttcaaaaacgagagcgacccggaaggggccctgtggtga

SEQ ID NO: 18709 - RNA, 9879 nt, synthetic construct
  misc_feature 1..9879: note = derived and/or modified CDS sequence (opt5) from DENV-1__KF973472__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcgtcacatgtatcgctgtgggcatggttaccctgtacctgggggtgatggtccaggccgactctggatgcgtgattaactggaaaggccgcgaactcaagtgtgggtccggaatctttgttacaaacgaggtgcatacctggacggaacagtataagttccaagctgatagccctaaacggctgtccgccgcgattggcaaggcctgggaggagggggtctgcggcatcagatctgctacacgccttgaaaatattatgtggaaacagatcagcaacgagctgaatcacatcctcctggaaaacgacatgaagtttaccgtggtggtcggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggttgaggactatggatttggcatcttcacgacaaacatttggcttaagctccgcgatagctacacccagatgtgcgaccatcggctgatgtccgcggccatcaaagatagcaaggctgtgcacgccgacatgggctattggattgaatctgagaaaaatgaaacatggaagctggccagagcttcctttatcgaggtgaagacctgtacatggcccaaaagccataccctctggtctaacggggtcctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtggttgtggatgagcattgcggaaaccggggcccctctctgagaacaaccacggtcacaggcaagatcattcacgaatggtgttgccggagctgtacccttcctcccctccgctttagaggggaggacggatgctggtacggcatggagatccggccggtgaaagaaaaggaggaaaatctggttagatccatggtgagcgcggggtctggagaggtcgactccttcagcctgggcatcctctgtgtgtccattatgatcgaagaggttatgcgctctcggtggagcagaaagatgctgatgacagggacccttgctgtgtttctgctcctgattatgggacagctgacctggaacgatcttatccgcctgtgcattatggtcggcgccaatgcctccgacagaatgggcatggggacaacgtatctcgctctgatggccaccttcaaactccggcctatgtttgcggtgggaatcctgttccgcagacttacatctcgggaggtgctgctcctgaccattggcctgagccttgtcgcttccgttgaactgcccaactctctcgaggaactgggggatggactcgccatgggcatcatgatgctgaagcttctgacagagtttcagccccatcaactctggaccacgctgctgagccttacattcatccgcaccaccctgtccctcgactacgcctggaaaacaaccgctatggccctgagcattgtgtctctctttcctctgtgtctttccacaacgagccagaagaccacatggctgccggtgctgctcgggtctttcggatgcaaacccctgaccatgtattttatcacagaaaacaagatttggggcagaaagtcctggcctatcaatgagggcattatggctatcgggatcgtcagcattcttctgtcttccctcctgaaaaacgatgtgcccctcgccggacctctgatcgcgggcgggatgcttattgcctgttacgttatcagcggatccagcgctgacctgtctctggagaaggccgctgaagtgagctgggagcaggaagccgagcactccggcacctctcataatattctcgtcgaagtgcgggatgacgggacgatgcgcatcaaagatgaggagaaggacgataccctgacaatccttctgaaagccaccctcctggctgttagcggagtgtatcccatgtccattcctgcgacactcttcgtctggtacttttggcagaagaaaaagcaaagatctggcgtgctgtgggacacccccagcccgcctgaagtcgagcgggccgtgcttgatgacggcatctatcgcattctgcagagagggctgctcggacggtcccaggttggcgtgggggtcttccaggacggagtgttccacacaatgtggcacgttacgagaggcgctgtgctgatgtaccaagggaagcgccttgaaccctcttgggccagcgtcaaaaaggatctgatctcctacggaggcggctggcggtttcaggggagctggaacaccggagaggaggtgcaggtgattgccgttgaacctggcaaaaatcccaagaacgtccagacaaccccggggaccttcaaaacacctgagggagaagtgggcgctatcgccctcgactttaagcccgggacgtctggatcccctattgtgaatagagagggcaagatcgtcggcctgtatgggaacggagtggttaccacaagcggcacctacgtgtctgcgatcgctcaagccaaagcctcccaggaagggcccctccccgagattgaggatgaagtcttcaagaaacgcaatctgacaatcatggaccttcatcctggaagcggcaagacccggagatatctgccggctattgtgcgcgaggccatcaaacggaagctgagaacgctcattctggcgcccacacgcgttgtggcttccgaaatggccgaggcccttaaggggatgcctatccggtaccagaccaccgctgtcaaatctgaacacacaggcagagagatcgtggatctgatgtgccatgccacctttacaatgcggctcctgagccccgttcgcgtgcctaactataatatgattatcatggacgaggctcacttcaccgatcccgcctccattgcggccagaggatacatcagcacgcgggtcggcatgggggaagctgccgctatttttatgacagccacccctccgggatctgtggaggccttcccccaatccaacgctgtgatccaggacgaagagcgcgatatccctgaaagaagctggaattctggctatgactggattacagattttcccgggaagaccgtctggttcgttcctagcatcaaatccggaaacgacattgcgaattgtctgcggaagaacggcaaaagagtgatccagctctctcgcaagacgtttgacaccgagtaccagaagacaaaaaacaatgattgggactacgtggtcaccacagatattagcgagatgggggccaacttccgggctgacagagtgatcgatccccgccggtgccttaagccggttattctgaaagacggccctgaaagagtgatcctggccggacccatgcccgtcaccgtggcctccgctgcccaacgccggggcagaatcgggcgcaatcagaacaaggagggagatcagtatgtttacatgggccagcctctcaataacgacgaagatcatgcgcactggacagaggctaaaatgctgcttgacaatattaacacccccgaggggatcattcctgccctgttcgaaccggagagagaaaagtctgccgctatcgatggagagtatcggctccgcggcgaagccagaaagacgtttgtggagctgatgcggcgcggggacctgcccgtctggctcagctacaaagtggcgtccgagggcttccaatatagcgatagacggtggtgctttgacggagaaagaaataaccaggtccttgaggaaaatatggacgtggagatttggacaaaggaaggcgagcgcaaaaagctgcggcctagatggctggatgcccgcacctactctgaccccctcgctctgcgggagttcaaagaatttgccgctgggagacggtccgttagcggagatcttatcctggagatcggcaagctccctcagcacctgaccctgcgcgcccagaacgctctcgacaatcttgtgatgctgcataactccgaacaagggggaaaagcctatagacacgcgatggaggaactgcccgatacaattgagaccctcatgctgcttgccctgatcgctgtgctcacaggcggcgtcacgctgttctttctgtctgggaagggactcggcaagaccagcattgggcttctgtgtgttacagcctcctctgctctgctctggatggccagcgtggagccgcattggatcgccgcttccattatcctggaattctttcttatggtgctgctcatccctgagcccgaccggcagcgcacccctcaggataatcagctggcgtacgtcgtgattggactgctcttcatgatccttacagttgccgctaacgaaatgggcctgctggagaccacgaaaagagacctcgggattggacacgtggccgccgagaaccaccaacatgctaccatgctggatgtcgaccttcggcccgccagcgcgtggacactgtacgccgtggctaccacagtcatcacccctatgatgcgccacacgattgaaaatacaaccgccaacatctctctcacagctattgccaatcaggcggccatcctgatgggcctggataagggctggcccatctccaaaatggacattggggtgccgctccttgctctgggatgctatagccaggttaaccctctgaccctcaccgccgctgtgctgatgcttgtcgcccattacgctatcattggccccgggctgcaagccaaggcgacaagagaggcccagaaacggacggctgccggaatcatgaagaatcccaccgtggatggcattgttgctatcgacctcgaccctgtggtctatgatgccaagtttgaaaaacagctggggcagatcatgctgctcattctttgtacatctcaaatcctgctgatgcgcaccacatgggccctctgcgagtccattaccctggcgacgggaccgcttacaaccctgtgggaaggcagccccggcaagttctggaacaccacaatcgctgtgtctatggccaatatttttagagggagctacctcgctggagccggcctggccttctccctgatgaaatctctcgggggaggccggagagggaccggagctcagggcgagacacttggcgagaagtggaaacgccagctgaaccagctgagcaagcctgaattcaatacgtataagcggtccgggatcatggaggtggacagaagcgaagccaaagagggactcaagcgcggcgaaaccacaaaacacgcggtttcccgggggaccgccaagctgagatggtttgtcgagcgcaaccttgtgaaacccgagggaaaggtgatcgatctgggctgtgggcggggaggctggtcttactattgcgctggcctcaagaaagtcacagaagttaaggggtacaccaaaggaggccctgggcatgaggaacccattcctatggccacgtacggatggaatctggtgaagctgcacagcggcaaagacgtgttctttatgccgcccgagaagtgtgataccctcctttgcgacatcggggaatcctctcctaaccccacaattgaggagggaagaaccctgcgcgtcctgaaaatggtggaaccttggctccggggcaatcaattctgtatcaagattctgaacccctatatgccgagcgttgtggagacacttgaacagatgcagagaaagcacggcgggatgctggtccgcaatcctctctcccggaactctacccatgagatgtactgggtgagctgcggaacaggcaatatcgtttccgctgtgaacatgaccagcagaatgctgctgaaccgctttacgatggcccacagaaaacccacatatgagcgggatgtcgacctcggggcgggaacccgccatgtggccgtggaacccgaggtcgctaatctggatattatcggccagagaatcgaaaacattaagaatgagcacaaatctacctggcactacgacgaagataacccttataagacatgggcctaccatgggtcctatgaggttaaacccagcggatctgcttccagcatggtgaatggcgtggtccggcttctgacgaagccttgggacgtgatcccgatggttacccaaattgccatgacagacaccacacccttcggccagcagagagtgtttaaggagaaagtcgatacccggacacctcgcgctaagagagggaccacgcaaatcatggaagtgaccgccaaatggctctggggattcctgtctcggaacaagaaaccccgcatttgtacaagagaggaatttacccggaaggttcgctccaatgcggccatcggcgctgtgttcgtcgacgagaaccagtggaatagcgccaaggaagctgtggaggatgagagattttgggaccttgttcaccgggaacgcgagctgcataaacaggggaagtgcgccacatgcgtgtacaacatgatgggaaaaagagaaaagaaactcggcgagttcgggaaggccaagggctcccgggcgatctggtacatgtggctgggagctcgctttctggaattcgaggccctcggcttcatgaatgaggatcactggtttagcagagaaaactctctgagcggggtcgagggagaaggccttcataaactggggtatattctccgggacatctccaagattcctggaggcaatatgtacgccgatgacaccgctgggtgggatacgcgcatcacagaggacgatctgcagaacgaggccaaaattaccgacatcatggaacccgagcacgctcttctggccacatctatcttcaagctcacctatcaaaataaagtggtcagagtgcagcggccggcgaagaacggcacggttatggatgtgattagcagacgcgaccagcggggatccggccaggtcgggacctacggactgaacacatttaccaatatggaagtgcaactgatcagacagatggagtctgaaggcattttcctccctagcgagctggagacacccaaccttgccgaacgcgtgctggactggctcgagaaacacggggctgaacggctgaagagaatggccatctccggagatgactgtgttgtgaagcctattgatgaccgctttgctaccgcccttacagcgctgaatgatatgggcaaagtccggaaggacatcccccagtgggagccttctaaagggtggaacgattggcagcaagtgcccttctgcagccatcactttcatcagctcatcatgaaggacggcagagaaattgttgtgccgtgtcgcaatcaggatgagctggtcggacgggccagagtgtcccagggcgctgggtggagcctgcgcgagaccgcctgcctcggaaaatcttatgctcaaatgtggcagctgatgtacttccaccggagagaccttcggctggccgctaacgccatctgttccgcggtccctgtggattgggttcccacgagcagaacaacctggtctattcacgcccatcaccagtggatgaccacagaagacatgctctccgtgtggaatcgcgtctggatcgaggaaaacccctggatggaggacaagacccatgtgagctcctgggaagaggttccttatctgggcaagcgggaggatcaatggtgcgggtctcttattggactgacagctagagccacgtgggccaccaatatccaggtggctattaaccaggtccgcagactcatcggcaatgaaagctacctggactacatgacatccatgaaacggtttaagaacgagagcgatccggaaggggccctgtggtga

SEQ ID NO: 18710 - RNA, 9879 nt, synthetic construct
  misc_feature 1..9879: note = derived and/or modified CDS sequence (opt5) from DENV-1__KF973474__SS-prME
  source 1..9879: mol_type = other RNA
agcgtgaccatgctgctcatgctgcttcccacagccctggctttccacctcacgaccagaggcggggagcctcatatgatcgtctccaagcacgaacggggaaaatctctgctttttaagacaagcaccggcgttaacatgtgcacactgattgccatggacctcggggagctgtgtgaagataccatgacatacaaatgcccgcgcatcaccgaggcggaacccgacgatgtggactgttggtgcaatgctacggatacctgggtgacatatggaacctgttcccagacaggcgagcatagacgggacaagcgctctgtcgccctggcccctcacgtggggctcggactggagaccagaacggaaacatggatgagctccgagggcgcttggaaacaaattcagcgggttgaaacctgggcccttcgccatcccggcttcacagtgatcgctctgtttctcgcccacgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccagggagaggcgacactcgtggaagagcaagatgccaacttcgtgtgccggcgcaccctggtcgacagaggctggggcaatgggtgtggactttttggcaaagggagcctgctcacatgcgctaagttcaagtgcgtgacgaaactggagggaaagattgttcagtacgaaaacctgaaatattctgtgatcgtcaccgtgcatacaggcgatcagcaccaggttgggaatgagaccacagaacatggaaccatcgccacgattaccccccaagctcctacatccgagatccagctcaccgactacggcgccctggcccttgactgtagcccccggacaggcctggattttaacgaaatggtgctcctgaccatgaaggagaaatcttggcttgtccacaagcagtggttcctggacctccctctgccctggacgtccggggctagcacatcccaggagacctggaatcgccaagatctgctcgtgacatttaaaaccgcgcacgccaagaagcaggaagtcgtggttctgggatctcaggagggcgctatgcataccgcccttacaggggccacggaaattcaaaccagcggaacaaccacaatcttcgctggccacctgaaatgcagactcaagatggacaaactgaccctgaaggggacgtcctatgtgatgtgtacaggcagctttaaacttgagaaggaagtcgccgagacccagcatggaaccgtgctcgttcaggtgaagtacgagggcacagatgcgccgtgcaaaattcctttctctacccaggacgaaaagggggtcacacaaaacggacggctgatcacggctaatcccatcgtgaccgataaagagaagcctgtgaacattgaaacagagccccccttcggcgagtcctatatcgttgtcggggccggagaaaaagccctgaagctcagctggtttaagaaaggctctagcattgggaagatgttcgaggctaccgccagaggcgctcgccggatggccatcctgggagacacagcgtgggattttggctccattgggggagtgttcacctctgtgggcaaacttgtccaccaggtgtttgggacggcctacggagttctgttcagcggcgtgtcctggaccatgaagatcgggatcggcattctcctgacatggctgggacttaatagcagatctacctccctcagcatgacatgtatcgctgtcggcatggtgaccctgtacctgggggttatggtgcaggccgactctggatgcgtcattaactggaaaggccgcgaactcaagtgtgggtccggaatctttgtgacaaacgaggttcatacctggacggaacagtataagttccaagctgatagccctaaacggctgtccgccgcgattggcaaggcctgggaggagggggtgtgcggcatcagatctgctacacgccttgaaaatattatgtggaaacagatcagcaacgagctgaatcacatcctcctggaaaacgacatgaagtttaccgtcgtggtgggagacgccaatggcattctggctcaggggaaaaagatgatccggccgcagcccatggagcacaaatactcctggaagtcttggggaaaggccaaaattatcggcgccgatattcaaaacaccacattcatcatcgacgggcctgatacccccgaatgtcctgacgatcagagagcttggaatatttgggaggtcgaggactatggatttggcatcttcacgacaaacatttggcttaagctccgcgatagctacacccagatgtgcgaccatcggctgatgtccgcggccatcaaagatagcaaggctgttcacgccgacatgggctattggattgaatctgagaaaaatgaaacatggaagctggccagagcttcctttatcgaggtgaagacctgtacatggcccaaaagccataccctctggtctaacggggtgctggaatccgagatgatcattccgaagatctacggaggccctattagccagcacaattatcgccccgggtacttcacgcaaaccgccggaccttggcaccttggcaaactggagctcgatttcgacctgtgcgaagggacaaccgtcgtggttgatgagcattgcggaaaccggggcccctctctgagaacaaccacggtgacaggcaagatcattcacgaatggtgttgccggagctgtacccttcctcccctccgctttagaggggaggacggatgctggtacggcatggagatccggccggtcaaagaaaaggaggaaaatctggtgagatccatggttagcgcggggtctggagaggtggactccttcagcctgggcatcctctgtgtctccattatgatcgaagaggtgatgcgctctcggtggagcagaaagatgctgatgacagggacccttgctgtttttctgctcctgattatgggacagctgacctggaacgatcttatccgcctgtgcattatggtgggcgccaatgcctccgacagaatgggcatggggacaacgtatctcgctctgatggccaccttcaaactccggcctatgtttgcggtcggaatcctgttccgcagacttacatctcgggaggtgctgctcctgaccattggcctgagccttgtggcttccgtcgaactgcccaactctctcgaggaactgggggatggactcgccatgggcatcatgatgctgaagcttctgacagagtttcagccccatcaactctggaccacgctgctgagccttacattcatcaaaaccaccctgtccctcgactacgcctggaagacaaccgctatggccctgagcattgtttctctctttcctctgtgtctttccacaacgagccagaaaaccacatggctgccggtgctgctcgggtctttcggatgcaagcccctgaccatgtatcttatcacagaaaacaagatttggggccgcaaatcctggcctatcaatgagggcattatggctatcgggatcgtgagcattctgctctcttccctgctcaagaacgatgtccccctggccggacctcttatcgcgggcgggatgctgattgcctgttacgtgatcagcggatccagcgctgacctgtctctcgagaaagccgctgaagttagctgggagcaggaagccgagcactccggcacctctcataatattctggtggaagtccaggatgacgggacgatgagaatcaaggatgaggagaaagacgatacccttacaatcctgctcaaggccaccctgctcgctgtgagcggagtttatcccatgtccattcctgcgacactgtttgtgtggtacttctggcaaaaaaagaagcagcggtctggcgtcctttgggacacccccagcccgcctgaagtggagcgcgccgtcctggatgacggcatctatagaattctgcagcgggggctcctgggacgctcccaggtgggcgttggggtgtttcaagacggagtcttccacacaatgtggcacgtgacgagaggcgctgttcttatgtaccaggggaaacggctggaaccctcttgggccagcgtgaagaaagatctcatctcctacggaggcggctggagattccaggggagctggaacaccggagaggaggtccaggtgattgccgtggaacctggcaagaatcccaaaaacgttcaaacaaccccggggacctttaagacacctgagggagaagtcggcgctatcgccctggacttcaagcccgggacgtctggatcccctattgtgaatcgcgagggcaaaatcgtgggcctctatgggaacggagtcgtgaccacaagcggcacctacgtttctgcgatcgctcaggccaaggcctcccaggaagggcccctgcccgagattgaggatgaagtgtttaaaaagcggaatcttacaatcatggacctgcatcctggaagcggcaaaaccagacgctatctgccggctattgtccgggaggccatcaagagaaagctccgcacgctgattcttgcgcccacacgggtggttgcttccgaaatggccgaggccctgaaagggatgcctgtgagataccaaaccaccgctgtcaagtctgaacacacaggccgcgagatcgtggatctcatgtgccatgccaccttcacaatgcggctgctgagccccgttagagtgcctaactataatatgatcattatggacgaggctcactttaccgatcccgcctccatcgcggcccggggatacattagcacgcgcgtcggcatgggggaagctgccgctatcttcatgacagccacccctccgggatctgtggaggcctttccccagtccaacgctgtgattcaggacgaagagagagatatccctgaacggagctggaattctggctatgactggatcacagatttccccgggaaaaccgtctggtttgttcctagcattaagtccggaaacgacatcgcgaattgtctccgcaaaaacggcaagagagtgattcagctttctcggaagacgttcgacaccgagtaccaaaaaacaaagaacaatgattgggactacgtggtcaccacagatatcagcgagatgggggccaactttagagctgaccgcgtgattgatccccggagatgcctgaaaccggttatcctgaaggacggccctgaacgcgtgattctcgccggacccatgcccgtcaccgtggcctccgctgcccagcggagaggccgcatcgggcggaatcagaacaaagagggagatcagtatgtttacatgggccaacctctgaataacgacgaagatcatgcgcactggacagaggctaagatgcttctggacaatatcaacacccccgaggggattatccctgccctcttcgaaccggagagagaaaagtctgccgctattgatggagagtatcgcctgagaggcgaagcccggaaaacgttcgtggagctgatgcgcagaggggacctccccgtctggcttagctacaaggtggcgtccgagggctttcagtatagcgatcggcgctggtgcttcgacggagaaagaaataaccaggtcctggaggaaaatatggacgtggagatctggacaaaagaaggcgagcggaagaaactgagacctcgctggctcgatgcccggacctactctgaccccctggctcttagagagtttaaggaattcgccgctgggcgccggtccgttagcggagatctgattctcgagatcggcaaactgcctcagcacctgaccctcagagcccaaaacgctcttgacaatctggtgatgctgcataactccgaacaggggggaaaggcctatcggcacgcgatggaggaactccccgatacaatcgagaccctgatgcttctggccctcattgctgtgctgacaggcggcgtcacgctgtttttcctctctgggaagggacttggcaaaaccagcatcgggctgctgtgtgttacagcctcctctgctctcctgtggatggccagcgtggagccgcattggattgccgcttccatcattcttgaatttttcctgatggtgctcctgatccctgagcccgaccgccagagaacccctcaggataatcaactggcgtacgtcgtgatcggactcctttttatgattctgacagttgccgctaacgaaatgggcctgctcgagaccacgaagcgggacctggggatcggacacgtggccgccgagaaccaccagcatgctaccatgcttgatgtcgacctgcgccccgccagcgcgtggacactctacgccgtggctaccacagtcattacccctatgatgagacacacgatcgaaaatacaaccgccaacatttctctgacagctatcgccaatcaggcggccattctgatgggcctcgataaaggctggcccatctccaagatggacatcggggtgccgcttctggctctgggatgctatagccaagttaaccctctcaccctgaccgccgctgtgcttatgctggtcgcccattacgctattatcggccccgggctccaggccaaagcgacacgggaggcccagaagcgcacggctgccggaattatgaagaatcccaccgtggatggcatcgttgctattgacctggaccctgtggtctatgatgccaaattcgaaaagcagctggggcaaatcatgctccttatcctgtgtacatctcagattctgctcatgagaaccacatgggccctgtgcgagtccatcacccttgcgacgggaccgctgacaaccctctgggaaggcagccccggcaaattttggaacaccacaattgctgtgtctatggccaatatcttccgggggagctacctggctggagccggcctggccttttccctcatgaagtctcttgggggaggccgcagagggaccggagctcagggcgagacactgggcgagaaatggaagcggcagctgaaccaactcagcaagcctgaattcaatacgtataaaagatccgggattatggaggtggaccgcagcgaagccaaggagggactgaaacggggcgaaaccacaaagcacgcggtttccagagggaccgccaaacttcgctggttcgtcgagcggaacctggtgaagcccgagggaaaggtgatcgatctcggctgtgggagaggaggctggtcttactattgcgctggcctgaaaaaggtcacagaagttaaagggtacaccaagggaggccctgggcatgaggaacccatccctatggccacgtacggatggaatctggtgaaactccacagcggcaaggacgtgtttttcatgccgcccgagaaatgtgatacccttctgtgcgacattggggaatcctctcctaaccccacaatcgaggagggacgcaccctgcgggtcctcaagatggtggaaccttggctgagaggcaatcagttttgtattaagatccttaacccctatatgccgagcgttgtggagacactggaacagatgcagcgcaaacacggcgggatgctcgtccggaatcctctgtccagaaactctacccatgagatgtactgggtgagctgcggaacaggcaatattgtttccgctgtgaacatgaccagccgcatgctgctcaaccggttcacgatggcccacagaaagcccacatatgagcgcgatgtcgacctgggggcgggaaccagacatgtgaccgtggaacccgaggtcgccaatcttgatatcattggccaacggatcgaaaacatcaaaaatgagcacaagtctacatggcactacgacgaagataacccttataaaacgtgggcttaccatgggtcctatgaggttaagcccagcggatctgcctccagcatggtgaatggcgtggtccgcctgctcaccaagccttgggacgtgattccgatggttacacagatcgctatgaccgacacaaccccctttggccagcaaagagtgttcaaagagaaggtcgatacacggacccctagagccaaacgggggacgacccagattatggaagtgacagctaagtggctgtggggatttctttctcgcaacaaaaagcccagaatctgtacccgggaggaattcacacgcaaggttagatccaatgccgcgattggcgccgtgtttgtcgacgagaaccagtggaatagcgctaaagaagccgtggaggatgagcggttctgggacctggttcaccgcgaaagagagctccataagcaggggaaatgcgctacctgcgtgtacaacatgatgggaaagcgggaaaaaaagctgggcgagtttgggaaggccaaaggctcccgcgccatctggtacatgtggctgggagcgagattcctcgaatttgaggctctgggcttcatgaatgaggatcactggttcagccgggaaaactctcttagcggggtcgagggagaaggcctgcataagctcgggtatatcctgcgcgacatttccaaaatccctggaggcaatatgtacgccgatgacacggccgggtgggatacaagaattaccgaggacgatcttcaaaacgaggctaagatcacagacattatggaacccgagcacgccctgctcgctacctctatctttaaactgacgtatcagaataaggtggtccgggtgcagcgcccggccaaaaacggcaccgttatggatgtgatcagcagacgggaccagagaggatccggccaagtcgggacatacggactgaacaccttcacaaatatggaagtgcagctcattcgccagatggagtctgaaggcatctttctgcctagcgagcttgagacccccaacctggcggaacgggtgctcgactggctggagaagcacggggccgaaagacttaagcgcatggctatttccggagatgactgtgttgtgaaacctatcgatgaccggttcgccacagctctgaccgccctcaatgatatgggcaaggtcagaaaagacattccccagtgggagccttctaaggggtggaacgattggcaacaggtgcccttttgcagccatcacttccatcagctgatcatgaaagacggccgcgaaatcgttgtgccgtgtcggaatcaggatgagctggtcggaagagcgcgcgtgtcccaaggcgccgggtggagcctccgggagacggcttgcctgggaaagtcttatgcccagatgtggcagcttatgtactttcacagacgcgacctgcggctcgctgccaacgctatttgttccgccgtccctgtggattgggttcccacaagcagaaccacctggtctatccacgcgcatcaccaatggatgacaaccgaagacatgctgtccgtgtggaatcgggtctggattgaggaaaacccctggatggaggacaagacacatgtgagctcctgggaagaggttccttatcttggcaaaagagaggatcagtggtgcgggtctctgatcggactcacggcccgcgctacctgggccacaaatattcaggtggccatcaaccaggtccggagactgattggcaatgaaaactacctggactacatgaccagcatgaagcgcttcaaaaatgagtccgatccggaaggggctctctggtga

SEQ ID NO: 18711 - RNA, 9879 nt, synthetic construct
  misc_feature 1..9879: note = derived and/or modified CDS sequence (opt5) from DENV-1__KF973475__SS-prME
  source 1..9879: mol_type = other RNA
agcgtgaccatgctgctgatgctgatgcccacagcgcttgctttccacctgacgaccagaggaggggaacctcatatgatcgtctccaagcacgaacggggaaaagccctcctgtttaagacctctaccggcgttaatatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcatagacgggacaagcgctccgtcgccctggctcctcacgtggggctgggactcgagaccagaacggaaacatggatgtctagcgagggcgcctggaaacaaattcagcgggttgaaacctgggctctgcgccatcccggcttcacagtgatcgccctttttctggcgcacgccattgggacctccatcacccagaagggaatcattttcatcctcctgatgcttgtcacaccttctatggctatgagatgcgtgggcattgggaaccgggattttgttgagggactgagcggcgccacgtgggtggacgtcgtgctcgagcacgggtcctgtgtgaccacaatggctaagaataaacccaccctggatatcgaactgctcaagacagaggtcaccaaccctgccgttctgcgcaaactttgcattgaagcgaagatcagcaatacgacaaccgactctagatgtccgacccagggagaggccacactggtggaagaacaagatgctaacttcgtgtgccggcgcacctttgtcgacagaggctggggcaatgggtgtggactcttcggcaaagggtccctgcttacatgcgccaagtttaagtgcgtgacgaaactggagggaaagattgttcagtacgaaaacctcaaatatagcgtgatcgtcaccgtgcatacaggcgatcagcaccaggttgggaatgagaccacagaacatggaaccatcgctacgattacaccccaagcccctacatctgagatccagctgaccgactacggcgccctgacactcgactgtagcccccggaccggcctggatttcaacgaaatggtgcttctgacgatgaaggagaaaagctggctcgtccacaagcagtggtttctggaccttcctctgccctggacatctggggcttccaccagccaggagacatggaatcgccaagatctcctggtgaccttcaaaaccgcgcacgccaagaagcaggaagtcgtggttctgggatcccaggagggcgctatgcatacagccctcacgggggccaccgaaattcaaacatctggaaccacaaccatctttgctggccacctgaaatgcagacttaagatggacaaactgacgctcaaggggacaagctatgtgatgtgtaccggctccttcaaactggagaaggaagtcgccgagacccagcatggaacagtgctggttcaggtgaagtacgagggcaccgatgcgccgtgcaaaattcctttcagcacacaggacgaaaagggggtcacgcaaaacggacggcttatcaccgctaatcccatcgtgacagataaagagaagcctgtgaacattgaaaccgagccgccctttggcgagtcttatatcgttgtcggggccggagaaaaagccctcaagctgtcctggttcaagaaaggcagctctattgggaagatgtttgaggctacagccagaggcgctcgccggatggccatcctgggagacaccgcgtgggatttcggcagcattgggggagtgtttacgtccgtgggcaaactcgtccaccaggtgttcgggaccgcctacggagttctgttttctggcgtgagctggacaatgaagatcgggatcggcattcttctgacctggctcggactcaattccagaagcacatctctgtccatgacctgtatcgctgtcggcatggtgacactttacctcggggttatggtgcaggccgacagcggatgcgtcattaactggaaaggccgcgaactgaagtgtgggtctggaatcttcgtgaccaacgaggttcatacgtggacagaacagtataagtttcaagctgattcccctaaacggctgagcgccgcgattggcaaggcctgggaggagggggtgtgcggcatcagatccgctacccgcctcgaaaatattatgtggaaacagatctctaacgagctgaatcacatccttctggaaaacggaatgaagttcaccgtcgtggtgggcgacgccaatgggattctcgctcagggcaagaagatgatccggccgcagcccatggagcacaaatacagctggaagtcctggggcaaggccaaaattatcggggccgacattcaaaacacaacctttatcatcgatggacctgacacgcccgaatgtcctgatgaccagagagcttggaatatttgggaggtcgaggattatggcttcggcatctttacaaccaacatttggctgaagctgcgcgactcttacacacagatgtgcgatcatcggcttatgagcgcggccatcaaagactccaaggctgttcacgccgatatggggtattggattgaaagcgagaaaaatgaaacctggaagctcgccagagcttctttcatcgaggtgaagacatgtacctggcccaaatcccatacgctgtggagcaacggagtgctggaatctgagatgatcattccgaagatctacggcgggcctatttcccagcacaattatcgccccggatacttcacccaaacagccggcccttggcacctcgggaaactggagcttgactttgatctgtgcgaaggaaccacagtcgtggttgacgagcattgcggcaaccggggccccagcctcagaaccacgacagtgaccgggaagatcattcacgaatggtgttgccggtcttgtacactgcctcccctgcgcttcagaggagaggatggctgctggtacgggatggagatccggccggtcaaagaaaaggaggaaaatcttgtgagaagcatggtttccgcgggaagcggcgaggtggactctttttccctcgggatcctgtgtgtcagcattatgatcgaagaggtgatgcgctcccggtggtctagaaagatgctgatgaccggaaccctcgctgttttcctgcttctgattatgggccagctcacatggaacgacctgatccgcctgtgcattatggtgggcgccaatgccagcgatagaatggggatgggaacgacctatcttgctctgatggccacatttaaaatgcggcctatgttcgcggtcggcatcctctttcgcagactgacctcccgggaggtgctcctgcttacaattgggctgtctctcgtggctagcgtcgaactgcccaactccctggaggaacttggagacggcctggccatggggatcatgatgctcaagctgctcaccgagttccagccccatcaactgtggacgacacttctgtctctcacctttatcaaaaccacactgagcctggattacgcctggaagaccacagctatggccctttccattgttagcctgttccctctctgtctgtctacgacctcccagaaaacaacctggctcccggtgctgcttggatcctttggctgcaagcccctgacaatgttcctgatcaccgaaaacaagatttggggccgcaaatcttggcctatcaatgaggggattatggctatcggaatcgtgtccattctcctgagctctcttctgaagaacgacgtccccctcgccggccctctgatcgccgggggaatgctcattgcctgttatgtgatctccggcagctccgctgatctgagccttgagaaagccgctgaagtttcttgggagcaggaagccgagcacagcgggacgtcccataatattctggtggaagtccaggacgatggaaccatgagaatcaaggacgaggagaaagatgacacactgaccatcctcctgaaggccacacttctggctgtgtctggcgtttaccccatgagcattcctgcgaccctctttgtgtggtatttctggcagaagaagaagcagcggtccggcgtcctgtgggatacaccctctccgcctgaagtggagcgcgccgtcctcgacgatgggatctaccggattctgcagcggggacttctgggccgcagccaggtgggggttggagtgttccaagacggcgtctttcacacgatgtggcacgtgaccagaggggctgttctgatgtatcagggaaaacggctcgaaccctcctgggcctctgtgaagaaagacctgatcagctacggcggcgggtggagattccagggatcctggaacacaggcgaggaggtccaggtgattgccgtggaacctgggaagaatcccaaaaacgttcaaaccaccccgggaacatttaagacgagcgagggcgaagtcggggctatcgcccttgatttcaagcctggaacctctggctcccccattgtgaatcgcgagggcaaaatcgtggggctgtacggaaacggcgtcgtgacaaccagcgggacatatgtttctgcgatcgctcaggccaagacctcccaggaaggacctctccccgagattgaggacgaagtgtttaaaaagcggaatctgacgatcatggatctccatcccggcagcgggaaaacaagacgctacctgcctgccattgtccgggaggctatcaagagaaaacttcgcaccctgattctggccccgacccgggtggttgcgtccgaaatggctgaggccctcaaaggcatgcccatcagatatcaaacaaccgccgtgaagtctgaacacacaggacgcgagatcgtcgacctgatgtgccatgctaccttcacgatgcggcttctgagccctgtgagagttcccaactacaatatgattatcatggatgaggcccactttacagaccctgcttccattgccgcgcggggctatatcagcacccgcgtggggatgggagaagccgctgccattttcatgacagctacaccccctggctctgtcgaggcctttccgcagtccaacgccgtgatccaggatgaagagagagacatccccgaacggagctggaactctgggtacgattggattacggacttccctggaaaaaccgtgtggtttgtccccagcatcaagtccggcaacgatattgctaattgtctccgcaaaaacgggaagagagttatccagctgtctcggaagacattcgacaccgagtatcagaaaaccaagaacaatgactgggattacgtggtgaccacagacattagcgagatgggcgcgaacttcagagccgatcgcgtcatcgaccctcggagatgcctgaaacccgtgattctcaaggatggaccggaacgcgttatccttgctggccctatgcccgtgaccgtcgcctccgccgctcagcggagagggcgcatcggacggaatcagaacaaagagggcgaccagtacgtgtatatggggcaacccctgaataacgatgaagaccatgcccactggacggaggcgaagatgctgctcgataatattaacacacctgagggaatcattcccgctctgtttgaacctgagagagaaaagtctgccgccatcgacggcgagtaccgccttagaggggaagctcggaaaaccttcgttgagctgatgcgcagaggcgatctcccggtgtggctgagctataaggtcgcctccgagggatttcagtacagcgaccggcgctggtgcttcgatggcgaaagaaataaccaggtgctggaggaaaatatggacgtcgagatttggaccaaagaaggggagcggaagaaactcagaccccgctggcttgacgcgcggacatattctgatcctctggccctgagagagtttaaggagttcgctgccggacgccggtccgtgagcggcgacctcatcctggagatcgggaaacttccccagcacctgaccctcagagctcaaaacgccctggataatctggttatgctccataactccgaacagggaggcaaggcttaccggcacgccatggaggaacttcctgacacaattgagacgctgatgctgctcgcgctgatcgccgtgcttaccggcggggtgacactgtttttcctctctggaaagggcctggggaaaaccagcattggactgctctgtgtcacagcttcctctgcccttctgtggatggctagcgttgagccccattggatcgccgcctccattatcctggaatttttcctcatggtgctgcttatcccggagcctgatcgccagagaacgccccaagacaatcaactggcttatgtggtcattggcctcctgtttatgatcctgaccgtggcggccaacgaaatggggctccttgagaccacaaagcgggatctgggaattggccacgttgctgccgagaaccaccagcatgccaccatgctggacgtggatctccgccctgctagcgcctggacactgtacgcggtcgccaccacggtgatcacacccatgatgagacacaccattgaaaatacaaccgctaacatctctcttaccgccattgctaatcaggccgcgatcctgatgggcctcgacaaagggtggcctatctccaagatggatattggagtccccctgctggccctcggctgctacagccaagtgaacccgcttacactgacggctgccgttctgatgctcgtggctcattatgccatcattgggcctggactgcaggctaaagccacccgggaggcgcagaagcgcacagccgctggcatcatgaagaatcccaccgtcgacgggattgtggccatcgatcttgaccccgttgtgtacgacgctaaattcgaaaagcagctgggacaaatcatgctcctgattctgtgtacatctcagatcctccttatgagaaccacgtgggccctgtgcgagtccattacactggccaccggccctctcaccacactgtgggaaggcagcccggggaaattttggaacaccacaatcgcggtctctatggctaatattttccggggaagctatcttgccggcgctgggctggccttctccctcatgaagtctctgggaggcgggcgcagaggaacgggcgcccagggcgagaccctgggggagaaatggaagcggcagctcaaccaacttagcaagcccgaatttaatacatacaaaagatccggaatcatggaggtggatcgcagcgaagctaaggagggcctgaaaagaggggaaaccacaaagcacgccgtgtccagaggaaccgcgaaactgcgctggttcgttgagcggaacctcgtcaagcctgagggcaaggtgatcgacctggggtgtggaagaggcggctggtcttattactgcgccgggcttaaaaaggtgacggaagtcaaaggatataccaagggcgggcccggacatgaggaacctattcccatggctacatacggctggaatctggttaaactccacagcgggaaggatgtgtttttcatgcctccggagaaatgtgacaccctgctgtgcgatatcggagaatcctctcccaaccctacaattgaggagggccgcaccctccgggtgcttaagatggtcgaaccctggctgagaggcaatcagttttgtatcaagattctgaacccttacatgcccagcgtggttgagacactcgaacagatgcagcgcaaacacgggggaatgctggtgcggaatccgctttccagaaactctacccatgagatgtattgggtcagctgcggcacggggaatatcgtgtccgccgttaacatgacaagccgcatgctgctcaaccggttcaccatggctcacagaaagcctacctacgagcgcgacgtggatctgggagccggcacaagacatgtcgcggtggaacccgaggtggccaatctggacattatcgggcaacggatcgaaaacattaaaaatgagcacaagtctacgtggcactatgatgaagacaacccctacaaaacctgggcttatcatggatcctacgaggtcaagcctagcggctctgcctccagcatggttaatggcgtggtgcgcctcctgacaaagccctgggatgtcatccctatggtgacccagattgctatgacagacaccacaccgtttgggcagcaaagagttttcaaagagaaggtggacacccggacgcccagagccaaacggggaaccacacagatcatggaagtcaccgctaagtggctttggggctttctgtctcgcaacaaaaagcctagaatttgtacacgggaggagttcacccgcaaggtgagatccaatgccgcgatcggggccgtttttgtggatgagaaccagtggaatagcgctaaagaagccgtcgaggacgagcggttctgggatctcgtgcaccgcgaaagagagctgcataagcagggaaaatgcgctacgtgcgtttataacatgatgggcaagcgggagaagaaacttggggagtttggcaaagccaaaggatcccgcgccatctggtacatgtggctgggcgcgagattcctcgagttcgaggctctggggtttatgaatgaggaccactggttcagccgggaaaactctctgagcggagtggagggcgaagggctccataagctgggatacattcttcgcgatatctccaaaattcccggcgggaatatgtatgccgacgatacagccggctgggacaccagaatcacagaggatgacctgcaaaacgaggctaagattaccgatatcatggaacctgagcacgccctcctggctacgtctatctttaaacttacctaccagaataaggtcgtgcgggtccagcgccccgccaaaaacggaacagtgatggacgttattagcagacgggatcagagaggctccgggcaagtgggaacctatggcctgaacacattcaccaatatggaagtccagctcatccgccagatggagtctgaagggatttttctgccgagcgagctggagacacctaacctcgcggaacgggtgctggactggcttgagaagcacggagccgaaagactgaagcgcatggctatctccggcgacgattgtgtggttaaacccattgacgatcggttcgccaccgctctcacggccctgaatgacatggggaaggtgagaaaagatatccctcagtgggagccctctaagggctggaacgactggcaacaggtccctttttgcagccatcacttccatcagcttatcatgaaagatggacgcgaaattgtggttccctgtcggaatcaggacgagctggtgggcagagcgcgcgtctcccaaggggccggatggagcctccgggagacagcttgcctgggcaagtcttacgcccagatgtggcagctgatgtattttcacagacgcgatctccggctggctgccaacgctatctgttccgccgtgccggtcgactgggtgcctaccagcagaaccacatggtctattcacgcgcatcaccaatggatgaccacagaagatatgctttccgtttggaatcgggtgtggatcgaggaaaacccctggatggaggacaagacgcatgtcagctcctgggaagaggtgccctacctggggaaaagagaggaccagtggtgcggatctctcattggcctgaccgcccgcgctacatgggccaccaatatccaggttgccattaaccaggtgcggagacttatcgggaatgaaaactatctggattacatgacaagcatgaagcgcttcaaaaatgagtccgaccctgaaggcgctctctggtga

SEQ ID NO: 18712 - RNA, 9879 nt, synthetic construct
  misc_feature 1..9879: note = derived and/or modified CDS sequence (opt5) from DENV-1__FJ898448__SS-prME
  source 1..9879: mol_type = other RNA
agcgtgaccatgctgctcatgctgcttcccaccgtcctgacgttccacctcaccacaagaggcggggagcctcatatgatcgtttccaagcaggaacggggaaaatctctgctttttaagaccagcgccggcgtgaatatgtgcacactgattgctatggacctcggggagctgtgtgatgacaccatgacatacaaatgcccgagaatcaccgaaacggagcccgatgacgtggattgttggtgcaatgccaccgaaacatgggttacctatggaacatgttcccagaccggcgagcacagacgggacaagcgctctgtggcgctggctcctcatgttgggctcggactggagacgagaacagaaacctggatgagctccgagggcgcctggcggcagattcagaaagtggaaacatgggcccttcgccaccccggcttcaccgtcatcgctctgtttctcgcccatgctattgggacctctatcacacagaagggaatcattttcatcctgcttatgctggtgacgcctagcatggccatgagatgcgttggcattgggaaccgggattttgtggagggactctccggcgcgacctgggtcgacgtggtgctggagcacgggagctgtgtcacaaccatggccaaggataaacccacactggacatcgaactcctgaagaccgaggttacgaatcctgctgtgcttcgcaaactgtgcattgaagccaagatctctaacacaaccaccgattccagatgtccgacacaaggagaggctaccctcgtggaagaacaagacacaaatttcgtctgccggcgcacgtttgtggatagaggctggggcaacgggtgtggactgttcggcaaagggagccttattacctgcgccaagtttaagtgcgttacaaaactggagggaaagatcgtgcagtacgaaaatctcaaatattctgtcatcgtgaccgttcacacaggcgaccagcatcaagtggggaacgagaccacggaacacggaaccattgcgacaatcacaccccaggcccctacatccgagattcagctgaccgactacggcgctctgacgctcgattgtagcccccggacaggcctggacttcaatgaaatggtccttctgaccatgaaggagaaatcttggctcgtgcataagcagtggtttctggatcttcctctgccctggacatccggggccagcacctcccaagagacctggaaccgccaggacctcctggtcacattcaaaacggctcacgccaagaagcaggaagtggttgtgctgggatctcaagagggcgccatgcacaccgctctcacaggggcgaccgaaatccagacaagcggaaccacgacaatttttgccggccatctgaaatgcagacttaagatggataaactgaccctcaaggggatctcctatgtcatgtgtaccggcagcttcaaactggagaaggaagtggctgagacacagcacggaaccgttctggtgcaggtcaagtacgagggcacagacgccccgtgcaaaatccctttctcttcccaagatgaaaagggggtgacgcagaatggacggcttgtgaccgccaaccccattgttacagacaaagagaagcctgtcaatatcgaagctgagccgccctttggcgagagctatattgtggtgggggccggagaaaaagcgctcaagctgtcttggttcaagaaaggcagctccatcgggaagatgtttgaggctaccgccagaggcgcccgccggatggctattctgggagatacagcctgggacttcggctctatcgggggagtctttaccagcgtgggcaaactcgttcatcagatcttcgggacggcttacggagtgctgttttccggcgtcagctggaccatgaagattgggatcggcattcttctgacatggctcggactgaactctagatccaccagcctgtctatgacatgtatcgccgtgggcatggttaccctttacctcggggtgatggtccaggcggattccggatgcgtgattaattggaaaggccgcgaactgaagtgtgggagcggaatcttcgttacaaacgaggtgcacacctggacggaacaatataagtttcaggccgactcccctaaacggctgtctgctgccattggcaaggcttgggaggagggggtctgcggcatcagaagcgccacacgcctcgaaaacatcatgtggaaacagatttccaatgagctgaaccatatccttctggaaaatgacatgaagttcaccgtggtggtcggagatgtttctggcattctcgcgcaggggaaaaagaccatccggccgcaacccatggagcacaaatacagctggaagtcctggggaaaggccaaaattatcggcgctgacgtgcagaacacaacctttatcattgatgggcctaatacgcccgaatgtcctgacgatcagagagcctggaacatctgggaggtggaggactatggattcggcatttttacaaccaatatctggctgaagctgcgcgatagctacacacaggtctgcgaccaccggcttatgtctgctgccattaaagattccaaggccgtgcatgctgacatgggctattggatcgaaagcgagaaaaacgaaacctggaagctcgcgagagcctctttcatcgaggttaagacatgtgtgtggcccaaatcccacaccctgtggagcaatggggtcctggaatctgagatgattatcccgaagatttacggaggccctatcagccaacataactatcgccccgggtacttcacgcagaccgctggaccttggcacctcggcaaactggagcttgattttgacctgtgcgaagggacaaccgtggttgtggatgagcactgcggaaatcggggcccctccctcagaacaaccacggtcacaggcaagattatccatgaatggtgttgccggagctgtaccctgcctcccctgcgcttcaaaggggaggacggatgctggtacggcatggagatcagaccggtgaaggaaaaggaggaaaaccttgttaaatctatggtgtccgccgggagcggagaggtcgactccttttctctcggcctgctgtgtattagcatcatgattgaagaggtgatgcggtccagatggtctcgcaagatgctcatgacagggaccctggtggtcttccttctgctcaccctgggacagctgacatggaatgatcttatccggctgtgcattatggttggcgccaacgctagcgacaatatgggcatggggacgacctatctcgccctgatggcgacatttagaatgcgccctatgttcgctgtgggactcctgtttagacggcttacctcccgcgaggtgctgctcctgacagtcggcctgtctcttgtggccagcgttgaactgcccaactccctcgatgagctgggggacggactcgccatgggcatcatgattctgaaacttctgaccgatttccaaagccaccagctctgggctacgctgctgtctcttacatttgtgaagaccaccctgtccctccattacgcctggaaaacaatggcgatgatcctgagcatcgtctctctcctgcccctttgtctgtccaccacaagccagaagacgacctggctgcctgtgctcctggggtctcttggatgcaagccgctgacaatgttcctcattaccgaaaacaaaatctggggcagaaagtcctggcccctgaatgagggcattatggctgttgggatcgtgagcattctcctgtccagccttctgaaaaacgacgtccctctggccggacccctcatcgccggcgggatgctgatcgcttgttatgtgatttctggaagctccgccgatctttctctggaaaaggctgccaaagtcagctgggaggaggaagcggagcactccggcgcctctcataatatcctcgtggaaattcaggacgatgggacaatgaagatcaaagacgaggaacgggatgacaccattacgatcctgctcaaggctaccctgcttgccatcagcggagtttaccctatgtccattcccgctacactgtttgtgtggcacttctggcaaaagaaaaagcagcgctctggcgtcctgtgggatacccctagccctcccgaggtggagaaagccgttctcgacgacggcatctatcgcattctgcagcgggggcttctgggacgctcccaggtgggcgtcggggtgtttcaagaaggagtgttccacacaatgtggcatgttaccagaggcgccgtcctcatgtaccaggggaagcggctggagcccagctgggcttctgtgaaaaaggatctcatctcctatggaggcggctggcgcttccaggggagctggaacacaggagaagaggtgcaggtcattgcggtggagcccggcaagaatcctaaaaacgttcaaacggcccccgggacctttaagacatctgaaggagaggtgggcgctatcgccctggacttcaaaccggggacctccggaagccctattgtcaatagagaaggcaagatcgtgggcctttacgggaacggagttgtgaccacatccggcacgtacgtctctgccatcgctcaggccaaagcgagccaggaggggcccctgcctgaaattgaggatgaggtgtttcggaagagaaatctgaccatcatggacctccaccccggatccggcaagacacgccggtatctgcccgctattgttagagaagccatcaaacgcaaacttcggaccctggtgctcgcccctacaagagtcgtggctagcgagatggccgaagcgctgaaagggatgccgattcgctaccaaaccacggctgtgaagtctgagcatacaggcaaagaaatcgtcgatctgatgtgccacgccaccttcaccatgcggctcctttcccccgttagagtgcctaactataatatgatcattatggacgaggcccattttacagatcccgctagcatcgccgctcgcggatacatttctacccgggtgggcatgggggaggccgcggccatcttcatgacagctacccctcccggaagcgtcgaagcctttcctcagtccaacgctgtgattcaggacgaggaaaaggatatcccggagagatcttggaatagcggctatgactggatcacggatttccccgggaagacagtttggtttgtgccttccattaaatctggaaacgacatcgccaattgtctgcggaagaacggcaaacgcgtcattcagctgagcagaaagaccttcgacacagaataccagaagaccaagaacaatgattgggactatgtggttacgaccgatatctccgagatgggggccaactttcgggctgaccgcgtgattgatcccagacggtgcctcaagcctgtcatcctgaaagacggccccgagagagtgattcttgcgggaccgatgcctgtcacagtggccagcgctgcccagcgccggggcagaatcgggcgcaatcagaacaaggaaggagatcagtacatctacatgggccaacccctgaataacgacgaggatcacgcccactggaccgaagctaaaatgctcctggacaatattaacacacccgaggggatcattcctgccctgttcgagcccgaacgggagaagtctgcggctatcgatggagaatatagactccgcggcgaggcccggaaaaccttcgttgaacttatgagacgcggggacctgcctgtgtggctgtcctacaaggtggccagcgagggctttcagtattccgatagacggtggtgcttcgacggagagcgcaataaccaggtcctcgaagagaatatggacgttgaaatttggacaaaagagggcgaaagaaagaagctgcggccgcgctggcttgatgctagaacctactctgaccccctggccctccgggagtttaaagagttcgcggccgggagacgcagcgtgtccggagatctgatcctggaaatcggcaagctccctcagcatcttacgcaacgggctcagaacgccctggacaatctggtgatgctccacaactctgagcaagggggaaaggcttatagacatgccatggaggaactgcccgatacaattgaaaccatcatgcttctggctctcattgccgtcctgaccggcggcgtgacactgtttttcctcagcgggcgcggacttggcaagacctccatcgggctgctgtgtgttacatcctctagcgcgctcctgtggatggccagcgtggagcctcactggattgctgcctctatcatccttgagtttttcctgatggtcctcctgattcccgaaccggaccggcagagaacgcctcaagataatcagctggcttacgtggtcatcggactcctttttatgattctgaccgtggccgccaacgagatgggcctgctcgaaacaaccaaaaaggacctggggatcggacacgctgcggccgagaaccatcaccatgctgccatgcttgatgttgacctgcaccccgcctccgcttggacactctatgccgtggcgaccacgattatcacccctatgatgcggcatacaattgagaataccacagccaacatcagcctgaccgctatcgccaatcaggctgccattctgatgggcctcgataagggctggcccatctctaaaatggacattggggtccctcttctggcgctgggatgctacagccaagtgaaccccctcacgctgacagccgctgttcttatgctggtggcccactacgctatcattggcccggggctccaggccaaggctacccgcgaagcccagaaaagaacagcggccggaatcatgaagaatcctaccgtcgatggcatcgtggctattgacctggaccccgtggtttatgatgccaaattcgagaagcagctggggcaaatcatgctccttattctgtgtacctcccagatcctgctcatgcggacaacgtgggctctgtgcgaatctattacccttgccacaggacccctgaccacactctgggagggcagccctggcaagttttggaacaccacgatcgccgtctccatggcgaatatcttccgcgggagctacctggctggagccggcctggctttttccctcatgaaatctcttgggggaggcagacgggggacaggagcccagggcgaaaccctgggcgagaagtggaaacgccagctgaaccaactcagcaagtccgagttcaatacctataaaagatctgggattatcgaagtggaccggagcgaggccaaggaaggactgaagcgcggcgagacaaccaaacacgctgtgtccagagggacagccaaacttcggtggttcgtcgaaagaaacctggttaaaccggagggaaaggtgattgatctcggctgtgggcgcggaggctggtcttactattgcgcgggcctgaaaaaggtgacggaggtcaaagggtacaccaagggaggccccgggcatgaggagcctatccccatggccacatatggatggaatctggtgaagctccacagcggcaaagacgtctttttcattcctcccgaaaagtgtgatacccttctgtgcgacatcggggagtccagccctaacccgacaattgaagagggacggaccctgagagtgctcaaaatggtcgagccctggctgcgcggcaatcagttttgtatcaagatccttaacccttacatgccctctgtggttgaaacgctggagcagatgcagcggaaacatggcgggatgctcgtgagaaatcctctgtcccgcaacagcacccacgaaatgtactgggtctcttgcggaacaggcaatattgtgtccgctgtgaacatgaccagccggatgctgctcaacagattcacaatggcccaccgcaagcccacctatgagcgggatgtcgacctgggggctggaacaagacatgttgccgtggagccggaagtggcgaatcttgatatcattggccaacgcatcgagaacattaagaatgaacacaaatctacctggcattacgacgaggataacccttataagacgtgggcctaccacgggtcctatgaagtcaaacccagcggatccgctagctctatggtgaatggcgttgtgcggctgctcacaaagccctgggacgtcatccctatggtgacccagatcgccatgaccgacacaacgccctttggccagcaaagagttttcaaagagaaggtggatacccgcacacctaaggctaaaagagggaccgcccagattatggaggtcacagctaagtggctgtggggatttcttagccggaacaaaaagccgcgcatctgtaccagagaagagttcacacggaaagtgagatccaatgccgcgattggcgccgtttttgtggacgaaaaccagtggaactctgctaaggaggccgtcgaagatgagcggttctgggacctggtgcgcagagagcgggaactccataagcaggggaaatgcgctacctgcgtctacaacatgatgggaaagcgcgagaaaaagctgggcgaatttgggaaagccaagggcagcagagccatctggtatatgtggctgggagcgcggttcctcgagtttgaagctctgggcttcatgaatgaggatcactggttctcccgcgagaactctcttagcggggtggaaggagagggcctgcacaaactcgggtacattctgagagacatctccaagatccccggaggcaatatgtacgccgatgacacggccgggtgggatacccggattacagaagacgatcttcaaaacgaggctaagatcaccgacattatggagcctgaacatgccctgctcgctacatctatctttaaactgacctatcagaataaggttgtgcgcgtccagagacccgccaaaaacggcacggtgatggatgtgattagccggcgcgaccagagaggatccggccaagttgggacatacggactgaacaccttcacaaatatggaggcgcagctcatccggcagatggaaagcgagggcatcttttctccttccgaactggagacccccaaccttgccgggcgcgtgctggactggctcgagaagcacggaacggaaagactgcggagaatggctattagcggcgatgactgtgtcgtgaaaccgatcgatgaccgcttcgccaccgctcttacagccctgaatgatatggggaaggttcggaaggacattcctcagtgggagccctctaaaggctggaacgattggcaacaggtgcctttttgctcccatcacttccaccagctcatcatgaaggacggaagagaaattgtcgtgccctgtcgcaatcaggatgagctggtcggccgggcgagagtgagccaaggggccggatggtccctgcgcgaaaccgcttgcctcggcaaatcttatgcccagatgtggcagctgatgtactttcatcggagagaccttcgcctggctgccaacgctatctgtagcgccgttcctgtggattgggtccccacatcccggaccacatggagcattcacgcgcatcaccaatggatgaccacggaggacatgctctctgtgtggaatagagtttggatcgaggaaaacccgtggatggaggacaagacacatgtgtccagctgggaagatgtcccttatctggggaaacgcgaggaccagtggtgcggatctcttatcggcctgaccgcccgggctacctgggccacaaatattcaggtggccatcaaccaggtgagacggctcattgggaatgaaaactacctggattatatgaccagcatgaagagattcaagaatgagtccgaccccgagggcgctctgtggtga

SEQ ID NO: 18713 - RNA, 9879 nt, synthetic construct
  misc_feature 1..9879: note = derived and/or modified CDS sequence (opt5) from DENV-1__GQ868602__SS-prME
  source 1..9879: mol_type = other RNA
agcgtgaccatgctgcttatgctgcttcccacagccctggctttccacctcacgacccggggcggggaacctcatatgatcgtgtccaagcaggaacggggaaagtctctgctttttaagacaagcgccggcgttaacatgtgcaccctgattgcgatggacctcggggaactgtgtgaagatacaatgacctacaaatgcccccgcatcacagagaccgaacccgacgatgtggactgttggtgcaatgctacggagacctgggtgacatatggaacctgttcccaaacaggcgagcacagacgggataagcgctctgtcgccctggcccctcatgtggggctcggactggaaaccagaacggagacatggatgagctccgaaggcgcttggcggcagattcagaaagttgagacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggactttgttgagggactctccggcgctacgtgggtggatgtcgtgctggaacacgggagctgtgtgaccacaatggccaaggacaaacccaccctggatatcgagctcctgaagacagaagtcaccaatcctgctgttcttcgcaaactgtgcattgaggccaagatctctaacacgacaaccgactccagatgtccgacccaaggagaagcgacactcgtggaggagcaggataccaatttcgtgtgccggcgcacatttgtcgacagaggctggggcaacgggtgtggactgttcggcaaagggagccttattacgtgcgccaagtttaagtgcgtgaccaaactggaaggaaagatcgttcagtacgagaatctcaaatattctgtgatcgtcacagtgcacaccggcgatcagcatcaagttgggaacgaaacaaccgagcacggaacgaccgctacaattacaccccaggcccctacatccgaaatccagctgaccgactacggcgctctgacgctcgactgtagcccccggacaggcctggatttcaatgagatggtgcttctgaccatgaaggagaaatcttggctcgtccataagcagtggtttctggaccttcctctgccctggacatccggggccagcacctcccaagaaacctggaaccgccaggatctcctggtgacattcaaaacggcccacgctaagaagcaggaggtcgtggttctgggatctcaagaaggcgcgatgcacaccgccctcacaggggctaccgagattcagacaagcggaaccacgacaatctttgccggccatctgaaatgcagacttaagatggacaaactgaccctcaagggggtgtcctatgtcatgtgtaccggcagcttcaaactggaaaaggaggtggccgagacacagcacggaaccgttctggtgcaggtcaagtacgaaggcacagatgctccgtgcaaaattcctttctcttcccaagacgagaagggggtgacgcagaatggacggcttatcaccgccaaccccatcgtgacagataaagaaaagcctgttaatattgaggcggagccgccctttggcgaaagctatctcgtcgtgggggctggagagaaagccctgaagctgtcttggttcaagaaaggcagctccatcgggaagatgtttgaagccaccgctagaggcgcccgccggatggctattctcggagacacagcctgggatttcggctctatcgggggagtgtttaccagcgtcggcaaactgattcatcagatcttcgggacggcgtacggagtgctcttttccggcgttagctggaccatgaagatcgggattggcatcctgctcacatggctgggactgaactctagatccaccagcctttctatgacatgtattgccgtgggcatggtcaccctctacctgggggtgatggttcaggctgactccggatgcgtgatcaattggaaaggccgcgagctgaagtgtgggagcggaattttcgtcacaaacgaagtgcacacctggacggagcaatataagtttcaggccgattcccctaaacggctctctgctgccatcggcaaggcgtgggaggaaggggtttgcggcattagaagcgccacacgcctggagaacatcatgtggaaacagatctccaatgaacttaaccatattctgctcgagaatgacatgaagttcaccgtggtcgtgggagacgtgaacggcgtcctggctcaggggaaaaagatgatccggccgcaacccatggaacacaaatactcttggaaaagctggggaaaggccaaagttattggcgctgatgtgcagaatatcacctttattatcgacgggcctaacacacccgagtgtcctgatgaccagagagcctggaatatctgggaggtggaagattatggattcggcatttttaccacgaacatctggctgaaacttcgcgactcctacacacaggtctgcgatcaccggctcatgagcgccgctattaaagactctaaggcggtgcatgccgatatgggctattggatcgagtccgagaagaatgagacctggaagctgacaagagctagcttcattgaagttaagacctgtatctggcccaaatctcacacactgtggtccaacggggtgctcgagagcgagatgatcattccgaagatctacggaggccctatttctcaacataattatcgccccgggtacttcacccagacggccggaccttggcacctgggcaaacttgaactggactttgggctctgcgagggaaccacagtcgtggttgatgaacactgcggcaaccggggccccagcctgagaaccacaaccgtgacggggaagatcattcatgagtggtgttgccggtcctgtacactgcctccccttcgcttcaaaggagaggacggctgctggtacgggatggaaatcagaccggtcaaggagaaggaagagaatctcgtgaaaagcatggtttctgccggatccggcgaagtggatagcttttccctggggctgctctgtatctctattatgatcgaggaggtcatgcggagcagatggtcccgcaagatgctgatgaccggaacacttgctgtgttcctgctcctgattatgggccagctgacctggaacgaccttatccggctgtgcattatggtgggcgccaatgcgtctgacaaaatggggatgggaaccacatatctcgctctgatggccacgtttagaatgcgccctatgttcgccgtcggcctcctgtttagacggcttaccagccgcgaagttctgctcctgacagtggggctgtcccttgtggcttctgtcgagctgcccaacagcctcgaagaactgggagatggcctcgccatggggatcatgatgctgaaacttctgaccgacttccaatcccaccagctctgggcgacactgctgagccttacctttgtgaaaacgacattctctctgcattacgcttggaagaccatggccatgattctctccatcgttagcctgtttcccctctgtctgtctaccacatcccagaagaccacatggcttcctgtgctgctgggaagcctcggctgcaaaccgctgacgatgttccttatcaccgaaaacaagatttggggcagaaaatcttggcccctgaatgaggggatcatggccgtcggaattgtgtccatcctcctgagctccctcctgaagaacgatgttcctcttgctggccccctgattgccgggggaatgctgatcgcttgttatgtgatcagcggctctagcgccgacctctccctggagaaagcggccgaagtctcttgggaggaagaggctgaacacagcggggcctcccataatattcttgtggaggtccaggatgacggaacaatgaagatcaaagatgaggaacgggacgataccctgacaattctcctgaaggctaccctcctggccatctctggcgtgtaccctatgagcattcccgccacgctttttgtttggtatttctggcaaaagaaaaagcagcgctccggcgtgctgtgggacaccccttctcccccggaggtcgaaagagctgtgctggatgacgggatctaccggatcctccagcgcggactgcttggcaaaagccaggttggggtgggagtcttccaagagggcgtgtttcacacaatgtggcacgtgaccagaggggcggttctgatgtatcagggaaagcggctcgagccttcctgggccagcgtcaaaaaggatctgatttcttacggcggcgggtggcgcttccagggatcctggaacatgggcgaagaggtccaggtgatcgctgtcgaacccgggaagaatcctaaaaacgtgcaaacagcccccggaacctttaagacaccggagggcgaagttggggccattgctctcgacttcaaacctggaacgagcggctctcccatcgtgaatagagagggcaagattgtcgggctgtacggaaacggcgtggttaccacatccgggacctatgtgagcgccatcgcgcaggctaaagcctcccaggagggacctcttcccgaaattgaggacgaagtctttcggaagagaaatctgaccatcatggatctgcatcccggctctgggaagacacgccggtacctccctgccatcgtgagagaggctattaaacgcaagctgcggacgcttgttctggccccgaccagagtggtcgcgagcgaaatggctgaggccctcaaaggcatgcccatccgctatcaaacaaccgccgtgaagtccgagcacacaggaaaagaaattgtggacctgatgtgccatgctaccttcacgatgcggctgctcagccctgtcagagttcccaactacaatatgatcattatggatgaggcccactttacagaccctgcttctatcgccgcgcgcggctatatctccacccgggtggggatgggagaagccgctgccattttcatgaccgctacaccccctggcagcatggaggcctttccgcagtctaacgccgctatccaggatgaagagagagacattcccgagcggagctggaactccgggtacgattggatcaccgacttccctggaaagacagtgtggtttgtcccctctattaagagcggcaacgatatcgcgaattgtcttcgcaaaaacgggaagagagtggttcagctgtcccggaaaaccttcgacacggaatatcaaaagaccaagaataatgattgggactacgtggtcaccacagacatctctgagatgggcgccaacttccgcgctgatagagtgattgaccctcggagatgcctgaagcccgttatcctcaaggatggaccggaacgcgtgattctggccggccctatgcccgtcaccgtggccagcgctgcccagcggagagggcgcatcggacggaatcagaacaaagagggcgaccagtacatttatatggggcaaccccttaataacgatgaggaccatgcgcactggacggaagctaagatgctgctcgataatatcaacacccctgagggaattatccccgccctgtttgaacctgagagagaaaaatccgccgctatcgacggcgagtaccgcctgagaggggaagcccggaagacattcgtcgaactcatgcgcagaggcgatcttccggtgtggctgagctataaagttgcgtctgagggatttcagtactccgaccggcgctggtgcttcgatggcgaaagaaataaccaggtgctgctcaagaatatggacgtggagatttggaccaaagaaggggagcggaagaagctgcgccccagatggcttgatgcccggacatatagcgaccctctggctctcagagagtttaaagagttcgccgctggacgccggtccgtctctggcgacctgatcctggagattgggaagctcccccagcaccttacccaaagagcccagaacgctctggataatctggttatgctccataacagcgaacagggaggcaaagcctaccgccacgcgatggaggaactgcctgacacaatcgagacccttatgctgctcgccctgattgctgtgctgacgggcggggtgacactctttttcctttccggacggggcctggggaagacctctatcggactgctctgtgtcatggccagctccgctctgctttggatggccagcgtggagccccattggatcgccgcttctattatcctggaatttttcctcatggttctgctgattccggagcctgatagacagcggacaccccaagacaatcagctcgcgtatgtggtcatcggccttctgtttatgattctgacagtggccgctaacgaaatggggctcctggagaccaccaagaaggatcttggaatcggccacgtcgccgccgagtcccaccatcacgctgccatgctggacgtggatctccatcctgcgagcgcctggacgctgtacgctgttgccaccacaatcattacccccatgatgcgccacacaatcgaaaacaccacggctaatatttctctgaccgccatcgcgaaccaggccgctattctcatgggccttgacaaggggtggcctatctccaaaatggatattggagtgcccctgctggccctcggctgctacagccaagtcaatccgctgacacttaccgctgccgtgctgatgctcgttgctcattatgccatcatcgggcctggactgcaggcgaaggccacaagagaggctcagaaacggaccgccgctggcattatgaagaaccccacggtggacgggatcgtcgccattgatctggaccccgtggtgtacgatgccaaattcgaaaagcagctcggacaaatcatgcttctgattctgtgtacatctcagatcctcctgatgcgcaccacatgggcgctttgcgagagcatcaccctggctaccggccctctcacaacgctgtgggaaggctccccggggaagttttggaataccacaattgccgtttctatggctaacatcttcagaggaagctatctggccggcgccgggctcgctttctcccttatgaaaagcctgggaggcgggcggcgcggaaccggcgcccagggcgagacactgggggagaagtggaaaagacagctcaatcaactgtccaagtctgaatttaacacctacaaacggagcggaattatcgaggtcgaccgctccgaagcgaaggagggccttaagagaggggaaacgacaaaacacgccgtgtctcggggaaccgctaagctgagatggttcgtggagcgcaatctcgtcaaacccgagggcaaggttattgacctggggtgtggacggggcggctggagctattactgcgccgggctgaaaaaggtgaccgaagtgaaaggatatacaaagggcgggcctggacacgaggaacccatccctatggctacctacggctggaacctcgtcaaactttactccgggaaagatgtgtttttcacaccccctgagaagtgtgacacgctgctgtgcgatatcggagaatctagcccgaatcccaccattgaggagggcagaacactccgcgttctgaaaatggtggaaccttggcttcggggcaaccagttttgtatcaaggtcctgaatccctatatgccttccgtggttgagaccctcgaacagatgcagagaaaacatgggggaatgctggtgcgcaaccccctgagcagaaattctacacacgagatgtactgggtctcctgcggcaccgggaacattgtgagcgccgtgaatatgacgtctagaatgctcctgaaccgcttcaccatggcgcatcggaagccgacatatgagagagacgtcgatcttggagccggcacccgcaacgttgctgtggaacctgaggtggccaatctggacatcattgggcaacggatcgaaaacattaagaatgagcacaaatccacatggcactacgatgaagacaacccctataagacctgggcttaccatggaagctatgaggtcaaaccctctggctccgccagctccatggtgaatggcgttgtgagactcctgacaaagccttgggatgtcatccccatggtgacccagatcgctatgacggacacaaccccttttgggcagcaacgcgttttcaaagagaaggtggataccagaacaccgaaggccaaacggggaacggcgcagattatggaagtcaccgcccgctggctttggggctttctgagcagaaacaagaaaccccggatctgtacaagagaggagttcacccggaaggtgcgctctaatgctgccattggggctgtttttatcgacgagaaccagtggaatagcgccaaagaagccgtggaggacgagagattctgggatctcgtccaccgggaacgcgagctgcataagcagggaaagtgcgcgacatgcgtgtacaacatgatgggcaaaagagaaaagaaactgggggagtttggcaaggctaaaggatcccgggccatttggtacatgtggctcggcgcccgcttcctggagttcgaggctcttgggtttatgaatgaggaccactggttctctagagaaaacagcctgtccggagtcgagggcgaagggctccataagctgggatatatccttcgggatatctctaaaattcctggcgggaatatgtacgccgacgataccgctggctgggacacacgcatcaccgaggatgacctgcaaaacgaggccaagattacggatatcatggaacccgagcacgcgctcctggccaccagcatttttaagctgacatatcagaataaagtggttagagtgcagcggcctgctaagaacggaaccgtcatggacgtgatctcccgcagagatcagcggggctctgggcaagtgggaacatacggcctcaacaccttcacgaatatggaagcccagctgatccgccagatggagagcgaagggatttttcttccctccgagctggagacaccgaacctcgctgaaagagttctggactggcttgagaaacacggaatcgaacggctgaagagaatggccattagcggcgatgactgtgtggtcaaacctatcgacgatcgcttcgcgaccgccctcacagctctgaatgacatggggaaggtgcggaaggatattccccagtgggagccttctaaaggctggaacgactggcaacaggttcccttttgctcccatcacttccatcagctgatcatgaaggatggaagagaaatcgtggtcccttgtcgcaatcaggacgagctcgtgggccgggccagagtcagccaaggggctggatggtctctgcgcgagaccgcctgccttggcaaatcctatgctcagatgtggcagctgatgtactttcaccggagagatctccgcctggccgcgaacgccatttgtagcgctgtgcccgttgactgggtgccgacgtcccggaccacatggtctatccacgcccatcaccaatggatgaccacagaagatatgcttagcgtctggaatagagtgtggattgaggaaaacccttggatggaggacaagacccatgtttccagctgggaagatgtgccctatctggggaaacgcgaggaccagtggtgcggatctctcatcggcctgacagcccgggctacctgggccacgaatattcaggtcgcgatcaaccaggtgagacggctgattgggaatgagaactacctcgactacatgacatccatgaagagattcaagaatgaaaacgatcccgagggcgctctgtggtga

SEQ ID NO: 18714 - RNA, 9879 nt, synthetic construct
  misc_feature 1..9879: note = derived and/or modified CDS sequence (opt5) from DENV-1__KF921911__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcattaacatgtgcaccctgatcgccatggacctcggggagctgtgtgaagatacaatgacctacaaatgccccagaattacagaggcggaacccgacgatgtggactgttggtgcaatgctaccgatacgtgggtgacctatggaacatgttcccaaaccggcgagcacagacgggacaagcgctctgtcgccctggcccctcatgtggggctcggactggagacaagaaccgaaacgtggatgagctccgagggcgcttggaaacagatccagaaggttgaaacatgggcccttcggcaccccggcttcaccgtgacagctctgtttctcgcccatgcgattgggacctctatcacccagaagggaatcattttcatcctgcttatgctggtcacacctagcatggccatgcgctgcgtgggcattgggaacagagattttgttgagggactctccggcgctacgtgggtggacgtcgtgctggagcacgggagctgtgtgaccacaatggccaaagataagcccaccctggacatcgaactcctgaaaacagaggtcaccaatcctgctgttcttcggaagctgtgcattgaagccaaaatctctaacacgacaaccgattcccgctgtccgacccaaggagaggcgacactcgtggaggaacaggacagcaatttcgtgtgcagacggacctttgtcgatcgcggctggggcaacgggtgtggactgttcggcaaggggtctcttctgacatgcgccaagtttaaatgcgtgacgaagctcgagggaaaaattgttcagtacgaaaatctgaagtattccgtgatcgtcaccgtgcacacaggcgaccagcatcaagttgggaacgagaccacagaacacggaaccatcgctacgattacaccccaggcccctacaagcgagatccagctgaccgactacggcgctctcacactggattgttctcccagaaccggccttgacttcaatgaaatggtgctgctcacgatgaaagagaagtcctggctggtccataaacagtggtttcttgatctgcctctcccctggacaagcggggcctccacctctcaagagacatggaaccggcaggacctgctggtgaccttcaagaccgcccacgctaagaaacaggaagtcgtggttctcggaagccaagagggcgcgatgcacacagccctgacgggggctaccgaaattcagacatccggaaccacaaccatctttgccggccatcttaagtgccgcctgaaaatggataagctcacgctgaaagggatgagctatgtgatgtgtacaggctctttcaagctggagaaggaagtcgccgagacccagcacggaaccgtgcttgttcaggtgaaatacgagggcacagacgctccgtgcaagattcctttctccgcccaagatgaaaaaggggtcacccagaatggaagactcatcacagcgaaccccatcgtgacggacaaggagaaacctgtgaatattgaaaccgagccgccctttggcgagagctatatcgttattggggctggagaaaaggccctgaagctgtcttggttcaaaaagggcagctccatcgggaaaatgtttgaggccacagctcggggcgccagacgcatggctattctcggagataccgcctgggacttcggctctatcgggggagtctttacaagcgtgggcaagctggtgcatcaggtcttcggggcggcctacggagtgctcttttccggcgttagctggaccatgaaaatcgggattggcatcctgctcacgtggctgggactgaactctcggtccaccagcctttctatgacatgtattgctgtgggcatggtcaccctctacctgggggtgatggttcaggccgattccggatgcgtgatcaattggaagggcagagaactgaagtgtgggagcggaattttcgtcacaaacgaggtgcacacctggacagaacaatataaatttcaggctgactcccctaagcgcctctctgccgcgatcggcaaagcctgggaggagggggtttgcggcattcggagcgctaccagactggaaaacatcatgtggaagcagatctccaatgagcttaaccatattctgctcgaaaatgacatgaaattcacggtggtcgtgggagatgccaacggcatcctggctcaggggaagaaaatgattcgcccgcaacccatggagcaccggtactcttggaaaagctggggaaaggccaagatcattggcgccgacatccagaatacaacctttatcattgatgggcctgacacccccgaatgtcctgatgaccagagagcttggaacatctgggaggtggaggattatggattcggcatttttacaaccaatatctggctgaaacttcgcgactcctacacgcagatgtgcgatcaccggctcatgagcgcggccattaaagactctaaggctgtccatgccgatatgggctattggatcgaatccgagaaaaacgaaacatggaagctggccagagctagcttcatcgaggttaagacctgtatttggcccaaatctcacacactgtggtccaatggggtgctcgaaagcgagatgatcattccgaagatctacggaggccctatttctcaacataactatcgccccgggtacttcacccagacagccggaccttggcacctgggcaaacttgagctggactttgatctctgcgaagggaccacggtggtcgtggacgagcactgcggaaatcggggccccagcctgagaaccacaaccgttacaggcaagatcatccatgaatggtgttgccggtcctgtaccctgcctccccttcgcttcagaggggaggacggatgctggtacggcatggagattcggccggtgaaagaaaaggaggaaaacctcgtcagaagcatggtgtctgcggggtccggagaggttgatagcttttccctgggcatcctgtgtgtgtctattatgatcgaagaggtcatgcgcagccggtggaatagaaagatgctcatgacggggacactggctgtgttccttctgctcattatgggacagctgacctggaacgacctgatccgcctttgcattatggttggcgccaatgcctccgatagaatgggcatggggacaacctatctggctctcatggccacctttaaaatgcggcctatgttcgcggtgggactgctctttcgcagactgacatctcgggaggtccttctgctcacgatcggcctgagcctggtggcttccgtggaacttcccaactctctggaggaactcggggacggactggccatgggcatcatgatgctcaagctgcttaccgagttccaaccccaccagctgtggacaaccctcctgagcctgacatttattaaaaccacgctttccctggattacgcctggcgcacaatggctatggtcctcagcatcgtttctctgttccctctctgtctgtccaccaccagccagaagacaacctggcttccggtgctgctggggtcttttggatgcaaacccctcacaatgttcctgattacggaaaacaagatctggggcagaaagtcctggcctcttaatgagggcattatggccatcgggatcgtgagcattctgctctcttccctgctcaaaaacgacgtccccctggctggacctcttatcgccggcgggatgctgattgcgtgttatgtgatcagcggatccagcgccgatctgtctctcgagaaggctgccgaagttagctgggaggaagaggctgaacattccggcacctctcacaatattctggtggaggtccaggacgatgggacaatgaaaatcaaggacgaggaacgggatgacacccttacaatcctgctcaaagccaccctgctcgccgtgagcggagtttaccccatgtccattcctgctacgctgtttgtgtggtatttctggcaaaagaaaaagcagcgctctggcgtcctttgggatacccccagcccgcctgaggtggaaagagcggtcctggacgacggcatctaccggattctgcagcgcgggctcctgggaagatcccaggtgggcgttggggtgttccaagatggagtctttcatacaatgtggcacgtgacccggggcgccgttcttatgtatcaggggaagagactggagccctcttgggctagcgtgaaaaaggacctcatctcctacggaggcggctggcgcttccaggggagctggaacacaggagaggaagtccaggtgattgccgtggagcctggcaaaaatcccaagaacgttcaaaccacaccggggacgtttaaaacccctgaaggagaggtcggcgccatcgctctggatttcaagcccgggacatctggatcccctattgtgaatcgggaaggcaagatcgtgagcctctacggcaacggggtcgtgaccacctctggaacatatgtttccgccatcgcgcaggctaaaacgagccaggagggccccctgcccgagattgaagacgaggtgtttaagaaaagaaatcttaccatcatggatctgcaccctgggtccggaaagacacgccggtacctgccggccattgtcagagaagccatcaaacgcaagctccggaccctgattcttgctcccacaagagtggttgcctctgagatggcggaagctctgaagggcatgcctatccgctatcaaaccacggccgtgaaaagcgagcatacagggcgggagatcgtcgacctcatgtgccacgccaccttcaccatgagactgctgtcccccgtgcgggttcctaactacaatatgattatcatggatgaagctcattttacagaccccgccagcattgctgcccgcggctatatctctaccagagtgggaatgggcgaggcggccgctattttcatgacagccacccctccggggtccgtcgaggcttttccccagagcaacgccgtgatccaggatgaggaacgggacatccctgagcgctcttggaatagcggatacgattggattacggacttccccggcaagacagtgtggtttgtcccttccatcaaatctgggaacgacattgccaattgtctcagaaagaacggaaaacgggttatccagcttagcagaaagaccttcgatacagagtatcaaaagaccaaaaacaatgactgggattacgtggtgacgaccgacatttccgaaatgggcgctaacttccgcgcggatcgggtcatcgaccccagacgctgcctgaagccggtgattctgaaagatgggcctgagcgggttatcctcgccggccccatgcccgtgacagtcgcttctgccgcccagagacgcggacggatcggcagaaatcagaacaaggaaggggaccagtacgtgtatatgggacaacctctgaataacgatgaggaccacgctcattggaccgaggccaaaatgcttctggataatattaacacacccgaaggcatcattcctgcgctctttgagccggaacgcgaaaagagcgctgccatcgacggggaatacagactgcggggagaggcccgcaagaccttcgttgagctgatgagacggggcgatctccccgtgtggctttcctataaagtcgctagcgaagggtttcagtactctgaccgcagatggtgcttcgacggcgagcggaataaccaggtgctggaagagaatatggatgtcgaaatttggacaaaggagggagagcgcaagaagctgcgccctcggtggctcgacgccagaacctattccgatcccctggcgcttcgcgaatttaaagagttcgccgctggccggagaagcgtgtccggggacctgatcctcgaaatcggaaagctgcctcagcacctgacgctccgggcccaaaacgctcttgataatctggttatgctgcacaactctgagcagggcgggaaagcctaccgccatgctatggaagaacttcccgacacaattgagaccctgatgcttctggccctcatcgcggtgctgaccggaggcgtgacactgtttttcctcagcggcaaggggcttggaaagacctccattggcctgctgtgtgtcatggcctctagcgctctcctgtggatggccaatgttgaaccgcactggatcgctgcctccattatccttgagtttttcctgatggtgctcctgatccctgaacccgatagacagcggacacctcaggacaaccaactggcctatgtggtcattgggctcctttttatgatcctgacggtggctgcgaacgagatgggactgctcgagaccaccaagaaggatctgggcattgggcatgttgccgctgaaaatcagcaccacgccaccatgcttgacgtggatctgcgccccgccagcgcttggacactctacgccgtcgcgaccacggtgatcacccctatgatgagacatacaattgagaacaccacagccaatatctctctgaccgctattgccaaccaggctgccatcctgatgggactcgacaaaggctggcccatctccaagatggatattggcgtcccgcttctggcgctggggtgctacagccaagtgaatcctctcacgctgacagccgctgttcttatgctggtggcccactatgctatcattggacccggcctccaggccaaagctacccgggaagcccagaagcgcacagcggccgggatcatgaagaaccccaccgtcgacggaattgtggctatcgacctggatcctgttgtgtacgacgccaaattcgagaagcagctgggccaaatcatgctccttattctgtgtacctctcagatcctgctcatgagaacaacgtgggctctgtgcgaatccattacccttgccacagggccgctgaccacactctgggagggaagccccggcaaattttggaataccacgatcgccgtctctatggcgaacattttccggggcagctatctggctggggccggactggctttctccctcatgaagtctcttggcgggggacgcagaggcacaggggcccagggagagaccctgggcgaaaaatggaagcggcagctgaatcaactcagcaagtccgagtttaacacctacaaaagaagcggcatcatggaagtggatcgctccgaggccaaggaagggctgaaacggggagagacaaccaagcatgctgtgtctagaggcacagccaaacttcgctggttcgttgagcggaatctggtcaagcctgaagggaaggtgatcgacctcggatgtggcagagggggatggagctattactgcgcgggcctgaaaaaggtgacggaggtcaaaggctataccaaagggggacccggccacgaggagcctattcccatggccacatacgggtggaacctggttaaactctactccggaaaggatgtgtttttcacccctccggaaaaatgtgacacacttctgtgcgatatcggcgagtctagccccaatcctaccattgaggaagggcgcacgctgcgggtgctcaagatggtcgagccctggctgagaggaaaccagttttgtatcaagattcttaatccttatatgccctccgtggttgaaaccctggagcagatgcagcgcaaacatggcggcatgctcgtgcggaacccgctgtctagaaatagcacacacgagatgtactgggtctcctgcgggaccggaaacatcgtgagcgctgttaacatgacatctcgcatgctgctcaatcggttcaccatggcccacagaaagcctacatatgaacgcgacgtggatctgggcgctgggaccagacatgtcgccgtggagcccgaagtggcgaaccttgacattatcggacaacggatcgagaatattaaaaacgaacacaagtccacgtggcattacgatgaggacaatccctataaaacatgggcctaccacggcagctatgaggtcaagccttctgggtccgctagctctatggttaacggagtggtgcgcctgctcaccaagccctgggacgtcatccctatggtgacccagattgccatgacagatacgaccccgtttggccagcaaagagttttcaaagaaaaggtggacacacggacccccagagctaaacggggcacagcccagatcatggaggtcaccgctaagtggctgtgggggtttctttcccgcaataaaaagcctagaatttgtacacgggaagagttcacccgcaaggtgagaagcaacgccgcgatcggagccgtttttgtggatgaaaatcagtggaactccgctaaagaggccgtcgaggacgaacggttctgggatctggtgtaccgcgagagagaactccacaagcagggcaaatgcgctacgtgcgtttacaatatgatggggaagcgggagaaaaagctgggagaatttggcaaggccaaagggagccgcgccatctggtatatgtggctgggcgcgagattcctcgagttcgaggctctgggatttatgaacgaagaccattggttctctcgggagaatagcttttccggcgtggaaggggagggacttcacaagctgggctacattctccgcgatatctctaaaattcccgggggaaacatgtatgccgacgataccgccggctgggacacaagaatcaccgaggatgacctgcaaaatgaagctaagattacagatatcatggagcctgaacatgcccttctggctaccagcatcttcaaactcacgtaccagaacaaggtcgtgcgggtccagcgccccgccaaaaacgggacagtgatggacgttatttccagacgggaccagagaggctctggacaagtgggcacctatgggctgaatacatttaccaacatggaggtccagctgatccgccagatggaaagcgagggaattttcctcccgtccgagctggaaacgcctaatcttgcggagcgggtgctggattggctcgaaaagcacggcaccgagagactgaagcgcatggccatctctggggacgattgtgtggttaaacccgtggacgatcggtttgctacagcccttattgctctgaacgacatgggaaaggtcagaaaagatatccctcagtgggaacccagcaagggctggaatgactggcaacaggtgcctttctgctcccatcactttcaccagctcatcatgaaagatgggcgcgagattgttgtgccctgtcggaaccaggacgagctggtcggcagagcccgcgtgagccaaggagcgggctggtctctgcgggaaaccgcctgcctcgggaagtcctacgctcagatgtggcagctgatgtatttccatagacgcgatcttcggctggccgctaatgccatctgtagcgctgtcccggtggactgggttcctacatctagaaccacatggtccattcacgcccatcaccaatggatgaccacggaggacatgctcagcgtgtggaaccgggtctggatcgaagagaatccctggatggaagataagacacacgtgtcctcttgggaggaggttccctacctgggaaaaagagaagaccagtggtgcggcagccttattgggctgaccgcgcgcgccacctgggctacaaacatccaggtggccattaatcaggtccggagactcatcggaaacgagaattacctggattatatgacctccatgaagcgctttaaaaacgaaagcgaccctgagggcgccctgtggtga

SEQ ID NO: 18715 - RNA, 9879 nt, synthetic construct
  misc_feature 1..9879: note = derived and/or modified CDS sequence (opt5) from DENV-1__KJ189350__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaacggcgagcacagacgggagaagcgctctgtcgccctggctcctcatgtggggctcggactggaaaccagaacagagacctggatgagctccgaaggcgcctggaaacagattcagcgggttgagacgtgggctcttagacaccccggcttcacagtgatcgcctttttcctggcgcatgccattgggacctctatcacacagaagggaatcatttttatcctcctgatgcttgtcacccctagcatggctatgagatgcgtgggcattgggaatcgggacttcgttgagggactgtccggcgccacctgggtggatgtcgtgctcgaacacgggagctgtgtgacaacgatggctaagaacaaacccaccctggacatcgagctgctcaagacagaagtcaccaatcctgccgttctgcgcaaactttgcattgaggcgaagatctctaacacaaccacggattccagatgtccgacacaaggagaagccaccctggtggaggagcaggacgctaattttgtgtgccggcgcaccttcgtcgatagaggctggggcaacgggtgtggactctttggcaaagggagcctgcttacatgcgccaagttcaagtgcgtgaccaaactggaaggaaagattgttcagtacgagaatctcaaatattctgtgatcgtcacagtgcacacgggcgaccagcatcaagttgggaacgaaaccacagagcacggaaccatcgctacaattacaccccaggcccctacgtccgaaatccagctgaccgattacggcgccctgacactcgactgtagcccccggaccggcctggactttaatgagatggtgcttctgacaatgaaggagaaatcttggctcgtccataagcagtggttcctggatcttcctctgccctggacctccggggctagcacgtcccaagaaacatggaaccgccaggacctcctggtgacctttaaaacagcgcacgccaagaagcaggaggtcgtggttctgggatctcaagaaggcgctatgcacaccgccctcaccggggccacagagattcagacgagcggaaccacaaccatcttcgctggccatctgaaatgcagacttaagatggataaactgacactcaaggggatgtcctatgtgatgtgtaccggcagcttcaaactggaaaaggaggtcgccgagacgcagcacggaacagtgctggttcaggtgaagtacgaaggcaccgacgcgccgtgcaaaattcctttttctacccaagatgagaagggggtcacacagaatggacggcttatcaccgctaaccccatcgtgacagacaaagaaaagcctgtgaatattgagacggagccgcccttcggcgaatcctatatcgttgtcggggccggagagaaagccctcaagctgagctggtttaagagaggctctagcattgggaaaatgttcgaagctaccgcccgcggcgctcggagaatggccatcctgggagatacagcgtgggactttggctccattgggggagtgttcacctctgtgggcaagctcgtccatcagatctttgggacagcctacggagtgctgttcagcggcgtttcctggaccatgaaaatcgggattggcatccttctgacgtggctcggactgaacagccgctctacctccctgagcatgacatgtattgctgtgggcatggtcaccctttacctcggggtgatggttcaggccgattctggatgcgtgatcaactggaagggccgggagctgaaatgtgggtccggaatttttgtcacaaatgaagtgcacacctggacagagcaatataagttccaggctgacagccctaagagactgtccgccgcgatcggcaaagcctgggaggaaggggtttgcggcattcgctctgctacccggctcgagaacatcatgtggaagcagatcagcaatgaactgaaccatattcttctggagaatgatatgaaatttacggtggtcgtgggagacgccaacggcatcctcgctcaggggaagaaaatgattagaccgcaacccatggaacacaagtactcctggaaatcttggggaaaggccaagatcattggcgccgacatccagaatacaaccttcatcattgatgggcctgacacccccgagtgtcctgatggacagcgcgcttggaacatctgggaggtggaagactatggctttggcgtcttcacaaccaatatttggctgaaactgcgggatagctacacgcagatgtgcgaccacagacttatgtccgcggccatcaaggatagcaaagctgttcatgccgacatggggtattggattgagtctgaaaagaacgagacatggaaactcgcccgcgcttccttcatcgaagtgaagacctgtacatggcccaagagccacaccctgtggtctaatggagtgctggagtccgagatgatcattccgaaaatctacggcgggcctattagccaacataactatcggcccggatactttacacagaccgccggcccttggcacctcgggaagctggaacttgatttcgacctgtgcgagggaacgaccgtcgtggttgatgaacactgcggcaatagaggcccctctctccggacaaccacagtgaccgggaaaatcattcatgagtggtgttgccgcagctgtacgctgcctcccctgagatttcggggagaggacggctgctggtacgggatggaaatcagaccggtcaaggagaaagaagagaaccttgtgcgctccatggttagcgcgggatctggcgaagtggattccttcagcctcgggatcctgtgtgtctccattatgatcgaggaggtgatgcggtctagatggagccgcaagatgctgatgacaggaaccctcgctgtttttctgcttctgattatgggccagctcacatggaatgacctgatcagactgtgcattatggtgggcgccaacgcctccgaccggatggggatgggaaccacctatcttgctctgatggccacattcaagatgcgccctatgtttgcggtcggcctcctgttcagacggctcacgtctcgcgaagtgctgcttctgaccatcgggctcagcctggtggcttccgtcgagctgcccaactctcttgaggaactgggagatggcctcgccatggggattatgatgctgaaactcctgacagaatttcaaccccaccagctttggaccacactgctcagcctgaccttcgttaagacgacactgtcccttgactacgcctggaaaaccaccgctatggccctgagcatcgtgtctctctttcctctgtgtctctccacaaccagccagaagacaacgtggctgccggtgcttctgggatctttcggctgcaaacccctgaccatgtttctcatcacagagaataagatttggggcagaaagtcctggcctctgaacgaggggatcatggctattggaatcgtcagcattcttctgtcttccctcctgaaaaatgatgtgcccctcgccggccctctgatcgccgggggaatgcttatcgcctgttatgttattagcggctccagcgctgacctgtctctggaaaaggccgctgaggtgagctgggaacaggaggccgaacattccggggcctctcacagcatcctcgtcgaggtgcaagatgacggaaccatgaaaattaaggatgaggaacgggacgatacactgaccatccttctgaaagctacgctcctggcggtttccggcgtgtaccccatgtctattcctgccaccctcttcgtctggtatttctggcagaagaaaaagcagcgcagcggcgtgctgtgggacacaccctccccgcctgaggtcgaaagagctgtgcttgataacgggatctaccggatcctgcagcgcggactgctcggcagatctcaagttggggtgggagtctttcaggacggcgtgttccataccatgtggcacgttacaagaggggcggtgctgatgtatcagggaaagcggcttgagcccagctgggcctccgtcaaaaaggatctgattagctacggcggcgggtggcgctttcagggatcttggaataccggcgaggaagtgcaagtgatcgctgttgagcctgggaaaaaccccaagaatgtccagacaacgccgggaaccttcaaaacacctgaaggcgaggtgggggccattgcgctcgactttaagcccggaacctccggcagccctatcgtgaaccgggaaggcaagattgtcgggctgtacggaaatggcgtggttaccacatctgggacgtatgtgtccgctatcgcccaggccaaagctagccaagagggacccctccccgagattgaagacgaggtcttcaagaaaagaaacctgaccatcatggatcttcaccctggctccgggaagacacgccggtacctgccggccatcgtgagagaagcgattaaacgcaagctgcggaccctcatcctggctcccacaagagttgtggcctctgagatggccgaagctcttaagggcatgcctattcgctatcagaccacggccgtcaaaagcgagcatacaggacgggagatcgtggacctgatgtgccacgctacctttaccatgagactcctgtcccccgttcgggtgcctaattacaacatgattatcatggatgaagcccatttcacagaccccgcgagcatcgccgctcgcggctatatttctaccagagtcgggatgggagaggccgctgccatctttatgacagccacccctccgggctccgtggaggctttcccccagagcaatgcggtgattcaggatgaggaacgggacatccctgagcgctcttggaacagcgggtacgattggattacggactttcccggaaagacagtctggttcgttccttccatcaaatctggcaatgatatcgccaactgtctgagaaagaacgggaaacgggtgattcaactcagcagaaagaccttcgacacagagtatcagaagaccaaaaataacgattgggactacgtggtcacgaccgacatctccgaaatgggcgctaattttcgcgccgatcgggtgattgaccccagacgctgccttaagccggttatcctgaaagatggacctgagcgggtgattctggccggccccatgcccgtcacagctgcctctgcggctcagagacgcgggcggatcggaagaaaccagaataaggaaggcgaccaatacgtgtatatggggcagcctctcaacaatgatgaggaccacgcccattggaccgaggccaaaatgctgcttgataacattaatacacccgaaggaatcatccctgctctgttcgagccggaacgcgaaaagagcgccgcgattgacggcgaatacagactcagaggggaagcccgcaagacctttgttgagctgatgagacggggcgatctgcccgtgtggctctcctataaagtcgctagcgaaggattccagtactctgaccgcagatggtgctttgatggcgagcggaacaatcaggtgcttgaagagaacatggacgtcgaaatctggacaaaggagggggagcgcaagaagctgcgccctcggtggctggatgccagaacctattccgaccccctcgctctgcgcgagttcaaagagtttgccgctggacggagaagcgtgtccggcgaccttattctggaaatcgggaagctccctcaacacctgacgctgcgggcccagaatgcgctcgataaccttgttatgctgcacaattctgagcagggaggcaaagcctaccgccatgctatggaggaactgcccgacacaattgagaccctcatgctgcttgccctgatcgctgtgctcaccggcggggtgacactgttctttctgagcggaaagggcctcgggaagacctccatcggacttctgtgtgtcacagcctctagcgccctgctctggatggcttccgttgaaccgcactggattgcggccagcatcattctggagttctttcttatggtgctgctcatccctgaacccgatagacagcggacgcctcaagacaaccagctggcttatgtggtcattggcctcctgttcatgatccttaccgtggccgccaacgagatggggctgctggagacaaccaaaaaggatctcggaatcggctacgttgctgccgaaaatcatcagcacgcgacaatgctggacgtggatcttcaccccgcctctgcttggaccctgtacgccgtcgctacgaccgtgattacacctatgatgcgccataccatcgagaacacaaccgccaatatttccctcacggcgatcgccaaccaagctgccattctgatgggcctggacaaagggtggcccatcagcaagatggatattggagtcccgctccttgctctgggctgctattctcaggtgaatcctctgacactcaccgccgctgttctgatgcttgtggcccactacgcgatcatcgggcccggactgcaggccaaagctacaagagaagcccagaagcggaccgctgccggcattatgaagaaccccaccgtcgacgggatcgtggccattgatctcgaccctgttgtgtatgatgcgaaatttgagaagcaactgggacagatcatgctgctcattctttgtacatcccagatcctgctgatgcgcacgacctgggctctctgcgaaagcatcacactggccaccggcccgcttacaaccctgtgggagggctctcccgggaaattctggaatacgacaattgctgtcagcatggccaacatcttcagaggatcctacctcgccggcgctgggctggccttttctctgatgaaaagcctcggaggcgggcggcgcggaaccggcgcgcagggcgagacccttggggaaaaatggaagagacaactgaatcagctgtccaagagcgagttcaacacatataaacggtccggaattatggaagtggacagatctgaggccaaggaaggcctcaaacgcggggagaccacaaagcatgctgtgagccggggaacggccaaactgagatggtttgttgagcgcaatcttgtcaagcctgaaggcaaggtgatcgacctggggtgtggacggggcggctggtcctactattgcgctgggctcaaaaaggtgaccgaggtcaaaggatacacaaagggcgggcccggacacgaggaacctattcccatggccacctacggctggaacctggttaaactgcattctgggaaggatgtgttctttatgcctccggaaaaatgtgacacactcctttgcgatatcggagagagctcccccaatcctaccatcgaggaaggcagaacgctgcgcgtgctgaagatggtcgagccctggctccggggcaaccagttctgtattaagatcctgaatccttatatgccctctgtggttgaaacccttgagagaatgcagcgcaaacacgggggaatgctggtgcggaacccgctcagcagaaattccacacacgagatgtactgggtcagctgcggcaccgggaacattgtgtctgcggttaacatgacatcccgcatgctgctgaatcggtttaccatggcccatagaaagcctacatatgaacgcgacgtggatctcggagctggcaccagacacgtcgccgtggagcccgaagtggctaacctggacatcattgggcaacggatcgagaatattaaaaacgaacataagagcacgtggcactacgatgaggacaatccctataaaacatgggcctaccacggatcttatgaggtcaagccttccggcagcgcttcttccatggttaacggcgtggtgcgccttctgaccaagccctgggatgtcatccctatggtgacccagatcgccatgacagacacgaccccgttcgggcagcaaagagtttttaaagaaaaggtggatacacggacccccagagcgaaacggggaacaacccagattatggaggtcacagccaagtggctctggggcttcctgagccgcaataaaaagcctagaatctgtacccgggaagagtttacgcgcaaggtgagatccaacgctgccattggggctgttttcgtggacgaaaatcagtggaacagcgccaaagaggccgtcgaggacgaacggttttgggatcttgtgcatcgcgagagagaactgcacaagcagggaaaatgcgcgacctgcgtttacaatatgatgggcaagcgggagaaaaagctcggggagttcggcaaggctaaaggatctcgcgccatctggtacatgtggctgggcgccagattcctggagtttgaggctctcgggttcatgaacgaagaccattggtttagccgggaaaattccctgtctggagtggaaggcgaggggcttcacaagctgggatatattctccgcgatatcagcaaaatccccggcgggaacatgtacgccgacgatacagctggctgggacaccagagtcacagaggatgacctgcaaaatgaagccaagattaccgatatcatggagcctgaacatgcgcttctggccacgtccattttcaaactcacatatcagaacaaggtggtccgggtgcagcgccccgctaaaaacggaaccgttatggacgtgatctctagacgggatcagagaggcagcgggcaagtcggaacatacggcctgaatacctttacgaacatggaggtgcagctgattcgccagatggaatccgaggggatcttcctcccgtctgagctggaaacccctaatcttgccgagcgggctctggactggctcgaaaagcacggagccgagagactgaagcgcatggcgatcagcggcgatgactgtgtggttaaacccattgacgatcggtttgccacagctcttaccgccctgaacgacatggggaaggtgagaaaagatatccctcagtgggaaccctccaagggctggaatgactggcaacaggtccctttctgcagccaccattttcaccagctcattatgaaagatggacgcgagatcgtggttccctgtcggaaccaggacgagctggtgggcagagctcgcgtctctcaaggggccggatggtccctgcgggaaacagcttgcctcggcaagagctatgcccagatgtggcagctgatgtacttccatagacgcgatcttcggctggcggccaatgctatttgttctgccgtgccggtcgactgggtgcctacctccagaacaacctggagcatccacgcccaccatcaatggatgacgacagaggatatgctctccgtttggaaccgggtgtggatcgaagagaatccctggatggaaaacaagacccacgtctctagctgggaggaggtgccctatctggggaaaagagaagaccagtggtgcggatcccttattggcctgaccgctcgcgccacatgggcgaccaatatccaggttgctattaaccaggtgcggagactcatcgggaatgagaactacctggattacatgacaagcatgaagcgctttaaaaatgaatctgactccgagggcgccctgtggtga

SEQ ID NO: 18716 - RNA, 9879 nt, synthetic construct
  misc_feature 1..9879: note = derived and/or modified CDS sequence (opt5) from DENV-1__KJ189351__SS-prME
  source 1..9879: mol_type = other RNA
agcgtgaccatgctgctcatgctgcttcccacagtcctggccttccacctcacgaccagaggcggggagcctcatatgatcgtttccaagcaggaacggggaaaatctctgctttttaagacaagcgctggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggagaagcgctctgtggccctggcccctcatgttgggctcggactggaaacaagaaccgagacgtggatgagctccgaaggcgcttggaaacagattcagcgggtggagacatgggcccttcgccaccccggcttcaccgtcatcgcttttttcctggcccatgcgattgggacatctatcacccagaagggaatcatttttatcctcctgatgcttgtgacccctagcatggccatgagatgcgttggcattgggaaccgggacttcgtggagggactgtccggcgctacatgggtcgatgtggtgctcgaacacgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgccgggggcctccacaagccaagaaacctggaatcgccaggacctcctggtcacatttaaaaccgctcacgcgaagaagcaggaggtggttgtgctgggatcccaagaaggcgccatgcacaccgctctcacaggggccacggagattcagacctctggaacaaccacaatcttcgccggccatctgaaatgcagacttaagatggataaactgaccctcaaggggatgagctatgtcatgtgtacgggctccttcaaactggaaaaggaggtggctgagacacagcacggaaccgttctggtgcaggtcaagtacgaaggcaccgacgccccttgcaaaattccctttagcacacaagatgagaagggggtgacccagaacggacggcttatcacagcgaatcctatcgtgacggacaaagaaaagcccgttaacattgagaccgagccccctttcggcgaatcttatatcgtcgtgggggctggagagaaagccctcaagctgtcctggtttaagagaggcagctctattgggaaaatgttcgaagccacagctcgcggcgcccggagaatggctatcctgggagataccgcctgggactttggcagcattgggggagtgttcacatccgtcggcaagctcgtgcatcaggtttttgggaccgcgtacggagtgctgttctctggcgtcagctggacgatgaaaatcgggatcggcattcttctgacctggctcggactgaattcccgcagcacatctctgtccatgacctgtatcgccgtgggcatggttacactttacctcggggtgatggtccaggctgatagcggatgcgtgattaactggaagggccgggagctgaaatgtgggtctggaatctttgttaccaacgaagtgcacacatggaccgagcaatataagttccaggccgactccccgaagagactgagcgctgccattggcaaagcgtgggaggaaggggtctgcggcatccgctccgccacgcggctcgagaatattatgtggaagcagatctctaacgaactgaatcatatccttctggagaacgatatgaaatttacagtggtggtcggagacgctaatggcattctcgcccaggggaagaaaatgatcagaccccaacctatggaacacaagtacagctggaaatcctggggaaaggctaagattatcggcgccgacattcagaacaccaccttcatcatcgatgggcccgacacacctgagtgtcccgatggacagcgcgcctggaatatttgggaggttgaagactatggctttggcgtgttcaccacgaacatctggctgaaactgcgggattcttacacacagatgtgcgaccacagacttatgagcgctgcgattaaggattccaaagccgtgcatgctgacatggggtattggatcgagagcgaaaagaatgagacctggaaactcgcccgcgcctctttcattgaagtcaagacatgtacctggccgaagtcccacacactgtggagcaacggagtgctggagtctgagatgatcatccctaaaatttacggcgggcccatctcccaacataattatcggcctggatactttacccagacggctggcccctggcacctcgggaagctggaacttgatttcgacctgtgcgagggaaccacagttgtggtcgatgaacactgcggcaacagaggccctagcctccggaccacaaccgtgacggggaaaattatccatgagtggtgttgccgctcttgtacactgcccccgctgagatttcggggagaggacggctgctggtacgggatggaaattagacctgttaaggagaaagaagagaatcttgtgcgcagcatggtctccgccggaagcggcgaagtggattctttctccctcgggatcctgtgtgttagcatcatgattgaggaggtgatgcggtccagatggtctcgcaagatgctgatgaccggaacactcgcggtctttctgcttctgatcatgggccagctcacctggaacgacctgaccagactgtgcattatggtgggcgctaatgccagcgaccggatggggatgggaacaacgtatcttgccctgatggctaccttcaagatgcgccccatgtttgccgtgggcctcctgttcagacggctcacatcccgcgaagtcctgcttctgaccatcgggctctctctggttgcgagcgtggagctgcccaactcccttgaagagctgggagatggcctcgctatggggattatgatgctgaaactcctgacagaatttcaacctcaccagctttggaccacgctgctctctctgacattcgtgaagaccaccctgagccttgactacgcctggaaaacaaccgccatggctctgtccatcgtcagcctctttccgctgtgtctctctacaacgtcccagaagaccacatggctgcccgtgcttctgggaagcttcggctgcaaacctctgaccatgtttctcattgccgagaacagaatctggggccggaagtcttggcccctgaatgaggggatcatggctattggaatcgtttccattcttctgagctctctcctgaagaacgatgtgcctctcgccggccccctgatcgcggggggaatgcttattgcctgttatgtcatctccggcagctccgctgacctgagcctggaaaaagccgctgaggtgtcttgggaacaggaggccgaacatagcggggcctcccactctatcctcgttgaggtgcaagatgacggaacaatgaagattaaagatgaggaacgcgacgataccctgacgatccttctgaaggctaccctcctggcggtcagcggcgtgtaccctatgtccattcccgccacactcttcgtctggtatttctggcagaaaaagaaacagagatctggcgtgctgtgggacaccccgagccctcccgaggttgaacgggctgtgcttgataatgggatctaccgcattctgcagagaggactgctcggccggtcccaagtcggggtgggagtttttcaggacggcgtgttccatacaatgtggcacgtcaccagaggggccgtgctgatgtatcagggaaagcgccttgagccttcttgggccagcgtgaagaaagatctgatctcctacggcggcgggtggcggtttcagggaagctggaacacaggcgaggaagttcaagtcatcgctgtggagcccgggaagaatccgaaaaacgtgcagacgacccctggaacattcaagacccccgaaggcgaggtcggggccattgcgctcgactttaaacctggaacctctggctcccccatcgtgaatagagaaggcaagattgttgggctgtacggaaacggcgtggtcacaacgagcgggacctatgtgtctgctatcgcccaggccaaggcttcccaagagggacccctccctgagattgaagacgaggttttcaaaaagcgcaatctgacaatcatggatcttcacccgggcagcgggaaaacccggagatacctgcccgccattgtgcgcgaagcgatcaagcggaaactgagaacactcatcctggctcctacccgcgtcgtggcctccgagatggccgaagctcttaagggcatgcccattcggtatcagacgacagccgttaagtctgagcataccggaagagagatcgtggacctgatgtgccacgctacctttacaatgcggctcctgagccctgtccgcgtgcccaactacaatatgattatcatggatgaagcccatttcaccgaccctgcgtccattgccgctagaggctatatcagcacacgggtggggatgggagaggccgctgccatctttatgaccgccacgccgcccggctctgtcgaagctttccctcagtccaacgcggttattcaggatgaggaacgcgacatccccgagagaagctggaattctgggtacgattggattacagactttcctggaaaaaccgtgtggttcgtgcccagcatcaagtccggcaacgatattgccaattgtctgcggaaaaacgggaagagagtcatccaactctctcgcaaaacattcgacaccgagtatcagaagacgaagaacaatgattgggactacgtggttaccacagacatcagcgaaatgggcgctaactttcgggccgatagagtgattgacccgcgccggtgccttaaacctgtcatcctgaaggatggacccgagagagtgattctggccggccccatgcctgttaccgtggcttccgccgcgcagcgccgggggagaatcggacgcaatcagaacaaagaaggcgaccaatacgtctatatggggcagcccctcaataacgatgaggaccacgctcattggacagaggccaagatgctgcttgataatattaacacccctgaaggaatcattccggccctgttcgagcccgaaagagagaaatctgctgccatcgacggcgaataccggctccgcggggaggcgagaaagacatttgtggagctgatgcggcgcggcgatctgcctgtctggctcagctataaggtggcctccgaaggattccagtacagcgacagacggtggtgctttgatggcgagagaaataaccaggttcttgaagagaatatggacgtggaaatctggaccaaagagggggagcgcaagaaactgcggcccagatggctggatgctcgcacgtattctgaccctctcgccctgcgggaattcaaggagtttgctgccggaagacggtccgtgagcggcgaccttattctggaaatcgggaaactcccccaacacctgacactgcgcgctcagaacgccctcgataatcttgtcatgctgcacaactccgagcagggaggcaaggcgtacagacatgccatggaagagctgccggacaccattgagaccctcatgctgcttgctctgatcgccgttctcacaggcggggtgaccctgttctttctgtctggaaaaggcctcgggaagacaagcattggacttctgtgtgtgacggcttcctctgccctgctctggatggccagcgtcgaacctcactggatcgctgcgtccatcattctggagttctttcttatggtgctgctcatccccgaacctgatcggcagcgcaccccccaagacaatcagctggcctatgttgtgattggcctgctcttcatgatccttacagtcgctgccaacgagatggggctgctggagaccacaaagaaagatctcggaattggctacgtggccgctgaaaaccatcagcacgccaccatgctggacgtcgatcttcaccctgcgagcgcctggacgctgtacgctgtggccaccacagttatcacccccatgatgagacatacaatcgagaataccacggctaacatttctctcacagccatcgcgaatcaagccgctattctgatgggcctggacaaggggtggccgatctccaaaatggatattggagtgcctctccttgccctgggctgctatagccaggtcaaccccctgaccctcacagctgccgtgctgatgcttgttgctcactacgccatcattgggcccggactgcaggcgaaggccacccgggaagctcagaaacgcaccgccgctggcatcatgaagaatcctacagtggacgggatcgtcgccattgatctcgacccggtggtgtatgatgccaagtttgagaaacaactgggacagatcatgctgctcattctttgtacgtctcagatcctgctgatgagaaccacatgggcgctctgcgaatccattaccctggctacaggcccccttaccacgctgtgggagggcagccctgggaagttctggaacacaaccatcgccgtttctatggctaatatcttccggggaagctacctcgccggcgccgggctggctttttccctgatgaaatctctcggaggcgggcgcagaggaaccggcgcccagggcgagacacttggggaaaagtggaaacggcaactgaaccagctgagcaagtccgagttcaatatttataagagaagcggaatcatggaagtcgaccgctccgaggcgaaagaaggcctcaagcggggggagaccacaaaacatgccgtgtctagaggaacggctaagctgcgctggtttgtggagcggaaccttgtcaaacccgaaggcaaggttattgacctggggtgtggaagaggcggctggagctactattgcgccgggctcaagaaagtgaccgaggtgaagggatacacaaaaggcgggcctggacacgaagagcccatccctatggctacctacggctggaatctggtcaagctgcattccgggaaagatgtgttctttatgccgcccgaaaagtgtgacacactcctttgcgatattggagagtctagccctaaccccaccatcgaggaaggccgcacgctgcgggttctgaaaatggtggagccttggctcagaggcaatcagttctgtgtcaagatcctgaacccctatatgccgtccgtggttgaaacccttgagcgcatgcagcggaagcacgggggaatgctggtgagaaatcctctctctcgcaacagcacacacgagatgtactgggtctcctgcggcaccgggaatattgtgagcgccgtgaacatgacatctcggatgctgctgaacagatttaccatggcgcatcgcaaacccacatatgaaagagacgtcgatctcggagccggcacccggcacgttgctgtggagcccgaagtggccaatctggacatcattgggcaacgcatcgagaacattaagaatgaacataaatccacgtggcactacgatgaggacaacccttataagacatgggcttaccacggaagctatgaggtcaaatcttccggcagcgcctcttccatggtgaatggcgttgtgagacttctgaccaagccctgggatgtcatccctatggtgacccagattgctatgacagacacgaccccgttcgggcagcaacgggtttttaaggaaaaagtggatacaagaaccccccgggccaagcgcggaacaacccagatcatggaggtcacagcgaaatggctctggggcttcctgagcagaaacaagaaacctcggatctgtacccgcgaagagtttacgagaaaggtgcggtccaatgccgctattggggccgttttcgtggacgaaaaccagtggaatagcgctaaggaggccgtcgaggacgaacgcttttgggatcttgtgcatagagagcgggaactgcacaaacagggaaagtgcgccacctgcgtctacaacatgatgggcaaacgcgagaagaaactcggggaattcggcaaggcgaagggatctagagctatctggtacatgtggctgggcgcccggttcctggagtttgaggccctcgggttcatgaatgaagaccattggtttagccgcgagaactccctgtctggagtggaaggcgaggggcttcacaaactgggatatattctcagagatatcagcaagattcccggcgggaatatgtacgctgacgatacagccggctgggacacccggatcacagaggatgacctgcaaaacgaagctaaaatcaccgatattatggagcctgaacatgcccttctggcgacgtccatcttcaagctcacatatcagaataaagttgtgcgcgtccagagacccgccaagaacggaaccgtgatggacgtgatttctcggagagatcagcgcggcagcgggcaagttggaacatacggcctgaacacctttacgaatatggaggtgcagctgatccggcagatggaatccgaggggattttcctcccgtctgagctggaaacccctaaccttgctgagagagccctggactggctcgaaaaacacggagctgagcgcctgaagcggatggccatcagcggcgatgactgtgtcgtgaagcccatcgacgatagatttgcgacagcccttaccgctctgaatgacatggggaaagttcgcaaggatattcctcagtgggaaccctccaaaggctggaacgactggcaacaggtgcctttctgcagccaccattttcaccagctcatcatgaaggatggacgggagattgtcgtgccctgtagaaatcaggacgagctggtcggccgcgcccgggtgtctcaaggggctggatggtccctgagagaaacagcctgcctcggcaaaagctatgctcagatgtggcagctgatgtacttccatcgccgggatcttagactggccgcgaacgccatctgttctgctgttccggtggactgggtccctacctcccggacaacctggagcattcacgcccaccatcaatggatgacgacagaggatatgctctccgtgtggaatagagtttggatcgaagagaacccctggatggaagacaagacccacgtgtctagctgggaggaggtcccctatctggggaagcgcgaagatcagtggtgcggatcccttatcggcctgaccgcccgggctacatgggccaccaatattcaggtggcgatcaaccaggtgagacgcctcattgggaatgagaactacctggactacatgacaagcatgaaaagatttaagaatgaatctgactccgagggcgctctgtggtga

SEQ ID NO: 18717 - RNA, 9879 nt, synthetic construct
  misc_feature 1..9879: note = derived and/or modified CDS sequence (opt5) from DENV-1__KJ189352__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcagatctttgggaccgcctacggagtgctgttcagcggcgtttcctggacgatgaaaatcgggattggcatccttctgacctggctcggactgaatagccgctctacatccctgagcatgacctgtattgctgtgggcatggtcacactttacctcggggtgatggttcaggccgattctggatgcgtgatcaactggaagggccgggagctgaaatgtgggtccggaatttttgtcaccaacgaagtgcacacatggaccgagcaatataagttccaggctgacagccctaagagactgtccgccgcgatcggcaaagcctgggaggaaggggtttgcggcattcgctctgctacgcggctcgagaatatcatgtggagacagatcagcaacgaactgaatcatattcttctggagaacgatatgaagtttacagtggtcgtgggagacgccaatggcatcctcgctcaggggaaaaagatgattcgcccgcaacccatggaacacaaatactcctggaagtcttggggaaaagccaaggtgatcggcgccgacattcagaacaccaccttcatcatcgatgggcctgacacacccgagtgtcctgatggacagcgggcttggaatatttgggaggtcgaagactatggctttggcgttttcaccacgaacatctggctgaagctgagagatagctacacacagatgtgcgaccaccgccttatgtccgcggccattaaagatagcaaggctgtgcatgccgacatggggtattggatcgagtctgaaaaaaatgagacctggaagctcgcccgggcttccttcattgaagtgaaaacatgtacctggcccaagagccacacactgtggtctaacggagtcctggagtccgagatgatcatcccgaagatttacggcgggcctatcagccaacataattatagacccggatactttacccagacggccggcccttggcacctcgggaaactggaacttgatttcgacctgtgcgagggaaccacagtggttgtggatgaacactgcggcaaccggggcccctctctccgcaccacaaccgtcacggggaagattatccatgagtggtgttgcagaagctgtacactgcctcccctgcggtttagaggagaggacggctgctggtacgggatggaaattcgcccggtgaaagagaaggaagagaatcttgttcggtccatggtgagcgcgggatctggcgaagtcgattccttcagcctcgggatcctgtgtgtgtccatcatgattgaggaggttatgagatctcgctggagcagaaaaatgctgatgaccggaacactcgctgtgtttctgcttctgatcatgggccagctcacctggaacgacctgattcggctgtgcatcatggtcggcgccaatgcctccgaccgcatggggatgggaaccacatatcttgctctgatggccacgttcaagatgagacctatgtttgcggtgggcctcctgttccggcgcctcacctctagagaagtgctgcttctgacaattgggctcagcctggtcgcttccgttgagctgcccaactctcttgaagagctgggagatggcctcgccatggggatcatgatgctgaagctcctgaccgaatttcaaccccaccagctttggacaaccctgctcagcctgacgttcgtgaaaacaaccctgtcccttgactacgcctggaagaccacagctatggccctgagcattgtgtctctctttcctctgtgtctctccaccacaagccagaaaacgacctggctgccggtccttctgggatctttcggctgcaagcccctgacaatgtttctcatcaccgagaacaaaatctggggccggaagtcctggcctctgaatgaggggattatggctatcggaattgtgagcatccttctgtcttccctcctgaagaacgatgttcccctcgccggccctctgattgcggggggaatgcttatcgcctgttatgtgatcagcggctccagcgctgacctgtctctggaaaaagccgctgaggtcagctgggaacaggaggccgaacattccggggcctctcacagcattctcgtggaggttcaagatgacggaacaatgaagatcaaagatgaggaacgcgacgataccctgacgattcttctgaaggctaccctcctggcggtgtccggcgtctaccccatgtctatccctgccacactcttcgtgtggtatttctggcagaaaaagaaacagagaagcggcgtcctgtgggacaccccctccccgcctgaggtggaacgggctgttcttgataatgggatttaccgcatcctgcagagaggactgctcggccggtctcaagtgggggtcggagtgtttcaggacggcgttttccatacaatgtggcacgtgaccagaggggccgtcctgatgtatcagggaaagcgccttgagcccagctgggcctccgtgaagaaagatctgatcagctacggcggcgggtggcggtttcagggatcttggaacacaggcgaggaagtgcaagttattgctgtcgagcctgggaagaatcccaaaaacgtgcagacgaccccgggaacattcaagacccctgaaggcgaggtgggggccatcgcgctcgactttaaacccggaacctccggcagccctattgtcaatagagaaggcaagatcgtggggctgtacggaaacggcgttgtgacaacgtctgggacctatgtctccgctattgcccaggccaaggctagccaagagggacccctccccgagatcgaagacgaggtgttcaaaaagcgcaatctgacaattatggatcttcaccctggctccgggaaaacccggagatacctgccggccatcgttcgcgaagcgatcaagcggaaactgagaacactcattctggctcccacccgcgtggtcgcctctgagatggccgaagctcttaagggcatgcctatccggtatcagacgacagccgtgaagagcgagcataccggaagagagattgttgacctgatgtgccacgctacctttacaatgcggctcctgtcccccgtgcgcgtccctaactacaatatgatcattatggatgaagcccatttcaccgaccccgcgagcatcgccgctagaggctatatctctacacgggtggggatgggagaggccgctgccatttttatgaccgccacgcctccgggctccgtggaagctttcccccagagcaacgcggtcatccaggatgaggaacgcgacattcctgagagatcttggaatagcgggtacgattggatcacagactttcccggaaaaaccgtttggttcgtgccttccattaagtctggcaacgatatcgccaattgtctgcggaaaaacgggaagagagtgatccaactcagccgcaaaacattcgacaccgagtatcagaagacgaagaacaatgattgggactacgtcgtgaccacagacatttccgaaatgggcgctaactttcgggccgatagagttatcgacccccgccggtgccttaaaccggtgattctgaaggatggacctgagagagtcatcctggccggccccatgcccgtgaccgctgcctctgcggctcagcgccgggggagaattggacgcaatcagaacaaagaaggcgaccaatacgtttatatggggcagcctctcaataacgatgaggaccacgcccattggacagaggccaagatgctgcttgataatatcaacacccccgaaggaattatccctgctctgttcgagccggaaagagagaaaagcgccgcgatcgacggcgaataccggctccgcggggaggccagaaagacatttgtggagctgatgcggcgcggcgatctgcccgtctggctctcctataaggtggctagcgaaggattccagtactctgacagacggtggtgctttgatggcgagagaaataaccaggtccttgaagagaatatggacgtggaaatttggaccaaagagggggagcgcaagaaactgcggcctagatggctggatgcccgcacgtattccgaccccctcgctctgcgggaattcaaggagtttgccgctggaagacggagcgtttccggcgaccttatcctggaaattgggaaactccctcaacacctgacactgcgcgcccagaacgcgctcgataatcttgtgatgctgcacaactctgagcagggaggcaaggcctacagacatgctatggaagagctgcccgacaccatcgagaccctcatgctgcttgccctgattgctgtgctcacaggcggggtcaccctgttctttctgagcggaaaaggcctcgggaagacatccatcggacttctgtgtgttacggcctctagcgccctgctctggatggcttccgtggaaccgcactggatcgcggccagcattatcctggagttctttcttatggtgctgctcattcctgaacccgatcggcagcgcacccctcaagacaatcagctggcttatgtcgtgatcggcctgctcttcatgattcttacagttgccgccaacgagatggggctgctggagaccacaaagaaagatctcggaatcggctacgtggctgccgaaaaccatcagcacgcgaccatgctggacgtcgatcttcaccccgcctctgcttggacgctgtacgccgtggctaccacagtcatcacccctatgatgagacatacaattgagaataccacggccaacatctccctcacagcgattgccaatcaagctgccatcctgatgggcctggacaaggggtggcccattagcaaaatggatatcggagtgccgctccttgctctgggctgctattctcaggttaaccctctgaccctcacagccgctgtgctgatgcttgtcgcccactacgcgattatcgggcccggactgcaggccaaggctacccgggaagcccagaaacgcaccgctgccggcatcatgaagaatcccacagtggacgggattgttgccatcgatctcgaccctgtggtctatgatgcgaagtttgagaaacaactgggacagattatgctgctcatcctttgtacgtcccagattctgctgatgagaaccacatgggctctctgcgaaagcatcaccctggccacaggcccgcttaccacgctgtgggagggctctcccgggaagttctggaacacaaccatcgctgtgagcatggccaatattttccggggatcctacctcgccggcgctgggctggccttttctctgatgaaaagcctcggaggcgggcgcagaggaaccggcgcgcagggcgagacacttggggaaaagtggaaacggcaactgaaccagctgtccaagagcgagttcaatacctataagagatccggaatcatggaagtggaccgctctgaggccaaagaaggcctcaagcggggggagacaacgaaacatgctgttagcagaggaaccgccaagctgcgctggtttgtcgagcggaaccttgtgaaacctgaaggcaaggtgattgacctggggtgtggaagaggcggctggtcctactattgcgctgggctcaagaaagtcacagaggttaagggatacaccaaaggcgggcccggacacgaagagcctatccccatggccacatacggctggaatctggtgaagctgcattctgggaaagatgtgttctttatgcctccggaaaagtgtgacaccctcctttgcgatattggagagagctcccccaaccctacgatcgaggaaggccgcaccctgcgggtcctgaaaatggtggagccctggctcagaggcaatcagttctgtatcaagattctgaacccttatatgccctctgttgtggaaacacttgagcgcatgcagcggaagcacgggggaatgctggtcagaaatccgctcagccgcaactccacccacgagatgtactgggtgagctgcggcacagggaatatcgtttctgcggtgaacatgacctcccggatgctgctgaacagatttacaatggcccatcgcaaacctacctatgaaagagacgtcgatctcggagctggcacgcggcacgtggccgtggagcccgaagtcgctaatctggacattatcgggcaacgcattgagaacatcaagaatgaacataaaagcacatggcactacgatgaggacaacccctataagacctgggcctaccacggatcttatgaggttaaaccttccggcagcgcttcttccatggtgaatggcgtggtcagacttctgaccaagccctgggatgtgattcctatggttacacagatcgccatgacggacaccacaccgttcgggcagcaacgggtgtttaaggaaaaagtcgataccagaacaccccgggcgaagcgcggaaccacacagatcatggaggtgaccgccaaatggctctggggcttcctgagcagaaacaagaaacctcggatttgtacgcgcgaagagtttaccagaaaggttcggtccaatgctgccatcggggctgtgttcgtcgacgaaaaccagtggaatagcgccaaggaggccgtggaggacgaacgcttttgggatcttgttcatagagagcgggaactgcacaaacagggaaagtgcgcgacatgcgtgtacaacatgatgggcaaacgcgagaagaaactcggggaattcggcaaggctaagggatctagagccatttggtacatgtggctgggcgcccggttcctggagtttgaggctctcgggttcatgaatgaagaccattggtttagccgcgagaactccctgtctggagtcgaaggcgaggggcttcacaaactgggatatatcctcagagatattagcaagatccccggcgggaatatgtacgccgacgataccgctggctgggacacacgggtgaccgaggatgacctgcaaaacgaagccaaaatcacggatattatggagcctgaacatgcgcttctggccacatccatcttcaagctcacctatcagaataaagtcgtgcgcgttcagagacccgctaagaacggaacagtgatggacgtcatttctcggagagatcagcgcggcagcgggcaagtgggaacctacggcctgaacacgtttaccaatatggaggtgcagctgatccggcagatggaatccgaggggattttcctcccgtctgagctggaaacacctaaccttgccgagagagctctggactggctcgaaaaacacggagccgagcgcctgaagcggatggcgatcagcggcgatgactgtgttgtgaagcccatcgacgatagatttgccaccgctcttacagccctgaatgacatggggaaagtccgcaaggatattcctcagtgggaaccctccaaaggctggaacgactggcaacaggtgcctttctgcagccaccattttcaccagctcatcatgaaggatggacgggagattgttgtgccctgtagaaatcaggacgagctggtcggccgcgctcgggtgtctcaaggggccggatggtccctgagagaaaccgcttgcctcggcaaaagctatgcccagatgtggcagctgatgtacttccatcgccgggatcttagactggcggccaacgctatctgttctgccgtcccggtggactgggttcctacatcccggaccacgtggagcattcacgcccaccatcaatggatgacaaccgaggatatgctctccgtgtggaatagagtctggatcgaagagaacccctggatggaaaataagacccacgtgtctagctgggaggaggttccctatctggggaagcgcgaagaccagtggtgcggatcccttatcggcctgacagctcgggccacctgggcgacaaacattcaggtggctatcaatcaggtcagacgcctcattgggaacgagaattacctggattacatgacgagcatgaaaagatttaagaacgaatctgactccgagggcgccctgtggtga

SEQ ID NO: 18718 - RNA, 9879 nt, synthetic construct
  misc_feature 1..9879: note = derived and/or modified CDS sequence (opt5) from DENV-1__KJ189353__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcagatctttgggaccgcctacggagtgctgttcagcggcgtttcctggacgatgaaaatcgggattggcatccttctgacctggctcggactgaatagccgctctacatccctgagcatgacctgtattgctgtgggcatggtcacactttacctcggggtgatggttcaggccgattctggatgcgtgatcaactggaagggccgggagctgaaatgtgggtccggaatttttgtcaccaacgaagtgcacacatggaccgagcaatataagttccaggctgacagccctaagagactgtccgccgcgatcggcaaagcctgggaggaaggggtttgcggcattcgctctgctacgcggctcgagaatatcatgtggaagcagatcagcaacgaactgaatcatattcttctggagaacgatatgaaatttacagtggtcgtgggagacgccaatggcatcctcgctcaggggaagaaaatgattagaccgcaacccatggaacacaagtactcctggaaatcttggggaaaggccaagatcattggcgccgacatccagaacaccaccttcatcattgatgggcctgacacacccgagtgtcctgatggacagcgcgcttggaatatctgggaggtggaagactatggctttggcgtcttcaccacgaacatttggctgaaactgcgggatagctacacacagatgtgcgaccacagacttatgtccgcggccatcaaggatagcaaagctgttcatgccgacatggggtattggattgagtctgaaaagaatgagacctggaaactcgcccgcgcttccttcatcgaagtgaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgagctgtgcgaaggaaccacagtcgtggttgacgagcactgcggcaacagaggcccctctctccggaccacaaccgtgacggggaaaatcattcatgagtggtgttgccgcagctgtacactgcctcccctgagatttcggggagaagatggctgctggtacgggatggagatcagaccggtcaaggaaaaagaggaaaatcttgtgcgctccatggttagcgcgggatctggcgaggtggactccttcagcctcgggatcctgtgtgtctccattatgatcgaggaagtgatgcggtctagatggagccgcaagatgctgatgaccggaacactcgctgtttttctgcttctgattatgggccagctcacctggaacgatctgatcagactgtgcattatggtgggcgccaatgcctccgaccggatggggatgggaaccacatatcttgctctgatggccacgttcaagatgcgccctatgtttgcggtcggcctcctgttcagacggctcacctctcgcgaggtgctgcttctgacaatcgggctcagcctggtggcttccgtcgaactgcccaactctcttgaggaactgggagacggcctcgccatggggattatgatgctgaaactcctgaccgagtttcaaccccaccagctttggacaaccctgctcagcctgacgttcgttaagacaaccctgtcccttgattacgcctggaaaaccacagctatggccctgagcatcgtgtctctctttcctctgtgtctctccaccacaagccagaagacgacctggctgccggtgcttctgggatctttcggctgcaaacccctgacaatgtttctcatcaccgagaacaagatttggggcagaaagtcctggcctctgaatgaagggatcatggctattggaatcgtcagcattcttctgtcttccctcctgaaaaacgacgtgcccctcgccggccctctgatcgccgggggaatgcttatcgcctgttatgttattagcggctccagcgctgatctgtctctggagaaggccgctgaagtgagctgggagcaggaagccgagcattccggggcctctcacagcatcctcgtcgaggtgcaagacgatggaacaatgaaaattaaggacgaagaacgggatgacaccctgacgatccttctgaaagctaccctcctggcggtttccggcgtgtaccccatgtctattcctgccacactcttcgtctggtatttctggcagaagaaaaagcagcgcagcggcgtgctgtgggataccccctccccgcctgaagtcgagagagctgtgcttgacaatgggatctaccggatcctgcagcgcggactgctcggcagatctcaagttggggtgggagtctttcaggatggcgtgttccatacaatgtggcacgttaccagaggggcggtgctgatgtatcagggaaagcggcttgagcccagctgggcctccgtcaaaaaggacctgattagctacggcggcgggtggcgctttcagggatcttggaacacaggcgaagaggtgcaagtgatcgctgttgaacctgggaaaaatcccaagaacgtccagacgaccccgggaacattcaaaacccctgagggcgaagtgggggccattgcgctcgattttaagcccggaacctccggcagccctatcgtgaatcgggagggcaagattgtcgggctgtacggaaacggcgtggttacaacgtctgggacctatgtgtccgctatcgcccaggccaaagctagccaagagggacccctccccgaaattgaggacgaagtcttcaagaaaagaaatctgacaatcatggaccttcaccctggctccgggaagacccgccggtacctgccggccatcgtgagagaggcgattaaacgcaagctgcggacactcatcctggctcccaccagagttgtggcctctgaaatggccgaggctcttaagggcatgcctattcgctatcagacgacagccgtcaaaagcgagcataccggacgggaaatcgtggatctgatgtgccacgctacctttacaatgagactcctgtcccccgttcgggtgcctaactacaatatgattatcatggacgaggcccatttcaccgatcccgcgagcatcgccgctcgcggctatatttctacaagagtcgggatgggagaagccgctgccatctttatgaccgccacgcctccgggctccgtggaggctttcccccagagcaacgcggtgattcaggacgaagaacgggatatccctgagcgctcttggaatagcgggtacgactggattacagattttcccggaaagaccgtctggttcgttccttccatcaaatctggcaacgacatcgccaattgtctgagaaagaacgggaaacgggtgattcaactcagcagaaagacattcgataccgaatatcagaagacgaaaaacaatgactgggattacgtggtcaccacagacatctccgagatgggcgctaactttcgcgccgaccgggtgattgatcccagacgctgccttaagccggttatcctgaaagacggacctgaacgggtgattctggccggccccatgcccgtcaccgctgcctctgcggctcagagacgcgggcggatcggaagaaatcagaacaaggagggcgatcaatacgtgtatatggggcagcctctcaataacgacgaggatcacgcccattggacagaagccaaaatgctgcttgacaatattaacacccccgagggaatcatccctgctctgttcgaaccggagcgcgaaaagagcgccgcgattgatggcgagtacagactcagaggggaagcccgcaagacatttgttgaactgatgagacggggcgacctgcccgtgtggctctcctataaagtcgctagcgagggattccagtactctgatcgcagatggtgctttgacggcgaacggaataaccaggtgcttgaggaaaatatggatgtcgagatctggaccaaggagggggaacgcaagaagctgcgccctcggtggctggacgccagaacgtattccgatcccctcgctctgcgcgagttcaaagaatttgccgctggacggagaagcgtgtccggcgaccttattctggagatcgggaagctccctcaacacctgacactgcgggcccagaacgcgctcgacaatcttgttatgctgcacaactctgaacagggaggcaaagcctaccgccatgctatggaggagctgcccgataccattgaaaccctcatgctgcttgccctgatcgctgtgctcacaggcggggtgaccctgttctttctgagcggaaagggcctcgggaagacatccatcggacttctgtgtgtcacggcctctagcgccctgctctggatggcttccgttgagccgcactggattgcggccagcatcattctggagttctttcttatggtgctgctcatccctgagcccgacagacagcggacccctcaagataatcagctggcttatgtggtcattggcctcctgttcatgatccttacagtggccgccaacgagatggggctgctggaaaccaccaaaaaggacctcggaatcggctacgttgctgccgagaaccatcagcacgcgaccatgctggatgtggaccttcaccccgcctctgcttggacgctgtacgccgtcgctaccacagtgattacccctatgatgcgccatacaatcgaaaataccacggccaacatttccctcacagcgatcgccaatcaagctgccattctgatgggcctggataaagggtggcccatcagcaagatggacattggagtcccgctccttgctctgggctgctattctcaggtgaaccctctgaccctcacagccgctgttctgatgcttgtggcccactacgcgatcatcgggcccggactgcaggccaaagctaccagagaggcccagaagcggaccgctgccggcattatgaagaatcccacagtcgatgggatcgtggccattgacctcgatcctgttgtgtatgacgcgaaatttgaaaagcaactgggacagatcatgctgctcattctttgtacgtcccagatcctgctgatgcgcaccacatgggctctctgcgagagcatcaccctggccacaggcccgcttaccacgctgtgggagggctctcccgggaaattctggaacacaaccattgctgtcagcatggccaatatcttcagaggatcctacctcgccggcgctgggctggccttttctctgatgaaaagcctcggaggcgggcggcgcggaaccggcgcgcagggcgaaacacttggggagaaatggaagagacaactgaaccagctgtccaagagcgagttcaatacctataaacggtccggaattatggaggtggatagatctgaagccaaggagggcctcaaacgcggggagacaacgaagcatgctgtgagccggggaaccgccaaactgagatggtttgttgaacgcaaccttgtcaagcctgagggcaaggtgatcgacctggggtgtggacggggcggctggtcctactattgcgctgggctcaaaaaggtgacagaagtcaaaggatacaccaagggcgggcccggacacgaggaacctattcccatggccacatacggctggaatctggttaaactgcattctgggaaggacgtgttctttatgcctccggagaaatgtgataccctcctttgcgacatcggagagagctcccccaaccctacgatcgaagagggcagaaccctgcgcgtgctgaagatggtcgaaccctggctccggggcaatcagttctgtattaagatcctgaacccttatatgccctctgtggttgagacacttgagagaatgcagcgcaaacacgggggaatgctggtgcggaatccgctcagcagaaactccacccacgaaatgtactgggtcagctgcggcacagggaatattgtgtctgcggttaacatgacctcccgcatgctgctgaaccggtttacaatggcccatagaaagcctacctatgagcgcgatgtggacctcggagctggcacgagacacgtcgccgtggaacccgaggtggctaatctggatatcattgggcaacggatcgaaaacattaaaaatgagcataagagcacatggcactacgacgaggataacccctataaaacctgggcctaccacggatcttatgaagtcaagccttccggcagcgcttcttccatggttaatggcgtggtgcgccttctgaccaagccctgggacgtcatccctatggtgacacagatcgccatgacggataccacaccgttcgggcagcaaagagtttttaaagagaaggtggacacccggacacccagagcgaaacggggaaccacacagattatggaagtcaccgccaagtggctctggggcttcctgagccgcaacaaaaagcctagaatctgtacgcgggaggaatttacccgcaaggtgagatccaatgctgccattggggctgttttcgtggatgagaaccagtggaatagcgccaaagaggccgtcgaagacgagcggttttgggaccttgtgcatcgcgaaagagagctgcacaagcagggaaaatgcgcgacatgcgtttacaacatgatgggcaagcgggagaaaaagctcggggagttcggcaaggctaaaggatctcgcgccatctggtacatgtggctgggcgccagattcctggagtttgaagctctcgggttcatgaatgaggatcattggtttagccgggaaaactccctgtctggagtggagggcgaggggcttcacaagctgggatatattctccgcgacatcagcaaaatccccggcgggaatatgtacgccgatgacaccgctggctgggatacaagagtcaccgaagacgatctgcaaaacgaggccaagattacggacatcatggaacctgagcatgcgcttctggccacatccattttcaaactcacctatcagaataaggtggtccgggtgcagcgccccgctaaaaacggaacagttatggatgtgatctctagacgggaccagagaggcagcgggcaagtcggaacctacggcctgaacacgtttaccaatatggaagtgcagctgattcgccagatggagtccgaggggatcttcctcccgtctgaactggagacacctaaccttgccgaacgggctctggattggctcgagaagcacggagccgaaagactgaagcgcatggcgatcagcggcgacgattgtgtggttaaacccattgacgaccggtttgccaccgctcttacagccctgaatgatatggggaaggtgagaaaagacatccctcagtgggagccctccaagggctggaacgattggcaacaggtccctttctgcagccaccattttcaccagctcattatgaaagacggacgcgagatcgtggttccctgtcggaatcaggatgaactggtgggcagagctcgcgtctctcaaggggccggatggtccctgcgggagaccgcttgcctcggcaagagctatgcccagatgtggcagctgatgtacttccatagacgcgaccttcggctggcggccaacgctatttgttctgccgtgccggtcgattgggtgcctacatccagaaccacgtggagcatccacgcccaccatcaatggatgacaaccgaagacatgctctccgtttggaatcgggtgtggatcgaggaaaacccctggatggagaataagacccacgtctctagctgggaggaagtgccctatctggggaaaagagaggatcagtggtgcggatcccttattggcctgacagctcgcgccacctgggcgacaaacatccaggttgctattaatcaggtgcggagactcatcgggaacgaaaattacctggactacatgacgagcatgaagcgctttaaaaacgagtctgattccgagggcgccctgtggtga

SEQ ID NO: 18719 - RNA, 9879 nt, synthetic construct
  misc_feature 1..9879: note = derived and/or modified CDS sequence (opt5) from DENV-1__KJ189354__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcagatctttgggaccgcctacggagtgctgttcagcggcgtttcctggacgatgaaaatcgggattggcatccttctgacctggctcggactgaatagccgctctacatccctgagcatgacctgtattgctgtgggcatggtcacactttacctcggggtgatggttcaggccgattctggatgcgtgatcaactggaagggccgggagctgaaatgtgggtccggaatttttgtcaccaacgaagtgcacacatggaccgagcaatataagttccaggctgacagccctaagagactgtccgccgcgatcggcaaagcctgggaggaaggggtttgcggcattcgctctgctacgcggctcgagaatatcatgtggaagcagatcagcaacgaactgaatcatattcttctggagaacgatatgaaatttacagtggtcgtgggagacgccaatggcatcctcgctcaggggaagaaaatgattagaccgcaacccatggaacacaagtactcctggaaatcttggggaaaggccaagatcattggcgccgacatccagaacaccaccttcatcattgatgggcctgacacacccgagtgtcctgatggacagcgcgcttggaatatctgggaggtggaagactatggctttggcgtcttcaccacgaacatttggctgaaactgcgggatagctacacacagatgtgcgaccacagacttatgtccgcggccatcaaggatagcaaagctgttcatgccgacatggggtattggattgagtctgaaaagaatgagacctggaaactcgcccgcgcttccttcatcgaagtgaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgacctgtgcgagggaaccacagtcgtggttgatgaacactgcggcaacagaggcccctctctccggaccacaaccgtgacggggaaaatcattcatgagtggtgttgccgcagctgtacactgcctcccctgagatttcggggagaggacggctgctggtacgggatggaaatcagaccggtcaaggagaaagaagagaatcttgtgcgctccatggttagcgcgggatctggcgaagtggattccttcagcctcgggatcctgtgtgtctccattatgatcgaggaggtgatgcggtctagatggagccgcaagatgctgatgaccggaacactcgctgtttttctgcttctgattatgggccagctcacctggaacgacctgatcagactgtgcattatggtgggcgccaatgcctccgaccggatggggatgggaaccacatatcttgctctgatggccacgttcaagatgcgccctatgtttgcggtcggcctcctgttcagacggctcacctctcgcgaagtgctgcttctgacaatcgggctcagcctggtggcttccgtcgagctgcccaactctcttgaagaactgggagatggcctcgccatggggattatgatgctgaaactcctgaccgaatttcaaccccaccagctttggacaaccctgctcagcctgacgttcgttaagacaaccctgtcccttgactacgcctggaaaaccacagctatggccctgagcatcgtgtctctctttcctctgtgtctctccaccacaagccagaagacgacctggctgccggtgcttctgggatctttcggctgcaaacccctgacaatgtttctcatcaccgagaacaagatttggggcagaaagtcctggcctctgaatgaggggatcatggctattggaatcgtcagcattcttctgtcttccctcctgaaaaacgatgtgcccctcgccggccctctgatcgccgggggaatgcttatcgcctgttatgttattagcggctccagcgctgacctgtctctggaaaaggccgctgaggtgagctgggaacaggaggccgaacattccggggcctctcacagcatcctcgtcgaggtgcaagatgacggaacaatgaaaattaaggatgaggaacgggacgataccctgacgatccttctgaaagctaccctcctggcggtttccggcgtgtaccccatgtctattcctgccacactcttcgtctggtatttctggcagaagaaaaagcagcgcagcggcgtgctgtgggacaccccctccccgcctgaggtcgaaagagctgtgcttgataatgggatctaccggatcctgcagcgcggactgctcggcagatctcaagttggggtgggagtctttcaggacggcgtgttccatacaatgtggcacgttaccagaggggcggtgctgatgtatcagggaaagcggcttgagcccagctgggcctccgtcaaaaaggatctgattagctacggcggcgggtggcgctttcagggatcttggaacacaggcgaggaagtgcaagtgatcgctgttgagcctgggaaaaatcccaagaacgtccagacgaccccgggaacattcaaaacccctgaaggcgaggtgggggccattgcgctcgactttaagcccggaacctccggcagccctatcgtgaatcgggaaggcaagattgtcgggctgtacggaaacggcgtggttacaacgtctgggacctatgtgtccgctatcgcccaggccaaagctagccaagagggacccctccccgagattgaagacgaggtcttcaagaaaagaaatctgacaatcatggatcttcaccctggctccgggaagacccgccggtacctgccggccatcgtgagagaagcgattaaacgcaagctgcggacactcatcctggctcccaccagagttgtggcctctgagatggccgaagctcttaagggcatgcctattcgctatcagacgacagccgtcaaaagcgagcataccggacgggagatcgtggacctgatgtgccacgctacctttacaatgagactcctgtcccccgttcgggtgcctaactacaatatgattatcatggatgaagcccatttcaccgaccccgcgagcatcgccgctcgcggctatatttctacaagagtcgggatgggagaggccgctgccatctttatgaccgccacgcctccgggctccgtggaggctttcccccagagcaacgcggtgattcaggatgaggaacgggacatccctgagcgctcttggaatagcgggtacgattggattacagactttcccggaaagaccgtctggttcgttccttccatcaaatctggcaacgatatcgccaattgtctgagaaagaacgggaaacgggtgattcaactcagcagaaagacattcgacaccgagtatcagaagacgaaaaacaatgattgggactacgtggtcaccacagacatctccgaaatgggcgctaactttcgcgccgatcgggtgattgaccccagacgctgccttaagccggttatcctgaaagatggacctgagcgggtgattctggccggccccatgcccgtcaccgctgcctctgcggctcagagacgcgggcggatcggaagaaatcagaacaaggaaggcgaccaatacgtgtatatggggcagcctctcaataacgatgaggaccacgcccattggacagaggccaaaatgctgcttgataatattaacacccccgaaggaatcatccctgctctgttcgagccggaacgcgaaaagagcgccgcgattgacggcgaatacagactcagaggggaagcccgcaagacatttgttgagctgatgagacggggcgatctgcccgtgtggctctcctataaagtcgctagcgaaggattccagtactctgaccgcagatggtgctttgatggcgagcggaataaccaggtgcttgaagagaatatggacgtcgaaatctggaccaaggagggggagcgcaagaagctgcgccctcggtggctggatgccagaacgtattccgaccccctcgctctgcgcgagttcaaagagtttgccgctggacggagaagcgtgtccggcgaccttattctggaaatcgggaagctccctcaacacctgacactgcgggcccagaacgcgctcgataatcttgttatgctgcacaactctgagcagggaggcaaagcctaccgccatgctatggaggaactgcccgacaccattgagaccctcatgctgcttgccctgatcgctgtgctcacaggcggggtgaccctgttctttctgagcggaaagggcctcgggaagacatccatcggacttctgtgtgtcacggcctctagcgccctgctctggatggcttccgttgaaccgcactggattgcggccagcatcattctggagttctttcttatggtgctgctcatccctgaacccgatagacagcggacccctcaagacaatcagctggcttatgtggtcattggcctcctgttcatgatccttacagtggccgccaacgagatggggctgctggagaccaccaaaaaggatctcggaatcggctacgttgctgccgaaaaccatcagcacgcgaccatgctggacgtggatcttcaccccgcctctgcttggacgctgtacgccgtcgctaccacagtgattacccctatgatgcgccatacaatcgagaataccacggccaacatttccctcacagcgatcgccaatcaagctgccattctgatgggcctggacaaagggtggcccatcagcaagatggatattggagtcccgctccttgctctgggctgctattctcaggtgaaccctctgaccctcacagccgctgttctgatgcttgtggcccactacgcgatcatcgggcccggactgcaggccaaagctaccagagaagcccagaagcggaccgctgccggcattatgaagaatcccacagtcgacgggatcgtggccattgatctcgaccctgttgtgtatgatgcgaaatttgagaagcaactgggacagatcatgctgctcattctttgtacgtcccagatcctgctgatgcgcaccacatgggctctctgcgaaagcatcaccctggccacaggcccgcttaccacgctgtgggagggctctcccgggaaattctggaacacaaccattgctgtcagcatggccaatatcttcagaggatcctacctcgccggcgctgggctggccttttctctgatgaaaagcctcggaggcgggcggcgcggaaccggcgcgcagggcgagacacttggggaaaaatggaagagacaactgaaccagctgtccaagagcgagttcaatacctataaacggtccggaattatggaagtggacagatctgaggccaaggaaggcctcaaacgcggggagacaacgaagcatgctgtgagccggggaaccgccaaactgagatggtttgttgagcgcaaccttgtcaagcctgaaggcaaggtgatcgacctggggtgtggacggggcggctggtcctactattgcgctgggctcaaaaaggtgacagaggtcaaaggatacaccaagggcgggcccggacacgaggaacctattcccatggccacatacggctggaatctggttaaactgcattctgggaaggatgtgttctttatgcctccggaaaaatgtgacaccctcctttgcgatatcggagagagctcccccaaccctacgatcgaggaaggcagaaccctgcgcgtgctgaagatggtcgagccctggctccggggcaatcagttctgtattaagatcctgaacccttatatgccctctgtggttgaaacacttgagagaatgcagcgcaaacacgggggaatgctggtgcggaatccgctcagcagaaactccacccacgagatgtactgggtcagctgcggcacagggaatattgtgtctgcggttaacatgacctcccgcatgctgctgaaccggtttacaatggcccatagaaagcctacctatgaacgcgacgtggatctcggagctggcacgagacacgtcgccgtggagcccgaagtggctaatctggacatcattgggcaacggatcgagaacattaaaaatgaacataagagcacatggcactacgatgaggacaacccctataaaacctgggcctaccacggatcttatgaggtcaagccttccggcagcgcttcttccatggttaatggcgtggtgcgccttctgaccaagccctgggatgtcatccctatggtgacacagatcgccatgacggacaccacaccgttcgggcagcaaagagtttttaaagaaaaggtggatacccggacacccagagcgaaacggggaaccacacagattatggaggtcaccgccaagtggctctggggcttcctgagccgcaacaaaaagcctagaatctgtacgcgggaagagtttacccgcaaggtgagatccaatgctgccattggggctgttttcgtggacgaaaaccagtggaatagcgccaaagaggccgtcgaggacgaaaagttttgggatcttgtgcatcgggagcgcgaactgcacaaacagggaaagtgcgcgacatgcgtttacaacatgatgggcaaaagagagaagaagctcggggagttcggcaaagctaagggatctcgggccatctggtacatgtggctgggcgcccgcttcctggagtttgaggctctcgggttcatgaatgaagaccattggtttagcagagagaactccctgtctggagtggaaggcgaggggcttcacaaactgggatatattctccgggatatcagcaagatccccggcgggaatatgtacgccgacgataccgctggctgggacacacgcgtcaccgaggatgacctgcaaaacgaagccaaaattacggatatcatggagcctgaacatgcgcttctggccacatccattttcaagctcacctatcagaataaagtggtcagagtgcagcggcccgctaagaacggaacagttatggacgtgatctctcgcagagatcagcggggcagcgggcaagtcggaacctacggcctgaacacgtttaccaatatggaggtgcagctgattagacagatggaatccgaggggatcttcctcccgtctgagctggaaacacctaaccttgccgagcgcgctctggactggctcgaaaagcacggagccgagcggctgaaaagaatggcgatcagcggcgatgactgtgtggttaagcccattgacgatcgctttgccaccgctcttacagccctgaatgacatggggaaagtgcggaaggatatccctcagtgggaaccctccaaaggctggaacgactggcaacaggtccctttctgcagccaccattttcaccagctcattatgaaggatggaagagagatcgtggttccctgtcgcaatcaggacgagctggtgggccgggctagagtctctcaaggggccggatggtccctgcgcgaaaccgcttgcctcggcaagagctatgcccagatgtggcagctgatgtacttccatcggagagatcttcgcctggcggccaacgctatttgttctgccgtgccggtcgactgggtgcctacatcccggaccacgtggagcatccacgcccaccatcaatggatgacaaccgaggatatgctctccgtttggaatagagtgtggatcgaagagaacccctggatggaaaataaaacccacgtctctagctgggaggaggtgccctatctggggaagcgggaagaccagtggtgcggatcccttattggcctgacagctagagccacctgggcgacaaacatccaggttgctattaatcaggtgcgccggctcatcgggaacgagaattacctggattacatgacgagcatgaaaagatttaagaacgaatctgactccgagggcgccctgtggtga

SEQ ID NO: 18720 - RNA, 9879 nt, synthetic construct
  misc_feature 1..9879: note = derived and/or modified CDS sequence (opt5) from DENV-1__KJ189355__SS-prME
  source 1..9879: mol_type = other RNA
agcgtgacaatgctgctcatgctgcttcccacggccctggctttccacctcacgacacggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgattgacaaagaaaagcctgtgaacatcgagacggagccgcccttcggcgaatcctatattgttgtcggggccggagagaaagccctcaagctgagctggtttaagagaggctctagcatcgggaaaatgttcgaagctaccgcccgcggcgctcggagaatggccattctgggagatacagcgtgggactttggctccatcgggggagtgttcacctctgtgggcaagctcgtccatcagatctttgggacagcctacggagtgctgttcagcggcgtttcctggaccatgaaaattgggatcggcattcttctgacgtggctcggactgaatagccgctctatgtccctgagcatgacctgtatcgctgtgggcatggtcacactttacctcggggtgatggttcaggccgattctggatgcgtgattaactggaagggccgggagctgaaatgtgggtccggaatctttgtcaccaacgaagtgcacacatggaccgagcaatataagttccaggctgacagccctaagagactgtccgccgcgattggcaaagcctgggaggaaggggtttgcggcatccgctctgctacacggctcgagaatatcatgtggaagcagattagcaacgaactgaatcatatccttctggagaacgatatgaaatttaccgtggtcgtgggagacgccaatggcattctcgctcaggggaagaaaatgatcagaccgcaacccatggaacacaagtactcctggaaatcttggggaaaggccaagattatcggcgccgacatccagaacacgacattcattatcgatgggcctgacacccccgagtgtcctgatggacagcgcgcttggaatatttgggaggtggaagactatggctttggcgtcttcaccacaaacatctggctgaaactgcgggatagctacacccagatgtgcgaccacagacttatgtccgcggccattaaggatagcaaagctgttcatgccgacatggggtattggatcgagtctgaaaagaatgagacgtggaaactcgcccgcgcttccttcatcgaagtgaagacatgtacctggcccaagagccacacactgtggtctaacggagtgctggagtccgagatgattatcccgaaaatttacggcgggcctatcagccaacataattatcggcccggatactttacccagacagccggcccttggcacctcgggaagctggaacttgatttcgacctgtgcgagggaaccacggtcgtggttgatgaacactgcggcaacagaggcccctctctccggaccacaaccgtgacagggaaaattatccatgagtggtgttgccgcagctgtaccctgcctcccctgagatttcggggagaggacggctgctggtacgggatggaaatcagaccggtcaaggagaaagaagagaatcttgtgcgctccatggttagcgcgggatctggcgaagtggattccttcagcctcgggattctgtgtgtctccatcatgattgaggaggtgatgcggtctagatggagccgcaagatgctgatgacgggaacactcgctgtttttctgcttctgatcatgggccagctcacctggaacgacctgattagactgtgcatcatggtgggcgccaatgcctccgaccggatggggatgggaacaacctatcttgctctgatggccaccttcaagatgcgccctatgtttgcggtcggcctcctgttcagacggctcacatctcgcgaagtgctgcttctgacgattgggctcagcctggtggcttccgtcgagctgcccaactctcttgaagaactgggagatggcctcgccatggggatcatgatgctgaaactcctgaccgaatttcaaccccaccagctttggacaaccctgctcagcctgacattcgttaagaccacgctgtcccttgactacgcctggaaaacaaccgctatggccctgagcatcgtgtctctctttcctctgtgtctctccaccacaagccagaagaccacatggctgccggtgcttctgggatctttcggctgcaaacccctgacgatgtttctcattaccgagaacaagatctggggcagaaagtcctggcctctgaatgaggggattatggctatcggaattgtcagcatccttctgtcttccctcctgaaaaacgatgtgcccctcgccggccctctgatcgccggcgggatgcttattgcctgttatgttatcagcgggtccagcgctgacctgtctctggaaaaggccgctgaggtgagctgggaacaggaggccgaacattccggggcctctcacagcattctcgtcgaggtgcaagatgacggaacaatgaaaatcaaggatgaggaacgggacgataccctgacaattcttctgaaagctaccctcctggcggtttccggcgtgtaccccatgtctatccctgccacactgttcgtctggtatttctggcagaagaaaaagcagcgcagcggcgtgctgtgggacaccccctccccgcctgaggtcgaaagagctgtgcttgataatgggatctaccggattctgcagcgcggactgctcggcagatctcaagttggggtgggagtctttcaggacggcgtgttccatacaatgtggcacgttaccagaggggcggtgctgatgtatcagggaaagcggcttgagcccagctgggcctccgtcaaaaaggatctgatcagctacggcggcgggtggcgctttcagggatcttggaacacaggcgaggaagtgcaagtgattgctgttgagcctgggaaaaatcccaagaacgtccagaccacaccgggaacgttcaaaacccctgaaggcgaggtgggggccatcgcgctcgactttaagcccggaacatccggcagccctattgtgaatcgggaaggcaagatcgtcgggctgtacggaaacggcgtggttaccacctctgggacatatgtgtccgctattgcccaggccaaagctagccaagagggacccctccccgagatcgaagacgaggtcttcaagaaaagaaatctgacgatcatggatcttcaccctggctccgggaagacccgccggtacctgccggccattgtgagagaagcgatcaaacgcaagctgcggacactcattctggctcccaccagagttgtggcctctgagatggccgaagctcttaagggcatgcctatccgctatcagacaaccgccgtcaaaagcgagcatacgggacgggagattgtggacctgatgtgccacgctacatttaccatgagactcctgtcccccgttcgggtgcctaactacaatatgatcatcatggatgaagcccatttcaccgaccccgcgagcattgccgctcgcggctatatctctacaagagtcgggatgggagaggccgctgccatttttatgaccgccacacctccgggctccgtggaggctttcccccagagcaacgcggtgatccaggatgaggaacgggacattcctgagcgctcttggaatagcgggtacgattggatcaccgactttcccggaaagacggtctggttcgttccttccatcaaatctggcaacgatattgccaattgtctgagaaagaacgggaaacgggtgatccaactcagcagaaagacattcgacaccgagtatcagaagaccaagaacaatgattgggactacgtggtcaccacggacatttccgaaatgggcgctaactttcgcgccgatcgggtgatcgaccccagacgctgccttaagccggttattctgaaagatggacctgagcgggtgatcctggccggccccatgcccgtcaccgctgcctctgcggctcagagacgcgggcggattggaagaaatcagaacaaggaaggcgaccaatacgtgtatatggggcagcctctcaataacgatgaggaccacgcccattggacagaggccaaaatgctgcttgataatatcaacacccccgaaggaatcattcctgctctgttcgagccggaacgcgaaaagagcgccgcgatcgacggcgaatacagactcagaggggaagcccgcaagacatttgttgagctgatgagacggggcgatctgcccgtgtggctctcctataaagtcgctagcgaaggattccagtactctgaccgcagatggtgctttgatggcgagcggaataaccaggtgcttgaagagaatatggacgtcgaaatttggaccaaggagggggagcgcaaaaagctgcgccctcggtggctggatgccagaacatattccgaccccctcgctctgcgcgagttcaaagagtttgccgctggacggagaagcgtgtccggcgaccttatcctggaaattgggaagctccctcaacacctgaccctgcgggcccagaacgcgctcgataatcttgttatgctgcacaactctgagcagggaggcaaagcctaccgccatgctatggaggaactgcccgacacgatcgagacactcatgctgcttgccctgatcgctgtgctcaccggcggggtgaccctgttctttctgagcggaaagggcctcgggaagacatccattggacttctgtgtgtcaccgcctctagcgccctgctctggatggcttccgttgaaccgcactggatcgcggccagcattatcctggagttctttcttatggtgctgctcattcctgaacccgatagacagcggacacctcaagacaatcagctggcttatgtggtcatcggcctcctcttcatgatccttacggtggccgccaacgagatggggctgctggagaccaccaaaaaggatctcggaattggctacgttgctgccgaaaaccatcagcacgcgaccatgctggacgtggatcttcaccccgcctctgcttggacactgtacgccgtcgctaccacggtgatcacccctatgatgcgccatacaattgagaataccacagccaacatctccctcaccgcgattgccaatcaagctgccatcctgatgggcctggacaaagggtggcccattagcaagatggatatcggagtcccgctccttgctctgggctgctattctcaggtgaaccctctgacgctcacagccgctgttctgatgcttgtggcccactacgcgatcattgggcccggactgcaggccaaagctaccagagaagcccagaagcggacagctgccggcatcatgaagaatcccaccgtcgacgggattgtggccatcgatctcgaccctgttgtgtatgatgcgaaatttgagaagcaactgggacagattatgctgctcatcctttgtacctcccagatcctgctgatgcgcacaacgtgggctctctgcgaaagcattaccctggccacaggcccgcttaccacactgtgggagggctctcccgggaaattctggaacaccacgatcgctgtcagcatggccaatattttcagaggatcctacctcgccggcgctgggctggccttttctctgatgaaaagcctcggaggcgggcggcgcggaacaggcgcgcagggcgagacccttggggaaaaatggaagagacaactgaaccagctgtccaagagcgagttcaatacctataaacggtccggaatcatggaagtggacagatctgaggccaaggaaggcctcaaacgcggggagacaaccaagcatgctgtgagccggggaacagccaaactgagatggtttgttgagcgcaaccttgtcaagcctgaaggcaaggtgattgacctggggtgtggacggggcggctggtcctactattgcgctgggctcaaaaaggtgacggaggtcaaaggatacaccaagggcgggcccggacacgaggaacctatccccatggccacatacggctggaatctggttaaactgcattctgggaaggatgtgttctttatgcctccggaaaaatgtgacaccctcctttgcgatatcggagagagctcccccaaccctacaattgaggaaggcagaaccctgcgcgtgctgaagatggtcgagccctggctccggggcaatcagttctgtatcaagattctgaacccttatatgccctctgtggttgaaacgcttgagagaatgcagcgcaaacacgggggaatgctggtgcggaatccgctcagcagaaactccacccacgagatgtactgggtcagctgcggcacagggaatatcgtgtctgcggttaacatgacctcccgcatgctgctgaaccggtttacaatggcccatagaaagcctacctatgaacgcgacgtggatctcggagctggcacaagacacgtcgccgtggagcccgaagtggctaatctggacattatcgggcaacggattgagaacatcaaaaatgaacataagagcacctggcactacgatgaggacaacccctataaaacgtgggcctaccacggatcttatgaggtcaagccttccggcagcgcttcttccatggttaatggcgtggtgcgccttctgacaaagccctgggatgtcatccctatggtgacccagattgccatgaccgacacaacgccgttcgggcagcaaagagtttttaaagaaaaggtggatacccggacacccagagcgaaacggggaaccacacagatcatggaggtcaccgccaagtggctctggggcttcctgagccgcaacaaaaagcctagaatttgtacacgggaagagtttacccgcaaggtgagatccaatgctgccatcggggctgttttcgtggacgaaaaccagtggaatagcgccaaagaggccgtcgaggacgaacggttttgggatcttgtgcatcgcgagagagaactgcacaagcagggaaaatgcgcgacgtgcgtttacaacatgatgggcaagcgggagaaaaagctcggggagttcggcaaggctaaaggatctcgcgccatttggtacatgtggctgggcgccagattcctggagtttgaggctctcgggttcatgaatgaagaccattggtttagccgggagaactccctgtctggagtggaaggcgaggggcttcacaagctgggatatatcctccgcgatatcagcaaaattcccggcgggaatatgtacgccgacgataccgctggctgggacacaagagtcaccgaggatgacctgcaaaacgaagccaagatcacagatattatggagcctgaacatgcgcttctggccacctccatcttcaaactcacgtatcagaataaggtggtccgggtgcagcgccccgctaaaaacggaacagttatggacgtgatttctagacgggatcagagaggcagcgggcaagtcggaacctacggcctgaacacatttaccaatatggaggtgcagctgatccgccagatggaatccgaggggatcttcctcccgtctgagctggaaacgcctaaccttgccgagcgggctctgggatggctcgaaaagcacggcgccgagagactgaagcgcatggcgattagcggggacgattgtgtggttaaacccatcgacgaccggtttgccaccgctcttacagccctgaatgatatgggcaaggtgagaaaagacattcctcagtgggaaccctccaagggatggaacgattggcaacaggtccctttctgcagccaccattttcaccagctcatcatgaaagacggccgcgagattgtggttccctgtcggaatcaggatgagctggtggggagagctcgcgtctctcaaggagccggctggtccctgcgggaaaccgcttgcctcggaaagagctatgcccagatgtggcagctgatgtacttccatagacgcgaccttcggctggcggccaacgctatctgttctgccgtgccggtcgattgggtgcctacatccagaaccacatggagcatccacgcccaccatcaatggatgaccacggaggacatgctctccgtttggaatcgggtgtggattgaagagaacccctggatggaaaataagacacacgtctctagctgggaggaggtgccctatctgggaaaaagagaagatcagtggtgcggctcccttatcgggctgaccgctcgcgccacctgggcgacaaacattcaggttgctatcaatcaggtgcggagactcattggcaacgagaattacctggactacatgaccagcatgaagcgctttaaaaacgaatctgattccgagggagccctgtggtga

SEQ ID NO: 18721 - RNA, 9879 nt, synthetic construct
  misc_feature 1..9879: note = derived and/or modified CDS sequence (opt5) from DENV-1__KJ189358__SS-prME
  source 1..9879: mol_type = other RNA
agcgtgaccatgctgctcatgctgcttcccacagtcctggccttccacctcacgaccagaggcggggagcctcatatgatcgtttccaagcaggaacggggaaaatctctgctttttaagacaagcgctggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggagaagcgctctgtggccctggcccctcatgttgggctcggactggaaacaagaaccgagacgtggatgagctccgaaggcgcttggaaacagattcagcgggtggagacatgggcccttcgccaccccggcttcaccgtcatcgcttttttcctggcccatgcgattgggacatctatcacccagaagggaatcatttttatcctcctgatgcttgtgacccctagcatggccatgagatgcgttggcattgggaaccgggacttcgtggagggactgtccggcgctacatgggtcgatgtggtgctcgaacacgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggccagcacatcccaagaaacctggaatcgccaggacctcctggtcacatttaaaaccgctcacgcgaagaagcaggaggtggttgtgctgggatctcaagaaggcgccatgcacaccgctctcacaggggccacggagattcagaccagcggaacaaccacaatcttcgccggccatctgaaatgcagacttaagatggataaactgaccctcaaggggatgtcctatgtcatgtgtacgggcagcttcaaactggaaaaggaggtggctgagacacagcacggaaccgttctggtgcaggtcaagtacgaaggcaccgacgccccgtgcaaaattcctttttctacacaagatgagaagggggtgacccagaacggacggcttatcacagcgaatcccatcgtgacggacaaagaaaagcctgttaacattgagaccgagccccccttcggcgaatcctatatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcatcaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttacctcggggtgatggtccaggctgattctggatgcgtgattaactggaagggccgggagctgaaatgtgggtccggaatctttgttaccaacgaagtgcacacatggaccgagcaatataagttccaggccgacagccctaagagactgtccgctgccattggcaaagcgtgggaggaaggggtctgcggcatccgctctgccacgcggctcgagaatattatgtggaagcagatcagcaacgaactgaatcatatccttctggagaacgatatgaaatttacagtggtggtcggagacgctaatggcattctcgcccaggggaagaaaatgatcagaccgcaacccatggaacacaagtactcctggaaatcttggggaaaggctaagattatcggcgccgacattcagaacaccaccttcatcatcgatgggcctgacacacccgagtgtcctgatggacagcgcgcctggaatatttgggaggttgaagactatggctttggcgtgttcaccacgaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacactgtggtctaacggagtgctggagtccgagatgatcatcccgaaaatttacggcgggcctatcagccaacataattatcggcccggatactttacccagacggctggcccttggcacctcgggaagctggaacttgatttcgacctgtgcgagggaaccacagttgtggtcgatgaacactgcggcaacagaggcccctctctccggaccacaaccgtgacggggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggatctggcgaagtggattccttcagcctcgggatcctgtgtgtttccatcatgattgaggaggtgatgcggtctagatggagccgcaagatgctgatgaccggaacactcgcggtctttctgcttctgatcatgggccagctcacctggaacgacctgattagactgtgcatcatggtgggcgctaatgcctccgaccggatggggatgggaaccacacaccttgccctgatggctacgttcaagatgcgccctatgtttgccgtgggcctcctgttcagacggctcacctctcgcgaagtcctgcttctgacaattgggctcagcctggttgcgtccgtggagctgcccaactctcttgaagagctgggagatggcctcgctatggggatcatgatgctgaaactcctgaccgaatttcaaccctatcagctttggacaaccctgctcagcctgacgttcgtgaagacaaccctgtcccttgactacgcctggaaaaccacagccatggctctgagcattgtctctctctttcctctgtgtctctccaccacaagccagaagacgacctggctgccggtgcttctgggatctttcggctgcaaacccctgacaatgtttctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttatgtcatcagcggctccagcgccgacctgtctctggaaaaggctgccgaggtgagctgggaacaggaggctgaacattccggggcctctcacagcattctcgttgaggtgcaagatgacggaacaatgaaaatcaaggatgaggaacgggacgataccctgacgattcttctgaaagccaccctcctggctgtctccggcgtgtaccccatgtctatccctgcgacactcttcgtctggtatttctggcagcgcaagaaacagagaagcggcgtgctgtgggacaccccctccccgcctgaggttgaacgggccgtgcttgataatgggatttaccgcatcctgcagagaggactgctcggccggtctcaagtcggggtgggagtttttcaggacggcgtgttccatacaatgtggcacgtcaccagaggggctgtgctgatgtatcagggaaagcgccttgagcccagctgggcctccgtgaagaaagatctgatcagctacggcggcgggtggcggtttcagggatcttggaacacaggcgaggaagttcaagtcattgccgtggagcctgggaagaatcccaaaaacgtgcagacgaccccgggaacattcaagacccctgaaggcgaggtcggggctatcgccctcgactttaaacccggaacctccggcagccctattgtgaatagagaaggcaagatcgttgggctgtacggaaacggcgtggtcacaacgtctgggacctatgtgtccgcgattgctcaggccaaggccagccaagagggacccctccccgagatcgaagacgaggttttcaaaaagcgcaatctgacaattatggatcttcaccctggctccgggaaaacccggaagtacctgccggctatcgtgagagaagccatcaaacgcaagctgcggacactcattctggcgcccaccagagtcgtggcttctgagatggccgaagcccttaagggcatgcctatccgctatcagacgacagctgttaaaagcgagcataccggacgggagattgtggacctgatgtgccacgccacctttacaatgagactcctgtcccccgtccgggtgcctaactacaatatgatcattatggatgaagctcatttcaccgaccccgccagcatcgcggcccgcggctatatctctacaagagtggggatgggagaggctgccgctatttttatgaccgccacgcctccgggctccgtcgaagccttcccccagagcaacgctgttatccaggatgaggaacgggacattcctgagcgctcttggaatagcgggtacgattggatcacagactttcccggaaagaccgtgtggttcgtgccttccattaaatctggcaacgatatcgcgaattgtctgagaaagaacgggaaacgggtcatccaactcagcagaaagacattcgacaccgagtatcagaagacgaaaaacaatgattgggactacgtggttaccacagacatttccgaaatgggcgccaactttcgcgctgatcgggtgatcgaccccagacgctgccttaagccggtcattctgaaagatggacctgagcgggtgatcctggccggccccatgcccgttaccgtggcctctgctgcccagagacgcgggcggattggaagaaatcagaacaaggaaggcgaccaatacgtctatatggggcagcctctcaataacgatgaggaccacgcgcattggacagaggctaaaatgctgcttgataatatcaacacccccgaaggaattatccctgccctgttcgagccggaacgcgagaagagcgccgctatcgacggcgaatacagactccggggggaggcccgcaagacatttgtggagctgatgagacggggcgatctgcccgtctggctctcctataaagtggcgagcgaaggattccagtactctgaccgcagatggtgctttgatggcgagcggaataaccaggttcttgaagagaatatggacgtggaaatttggaccaaggagggggagagaaaaaagctgcgccctcggtggctggatgccagaacgtattccgaccccctcgctctgcgcgaattcaaagagtttgccgctggacggagaagcgtgtccggcgaccttatcctggaaattgggaagctccctcaacacctgacactgcgggcccagaacgctctcgataatcttgtcatgctgcacaactctgagcagggaggcaaagcctaccgccatgcgatggaagagctgcccgacaccatcgagaccctcatgctgcttgccctgattgctgttctcacaggcggggtgaccctgttctttctgagcggaaagggcctcgggaagacatccatcggacttctgtgtgtgacggcctctagcgctctgctctggatggcctccgtcgaaccgcactggatcgccgctagcattatcctggagttctttcttatggtgctgctcattcctgaacccgatagacagcggacccctcaagacaatcagctggcgtatgttgtgatcggcctgctcttcatgattcttacagtcgccgctaacgagatggggctgctggagaccacaaaaaaggatctcggaatcggctacgtggccgccgaaaaccatcagcacgctaccatgctggacgtcgatcttcaccccgcctctgcgtggacgctgtacgccgtggctaccacagttatcacccctatgatgcgccatacaattgagaataccacggccaacatctccctcacagctattgccaatcaagcggccatcctgatgggcctggacaaagggtggcccattagcaagatggatatcggagtgccgctccttgctctgggctgctattctcaggtcaaccctctgaccctcacagccgctgtgctgatgcttgttgcccactacgctattatcgggcccggactgcaggccaaagcgaccagagaagcccagaagcggaccgctgccggcatcatgaagaatcccacagtggacgggattgtcgctatcgatctcgaccctgtggtgtatgatgccaaatttgagaagcaactgggacagattatgctgctcatcctttgtacgtcccagattctgctgatgcgcaccacatgggccctctgcgaaagcatcaccctggcgacaggcccgcttaccacgctgtgggagggctctcccgggaaattctggaacacaaccatcgctgttagcatggccaatattttcagaggatcctacctcgctggcgccgggctggccttttctctgatgaagagcctcggaggcgggcggcgcggaaccggcgctcagggcgagacacttggggaaaaatggaagagacaactgaaccagctgtccaagagcgagttcaatacctataaacggtccggaatcatggaagtcgacagatctgaggccaaggaaggcctcaaacgcggggagacaacgaagcatgcggtgagccggggaaccgccaaactgagatggtttgtggagcgcaaccttgtcaagcctgaaggcaaggttattgacctggggtgtggacggggcggctggtcctactattgcgctgggctcaaaaaggtgacagaggtgaaaggatacaccaagggcgggcccggacacgaagagcctatccccatggccacatacggctggaatctggtcaaactgcattctgggaaggatgtgttctttatgcctccggaaaaatgtgacaccctcctttgcgatattggagagagctcccccaaccctacgatcgaggaaggcagaaccctgcgcgttctgaagatggtggagccctggctccggggcaatcagttctgtatcaagattctgaacccttatatgccctctgtcgtggaaacacttgagagaatgcagcgcaaacacgggggaatgctggttcggaatccgctcagcagaaactccacccacgagatgtactgggtgagctgcggcacagggaatatcgtctctgctgtgaacatgacctcccgcatgctgctgaaccggtttacaatggcccatagaaagcctacctatgaacgcgacgtggatctcggagcgggcacgagacacgtcgccgttgagcccgaagtggctaatctggacattatcgggcaacggattgagaacatcaaaaatgaacataagagcacatggcactacgatgaggacaacccctataaaacctgggcctaccacggatcttatgaggtgaagccttccggcagcgcttcttccatggtcaatggcgtggttcgccttctgaccaagccctgggatgtgattcctatggtcacacagatcgccatgacggacaccacaccgttcgggcagcaaagagtgtttaaagaaaaggttgatacccggacacccagagctaaacggggaaccacacagatcatggaggtgaccgccaagtggctctggggcttcctgagccgcaacaaaaagcctagaatttgtacgcgggaagagtttacccgcaaggtcagatccaatgcggccatcggggctgtgttcgttgacgaaaaccagtggaatagcgccaaagaggctgtggaggacgaacggttttgggatcttgtccatcgcgagagagaactgcacaagcagggaaaatgcgccacatgcgtgtacaacatgatgggcaagcgggagaaaaagctcggggaattcggcaaggccaaaggatctcgcgcgatttggtacatgtggctgggcgctagattcctggagtttgaggccctcgggttcatgaatgaagaccattggtttagccgggagaactccctgtctggagtcgaaggcgaggggcttcacaagctgggatatatcctccgcgatattagcaaaatccccggcgggaatatgtacgccgacgataccgctggctgggacacaagaatcaccgaggatgacctgcaaaacgaagccaagattacggatatcatggagcctgaacatgctcagcttgccacatccattttcaaactgacctatcagaataaggtggttcgggtgcagcgccccgcgaaaaacggaacagtcatggacgtgatctctagacgggatcaaagaggcagcgggcaggtgggaacctacggcctcaacacgtttaccaatatggaggttcagctgattcgccagatggaatccgaggggatcttcctgccgtctgagctcgaaacacctaacctggccgagcgggctcttgactggctggaaaagaatggagccgagagactcaagcgcatggctatcagcggcgatgactgtgtggtcaaacccattgacgatcggtttgccaccgcgctgacagcccttaacgacatggggaaggtgagaaaagatatccctcaatgggaaccctccaagggctggaatgactggcagcaggttcctttctgcagccaccactttcatcagctgattatgaaagatggacgcgagatcgtggtcccctgtcggaaccaagacgagctcgtgggcagagctcgcgtctctcagggggccggatggtccctgcgggaaaccgcttgcctgggcaagagctatgcccagatgtggcaactcatgtacttccacagacgcgatctgcggcttgctgccaatgcgatttgttctgccgtgccggttgactgggtgcctacatccagaaccacgtggagcatccatgctcaccaccagtggatgacaaccgaggatatgctgtccgtctggaaccgggtgtggatcgaagagaatccctggatggaagacaagacccatgtttctagctgggaggaggtgccctatctcgggaaaagagaagatcagtggtgcggatccctgattggccttacagcccgcgccacctgggctacaaacatccaggtcgccattaatcaagtgcggagactgatcgggaacgagaattacctcgactacatgacgagcatgaagcgctttaaaaacgaatctgactccgagggcgcgctgtggtga

SEQ ID NO: 18722 - RNA, 9879 nt, synthetic construct
  misc_feature 1..9879: note = derived and/or modified CDS sequence (opt5) from DENV-1__KJ189359__SS-prME
  source 1..9879: mol_type = other RNA
agcgtgaccatgctgctcatgctgcttcccacagtcctggccttccacctcacgaccagaggcggggagcctcatatgatcgtttccaagcaggaacggggaaaatctctgctttttaagacaagcgctggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggagaagcgctctgtggccctggcccctcatgttgggctcggactggaaacaagaaccgagacgtggatgagctccgaaggcgcttggaaacagattcagcgggtggagacatgggcccttcgccaccccggcttcaccgtcatcgcttttttcctggcccatgcgattgggacatctatcacccagaagggaatcatttttatcctcctgatgcttgtgacccctagcatggccatgagatgcgttggcattgggaaccgggacttcgtggagggactgtccggcgctacatgggtcgatgtggtgctcgaacacgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggccagcacatcccaagaaacctggaatcgccaggacctcctggtcacatttaaaaccgctcacgcgaagaagcaggaggtggttgtgctgggatctcaagaaggcgccatgcacaccgctctcacaggggccacggagattcagaccagcggaacaaccacaatcttcgccggccatctgaaatgcagacttaagatggataaactgaccctcaaggggatgtcctatgtcatgtgtacgggcagcttcaaactggaaaaggaggtggctgagacacagcacggaaccgttctggtgcaggtcaagtacgaaggcaccgacgccccgtgcaaaattcctttttctacacaagatgagaagggggtgacccagaacggacggcttatcacagcgaatcccatcgtgacggacaaagaaaagcctgttaacattgagaccgagccccccttcggcgaatcctatatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcatcaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttacctcggggtgatggtccaggctgattctggatgcgtgattaactggaagggccgggagctgaaatgtgggtccggaatctttgttaccaacgaagtgcacacatggaccgagcaatataagttccaggccgacagccctaagagactgtccgctgccattggcaaagcgtgggaggaaggggtctgcggcatccgctctgccacgcggctcgagaatattatgtggaagcagatcagcaacgaactgaatcatatccttctggagaacgatatgaaatttacagtggtggtcggagacgctaatggcattctcgcccaggggaagaaaatgatcagaccgcaacccatggaacacaagtactcctggaaatcttggggaaaggctaagattatcggcgccgacattcagaacaccaccttcatcatcgatgggcctgacacacccgagtgtcctgatggacagcgcgcctggaatatttgggaggttgaagactatggctttggcgtgttcaccacgaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacactgtggtctaacggagtgctggagtccgagatgatcatcccgaaaatttacggcgggcctatcagccaacataattatcggcccggatactttacccagacggctggcccttggcacctcgggaagctggaacttgatttcgacctgtgcgagggaaccacagttgtggtcgatgaacactgcggcaacagaggcccctctctccggaccacaaccgtgacggggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggatctggcgaagtggattccttcagcctcgggatcctgtgtgtttccatcatgattgaggaggtgatgcggtctagatggagccgcaagatgctgatgaccggaacactcgcggtctttctgcttctgatcatgggccagctcacctggaacgacctgattagactgtgcatcatggtgggcgctaatgcctccgaccggatggggatgggaaccacatatcttgccctgatggctacgttcaagatgcgccctatgtttgccgtgggcctcctgttcagacggctcacctctcgcgaagtcctgcttctgacaattgggctcagcctggttgcgtccgtggagctgcccaactctcttgaagagctgggagatggcctcgctatggggatcatgatgctgaaactcctgaccgaatttcaaccccaccagctttggacaaccctgctcagcctgacgttcgtgaagacaaccctgtcccttgactacgcctggaaaaccacagccatggctctgagcattgtctctctctttcctctgtgtctctccaccacaagccagaagacgacctggctgccggtgcttctgggatctttcggctgcaaacccctgacaatgtttctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttatgtcatcagcggctccagcgccgacctgtctctggaaaaggctgccgaggtgagctgggaacaggaggctgaacattccggggcctctcacagcattctcgttgaggtgcaagatgacggaacaatgaaaatcaaggatgaggaacgggacgataccctgacgattcttctgaaagccaccctcctggctgtctccggcgtgtaccccatgtctatccctgcgacactcttcgtctggtatttctggcagcgcaagaaacagagaagcggcgtgctgtgggacaccccctccccgcctgaggttgaacgggccgtgcttgataatgggatttaccgcatcctgcagagaggactgctcggccggtctcaagtcggggtgggagtttttcaggacggcgtgttccatacaatgtggcacgtcaccagaggggctgtgctgatgtatcagggaaagcgccttgagcccagctgggcctccgtgaagaaagatctgatcagctacggcggcgggtggcggtttcagggatcttggaacacaggcgaggaagttcaagtcattgccgtggagcctgggaagaatcccaaaaacgtgcagacgaccccgggaacattcaagacccctgaaggcgaggtcggggctatcgccctcgactttaaacccggaacctccggcagccctattgtgaatagagaaggcaagatcgttgggctgtacggaaacggcgtggtcacaacgtctgggacctatgtgtccgcgattgctcaggccaaggccagccaagagggacccctccccgagatcgaagacgaggttttcaaaaagcgcaatctgacaattatggatcttcaccctggctccgggaaaacccggagatacctgccggctatcgtgcgcgaagccatcaagcggaaactgagaacactcattctggcgcccacccgcgtcgtggcttctgagatggccgaagcccttaagggcatgcctatccggtatcagacgacagctgttaagagcgagcataccggaagagagattgtggacctgatgtgccacgccacctttacaatgcggctcctgtcccccgtccgcgtgcctaactacaatatgatcattatggatgaagctcatttcaccgaccccgccagcatcgcggccagaggctatatctctacacgggtggggatgggagaggctgccgctatttttatgaccgccacgcctccgggctccgtcgaagccttcccccagagcaacgctgttatccaggatgaggaacgcgacattcctgagagatcttggaatagcgggtacgattggatcacagactttcccggaaaaaccgtgtggttcgtgccttccattaagtctggcaacgatatcgcgaattgtctgcggaaaaacgggaagagagtcatccaactcagccgcaaaacattcgacaccgagtatcagaagacgaagaacaatgattgggactacgtggttaccacagacatttccgaaatgggcgccaactttcgggctgatagagtgatcgacccccgccggtgccttaaaccggtcattctgaaggatggacctgagagagtgatcctggccggccccatgcccgttaccgtggcctctgctgcccagcgccgggggagaattggacgcaatcagaacaaagaaggcgaccaatacgtctatatggggcagcctctcaataacgatgaggaccacgcgcattggacagaggctaagatgctgcttgataatatcaacacccccgaaggaattatccctgccctgttcgagccggaaagagagaaaagcgccgctatcgacggcgaataccggctccgcggggaggccagaaagacatttgtggagctgatgcggcgcggcgatctgcccgtctggctctcctataaggtggcgagcgaaggattccagtactctgacagacggtggtgctttgatggcgagagaaataaccaggttcttgaagagaatatggacgtggaaatttggaccaaagagggggagcgcaagaaactgcggcctagatggctggatgcccgcacgtattccgaccccctcgctctgcgggaattcaaggagtttgccgctggaagacggagcgtgtccggcgaccttatcctggaaattgggaaactccctcaacacctgacactgcgcgcccagaacgctctcgataatcttgtcatgctgcacaactctgagcagggaggcaaggcctacagacatgcgatggaagagctgcccgacaccatcgagaccctcatgctgcttgccctgattgctgttctcacaggcggggtgaccctgttctttctgagcggaaaaggcctcgggaagacatccatcggacttctgtgtgtgacggcctctagcgctctgctctggatggcctccgtcgaaccgcactggatcgccgctagcattatcctggagttctttcttatggtgctgctcattcctgaacccgatcggcagcgcacccctcaagacaatcagctggcgtatgttgtgatcggcctgctcttcatgattcttacagtcgccgctaacgagatggggctgctggagaccacaaagaaagatctcggaatcggctacgtggccgccgaaaaccatcagcacaccacgatgctggacgtcgatcttcaccccgcttctgcctggaccctgtacgcggtggccacaaccgttatcacacctatgatgagacataccattgagaatacgacagctaacatctccctcaccgccattgctaatcaagccgcgatcctgatgggcctggacaaggggtggcccattagcaaaatcgatattggagtgccgctccttgccctgggctgctattctcaggtcaaccctctgacactcaccgctgccgtgctgatgcttgttgctcactacgccatcatcgggcccggactgcaggctaaggccacccgggaagcgcagaaacgcacagccgctggcattatgaagaatcccacggtggacgggatcgtcgccattgatctcgaccctgtggtgtatgatgctaagtttgagaaacaactgggacagatcatgctgctcattctttgtacctcccagatcctgctgatgagaacaacctgggccctctgcgaaagcatcacactggccaccggcccgcttacgacactgtgggagggctctcccgggaagttctggaacaccaccattgcggttagcatggctaatatcttccggggatcctacctcgccggcgctgggctggccttttctctgatgaaaagcctcggaggcgggcgcagaggaacaggcgcccagggcgagacccttggggaaaagtggaaacggcaactgaaccagctgtccaagagcgagttcaatacatataagagatccggaattatggaagtcgaccgctctgaggctaaagaaggcctcaagcggggggagacgaccaaacatgccgtgagcagaggaacagcgaagctgcgctggtttgtggagcggaaccttgtcaaacctgaaggcaaggttatcgacctggggtgtggaagaggcggctggtcctactattgcgccgggctcaagaaagtgaccgaggtgaagggatacacaaaaggcgggcccggacacgaagagcctattcccatggctacctacggctggaatctggtcaagctgcattctgggaaagatgtgttctttatgcctccggaaaagtgtgacacgctcctttgcgatatcggagagagctcccccaaccctaccatcgaggaaggccgcacactgcgggttctgaaaatggtggagccctggctcagaggcaatcagttctgtattaagatcctgaacccttatatgccctctgtcgtggaaacccttgagcgcatgcagcggaagcacgggggaatgctggttagaaatccgctcagccgcaactccacacacgagatgtactgggtgagctgcggcaccgggaatattgtctctgccgtgaacatgacatcccggatgctgctgaacagatttaccatggctcatcgcaaacctacgtatgaaagagacgtggatctcggagccggcacacggcacgtcgcggttgagcccgaagtggccaatctggacatcattgggcaacgcatcgagaacattaagaatgaacataaaagcacctggcactacgatgaggacaacccctataagacctgggcttaccacggatcttatgaggtgaaaccttccggcagcgcctcttccatggtcaatggcgtggttagacttctgacaaagccctgggatgtgatccctatggtcacgcagatcgctatgaccgacacaaccccgttcgggcagcaacgggtgtttaaggaaaaagttgatacaagaaccccccgggccaagcgcggaacaacccagattatggaggtgacggctaaatggctctggggcttcctgagcagaaacaagaaacctcggatctgtacccgcgaagagtttacaagaaaggtccggtccaatgccgcgattggggccgtgttcgttgacgaaaaccagtggaataccgctaaggaggccgtggaggacgaacgcttttgggatcttgtccatagagagcgggaactgcacaaacagggaaagtgcgctacatgcgtgtacaacatgatgggcaaacgcgagaagaaactcggggaattcggcaaggccaagggaagcagagccatctggtacatgtggctgggcgcgcggttcctggagtttgaggctctcgggttcatgaatgaagaccattggttttctcgcgagaacagcctgtccggagtcgaaggcgaggggcttcacaaactgggatatattctcagagatatctctaagatccccggcgggaatatgtacgccgacgataccgccggctgggacacgcggattacagaggatgacctgcaaaacgaagctaaaatcaccgatattatggagcctgaacatgcccttctggctacaagcatcttcaagctcacctatcagaataaagtggttcgcgtgcagagacccgccaagaacggaacggtcatggacgtgatttcccggagagatcagcgcggctctgggcaagtgggaacctacggcctgaacacatttaccaatatggaggttcagctgatccggcagatggaaagcgaggggatcttcctcccgtccgagctggaaacacctaaccttgcggagagagccctggactggctcgaaaaacacggagctgagcgcctgaagcggatggccatttctggcgatgactgtgtggtcaagcccatcgacgatagatttgctaccgcccttacagcgctgaatgacatggggaaagtgcgcaaggatattcctcagtgggaacccagcaaaggctggaacgactggcaacaggttcctttctgctcccaccattttcaccagctcatcatgaaggatggacgggagattgtggtcccctgtagaaatcaggacgagctggtgggccgcgcccgggtcagccaaggggctggatggtctctgagagaaaccgcctgcctcggcaaatcctatgctcagatgtggcagctgatgtacttccatcgccgggatcttagactggccgctaacgccatctgtagcgcggtgccggttgactgggtgcctacgtctcggacaacctggtccatccacgcccaccatcaatggatgaccacagaggatatgctcagcgtctggaatagagtgtggattgaagagaacccctggatggaagacaagacccacgtttcctcttgggaggaggtgccctatctggggaagcgcgaagatcagtggtgcggaagccttatcggcctgacagctcgggccacgtgggccaccaatattcaggtcgctatcaaccaggtgagacgcctcattgggaatgagaactacctggactacatgacatccatgaaaagatttaagaatgaaagcgactctgagggcgccctgtggtga

SEQ ID NO: 18723 - RNA, 9879 nt, synthetic construct
  misc_feature 1..9879: note = derived and/or modified CDS sequence (opt5) from DENV-1__KJ189360__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcagatctttgggaccgcctacggagtgctgttcagcggcgtttcctggacgatgaaaatcgggattggcatccttctgacctggctcggactgaatagccgctctacatccctgagcatgacctgtattgctgtgggcatggtcacactttacctcggggtgatggttcaggccgattctggatgcgtgatcaactggaagggccgggagctgaaatgtgggtccggaatttttgtcaccaacgaagtgcacacatggaccgagcaatataagttccaggctgacagccctaagagactgtccgccgcgatcggcaaagcctgggaggaaggggtttgcggcattcgctctgctacgcggctcgagaatatcatgtggaagcagatcagcaacgaactgaatcatattcttctggagaacgatatgaaatttacagtggtcgtgggagacgccaatggcatcctcgctcaggggaagaaaatgattagaccgcaacccatggaacacaagtactcctggaaatcttggggaaaggccaagatcattggcgccgacatccagaacaccaccttcatcattgatgggcctgacacacccgagtgtcctgatggacagcgcgcttggaatatctgggaggtggaagactatggctttggcgtcttcaccacgaacatttggctgaaactgcgggatagctacacacagatgtgcgaccacagacttatgtccgcggccatcaaggatagcaaagctgttcatgccgacatggggtattggattgagtctgaaaagaatgagacctggaaactcgcccgcgcttccttcatcgaagtgaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgacctgtgcgagggaaccacagtcgtggttgatgaacactgcggcaacagaggcccctctctccggaccacaaccgtgacggggaaaatcattcatgagtggtgttgccgcagctgtacactgcctcccctgagatttcggggagaggacggctgctggtacgggatggaaatcagaccggtcaaggagaaagaagagaatcttgtgcgctccatggttagcgcgggatctggcgaagtggattccttcagcctcgggatcctgtgtgtctccattatgatcgaggaggtgatgcggtctagatggagccgcaagatgctgatgaccggaacactcgctgtttttctgcttctgattatgggccagctcacctggaacgacctgatcagactgtgcattatggtgggcgccaatgcctccgaccggatggggatgggaaccacatatcttgctctgatggccacgttcaagatgcgccctatgtttgcggtcggcctcctgttcagacggctcacctctcgcgaagtgctgcttctgacaatcgggctcagcctggtggcttccgtcgagctgcccaactctcttgaagaactgggagatggcctcgccatggggattatgatgctgaaactcctgaccgaatttcaaccccaccagctttggacaaccctgctcagcctgacgttcgttaagacaaccctgtcccttgactacgcctggaaaaccacagctatggccctgagcatcgtgtctctctttcctctgtgtctctccaccacaagccagaagacgacctggctgccggtgcttctgggatctttcggctgcaaacccctgacaatgtttctcatcaccgagaacaagatttggggcagaaagtcctggcctctgaatgaggggatcatggctattggaatcgtcagcattcttctgtcttccctcctgaaaaacgatgtgcccctcgccggccctctgatcgccgggggaatgcttatcgcctgttatgttattagcggctccagcgctgacctgtctctggaaaaggccgctgaggtgagctgggaacaggaggccgaacattccggggcctctcacagcatcctcgtcgaggtgcaagatgacggaacaatgaaaattaaggatgaggaacgggacgataccctgacgatccttctgaaagctaccctcctggcggtttccggcgtgtaccccatgtctattcctgccacactcttcgtctggtatttctggcagaagaaaaagcagcgcagcggcgtgctgtgggacaccccctccccgcctgaggtcgaaagagctgtgcttgataatgggatctaccggatcctgcagcgcggactgctcggcagatctcaagttggggtgggagtctttcaggacggcgtgttccatacaatgtggcacgttaccagaggggcggtgctgatgtatcagggaaagcggcttgagcccagctgggcctccgtcaaaaaggatctgattagctacggcggcgggtggcgctttcagggatcttggaacacaggcgaggaagtgcaagtgatcgctgttgagcctgggaaaaatcccaagaacgtccagacgaccccgggaacattcaaaacccctgaaggcgaggtgggggccattgcgctcgactttaagcccggaacctccggcagccctatcgtgaatcgggaaggcaagattgtcgggctgtacggaaacggcgtggttacaacgtctgggacctatgtgtccgctatcgcccaggccaaagctagccaagagggacccctccccgagattgaagacgaggtcttcaagaaaagaaatctgacaatcatggatcttcaccctggctccgggaagacccgccggtacctgccggccatcgtgagagaagcgattaaacgcaagctgcggacactcatcctggctcccaccagagttgtggcctctgagatggccgaagctcttaagggcatgcctattcgctatcagacgacagccgtcaaaagcgagcataccggacgggagatcgtggacctgatgtgccacgctacctttacaatgagactcctgtcccccgttcgggtgcctaactacaatatgattatcatggatgaagcccatttcaccgaccccgcgagcatcgccgctcgcggctatatttctacaagagtcgggatgggagaggccgctgccatctttatgaccgccacgcctccgggctccgtggaggctttcccccagagcaacgcggtgattcaggatgaggaacgggacatccctgagcgctcttggaatagcgggtacgattggattacagactttcccggaaagaccgtctggttcgttccttccatcaaatctggcaacgatatcgccaattgtctgagaaagaacgggaaacgggtgattcaactcagcagaaagacattcgacaccgagtatcagaagacgaaaaacaatgattgggactacgtggtcaccacagacatctccgaaatgggcgctaactttcgcgccgatcgggtgattgaccccagacgctgccttaagccggttatcctgaaagatggacctgagcgggtgattctggccggccccatgcccgtcaccgctgcctctgcggctcagagacgcgggcggatcggaagaaatcagaacaaggaaggcgaccaatacgtgtatatggggcagcctctcaataacgatgaggaccacgcccattggacagaggccaaaatgctgcttgataatattaacacccccgaaggaatcatccctgctctgttcgagccggaacgcgaaaagagcgccgcgattgacggcgaatacagactcagaggggaagcccgcaagacatttgttgagctgatgagacggggcgatctgcccgtgtggctctcctataaagtcgctagcgaaggattccagtactctgaccgcagatggtgctttgatggcgagcggaataaccaggtgcttgaagagaatatggacgtcgaaatctggaccaaggagggggagcgcaagaagctgcgccctcggtggctggatgccagaacgtattccgaccccctcgctctgcgcgagttcaaagagtttgccgctggacggagaagcgtgtccggcgaccttattctggaaatcgggaagctccctcaacacctgacactgcgggcccagaacgcgctcgataatcttgttatgctgcacaactctgagcagggaggcaaagcctaccgccatgctatggaggaactgcccgacaccattgagaccctcatgctgcttgccctgatcgctgtgctcacaggcggggtgaccctgttctttctgagcggaaagggcctcgggaagacatccatcggacttctgtgtgtcacggcctctagcgccctgctctggatggcttccgttgaaccgcactggattgcggccagcatcattctggagttctttcttatggtgctgctcatccctgaacccgatagacagcggacccctcaagacaatcagctggcttatgtggtcattggcctcctgttcatgatccttacagtggccgccaacgagatggggctgctggagaccaccaaaaaggatctcggaatcggctacgttgctgccgaaaaccatcagcacgcgaccatgctggacgtggatcttcaccccgcctctgcttggacgctgtacgccgtcgctaccacagtgattacccctatgatgcgccatacaatcgagaataccacggccaacatttccctcacagcgatcgccaatcaagctgccattctgatgggcctggacaaagggtggcccatcagcaagatggatattggagtcccgctccttgctctgggctgctattctcaggtgaaccctctgaccctcacagccgctgttctgatgcttgtggcccactacgcgatcatcgggcccggactgcaggccaaagctaccagagaagcccagaagcggaccgctgccggcattatgaagaatcccacagtcgacgggatcgtggccattgatctcgaccctgttgtgtatgatgcgaaatttgagaagcaactgggacagatcatgctgctcattctttgtacgtcccagatcctgctgatgcgcaccacatgggctctctgcgaaagcatcaccctggccacaggcccgcttaccacgctgtgggagggctctcccgggaaattctggaacacaaccattgctgtcagcatggccaatatcttcagaggatcctacctcgccggcgctgggctggccttttctctgatgaaaagcctcggaggcgggcggcgcggaaccggcgcgcagggcgagacacttggggaaaaatggaagagacaactgaaccagctgtccaagagcgagttcaatacctataaacggtccggaattatggaagtggacagatctgaggccaaggaaggcctcaaacgcggggagacaacgaagcatgctgtgagccggggaaccgccaaactgagatggtttgttgagcgcaaccttgtcaagcctgaaggcaaggtgatcgacctggggtgtggacggggcggctggtcctactattgcgctgggctcaaaaaggtgacagaggtcaaaggatacaccaagggcgggcccggacacgaggaacctattcccatggccacatacggctggaatctggttaaactgcattctgggaaggatgtgttctttatgcctccggaaaaatgtgacaccctcctttgcgatatcggagagagctcccccaaccctacgatcgaggaaggcagaaccctgcgcgtgctgaagatggtcgagccctggctccggggcaatcagttctgtattaagatcctgaacccttatatgccctctgtggttgaaacacttgagagaatgcagcgcaaacacgggggaatgctggtgcggaatccgctcagcagaaactccacccacgagatgtactgggtcagctgcggcacagggaatattgtgtctgcggttaacatgacctcccgcatgctgctgaaccggtttacaatggcccatagaaagcctacctatgaacgcgacgtggatctcggagctggcacgagacacgtcgccgtggagcccgaagtggctaatctggacatcattgggcaacggatcgagaacattaaaaatgaacataagagcacatggcactacgatgaggacaacccctataaaacctgggcctaccacggatcttatgaggtcaagccttccggcagcgcttcttccatggttaatggcgtggtgcgccttctgaccaagccctgggatgtcatccctatggtgacacagatcgccatgacggacaccacaccgttcgggcagcaaagagtttttaaagaaaaggtggatacccggacacccagagcgaaacggggaaccacacagattatggaggtcaccgccaagtggctctggggcttcctgagccgcaacaaaaagcctagaatctgtacgcgggaagagtttacccgcaaggtgagatccaatgctgccattggggctgttttcgtggacgaaaaccagtggaatagcgccaaagaggccgtcgaggacgaacggttttgggatcttgtgcatcgcgagagagaactgcacaagcagggaaaatgcgcgacatgcgtttacaacatgatgggcaagcgggagaaaaagctcggggagttcggcaaggctaaaggatctcgcgccatctggtacatgtggctgggcgccagattcctggagtttgaggctctcgggttcatgaatgaagaccattggtttagccgggagaactccctgtctggagtggaaggcgaggggcttcacaagctgggatatattctccgcgatatcagcaaaatccccggcgggaatatgtacgccgacgataccgctggctgggacacaagagtcaccgaggatgacctgcaaaacgaagccaagattacggatatcatggagcctgaacatgcgcttctggccacatccattttcaaactcacctatcagaataaggtggtccgggtgcagcgccccgctaaaaacggaacagttatggacgtgatctctagacgggatcagagaggcagcgggcaagtcggaacctacggcctgaacacgtttaccaatatggaggtgcagctgattcgccagatggaatccgaggggatcttcctcccgtctgagctggaaacacctaaccttgccgagcgggctctggactggctcgaaaagcacggagccgagagactgaagcgcatggcgatcagcggcgatgactgtgtggttaaacccattgacgatcggtttgccaccgctcttacagccctgaatgacatggggaaggtgagaaaagatatccctcagtgggaaccctccaagggctggaacgactggcaacaggtccctttctgcagccaccattttcaccagctcattatgaaagatggacgcgagatcgtggttccctgtcggaatcaggacgagctggtgggcagagctcgcgtctctcaaggggccggatggtccctgcgggaaaccgcttgcctcggcaagagctatgcccagatgtggcagctgatgtacttccatagacgcgatcttcggctggcggccaacgctatttgttctgccgtgccggtcgactgggtgcctacatccagaaccacgtggagcatccacgcccaccatcaatggatgacaaccgaggatatgctctccgtttggaatcgggtgtggatcgaagagaacccctggatggaaaataagacccacgtctctagctgggaggaggtgccctatctggggaaaagagaagaccagtggtgcggatcccttattggcctgacagctcgcgccacctgggcgacaaacatccaggttgctattaatcaggtgcggagactcatcgggaacgagaattacctggattacatgacgagcatgaagcgctttaaaaacgaatctgactccgagggcgccctgtggtga

SEQ ID NO: 18724 - RNA, 9879 nt, synthetic construct
  misc_feature 1..9879: note = derived and/or modified CDS sequence (opt5) from DENV-1__KJ189361__SS-prME
  source 1..9879: mol_type = other RNA
agcgtgacaatgctgctcatgctgcttcccacagccatggctttccacctgacgacccggggcggggagcctcatatgatcgtgtccaagcaggaacggggaaagtctctcctgtttaagacaagcgccggcgttaacatgtgcacccttattgcgatggacctgggggagctctgtgaagatacaatgacctacaaatgccccagaatcacagaggctgaacccgacgatgtggactgttggtgcaatgccaccgatacgtgggtgacctatggaacatgttcccaaaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgcctttttccttgcgcatgccattgggacatctatcacccagaagggaatcatttttatcctgctcatgctggtcacccctagcatggctatgagatgcgtgggcattgggaaccgggacttcgttgagggactttccggcgccacatgggtggatgtcgtgctggaacacgggagctgtgtgacgaccatggctaagaataaacccacactcgacatcgagctgctgaagaccgaagtcacaaaccctgccgttctccgcaaactgtgcattgaggcgaagatctctaataccacgacagattccagatgtccgacccaaggagaagccacccttgtggaggagcaggacgctaactttgtgtgccggcgcacattcgtcgatagaggctggggcaatgggtgtggactgtttggcaaagggagcctcctgacctgcgccaagttcaagtgcgtgacaaaacttgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctcacagattacggcgccctgaccctggactgtagcccccggacaggcctcgactttaacgagatggtgctgcttaccatgaaggagaaatcttggctggtccataagcagtggttcctcgatctgcctcttccctggacgtccggggctagcacatcccaagaaacctggaatcgccaggacctgctcgtgacatttaaaaccgcgcacgccaagaagcaggaggtcgtggttctgggatctcaagaaggcgctatgcacaccgccctgacaggggccacggagattcagaccagcggaacaaccacaatcttcgctggccatctcaaatgcagactgaagatggataaacttaccctgaaggggatgtcctatgtgatgtgtacgggcagcttcaaactcgaaaaggaggtcgccgagacacagcacggaaccgtgctggttcaggtgaagtacgaaggcaccgacgcgccgtgcaaaattcctttttctacacaagatgagaagggggtcacccagaacggacggctgatcacagctaatcccatcgtgacggacaaagaaaagcctgtgaacattgagaccgagccgcccttcggcgaatcctatatcgttgtcggggccggagagaaagcccttaagctcagctggtttaagagaggctctagcattgggaaaatgttcgaagctacagcccgcggcgctcggagaatggccatcctgggagataccgcgtgggactttggctccattgggggagtgttcacatctgtgggcaagctggtccatcagatctttgggaccgcctacggagtcctgttcagcggcgtttcctggacgatgaaaatcgggattggcatcctgcttacctggctgggactcaatagccgctctacatccctgagcatgacctgtattgctgtgggcatggtcacactgtaccttggggtgatggttcaggccgattctggatgcgtgatcaactggaagggccgggagctcaaatgtgggtccggaatttttgtcaccaacgaagtgcacacatggaccgagcaatataagttccaggctgacagccctaagagactgtccgccgcgatcggcaaagcctgggaggaaggggtttgcggcattcgctctgctacgcggctggagaatatcatgtggaagcagatcagcaacgaactcaatcatattctgcttgagaacgatatgaaatttacagtggtcgtgggagacgccaatggcatcctggctcaggggaagaaaatgattagaccgcaacccatggaacacaagtactcctggaaatcttggggaaaggccaagatcattggcgccgacatccagaacaccaccttcatcattgatgggcctgacacacccgagtgtcctgatggacagcgcgcttggaatatctgggaggtggaagactatggctttggcgtcttcaccacgaacatttggctcaaactgcgggatagctacacacagatgtgcgaccacagactgatgtccgcggccatcaaggatagcaaagctgttcatgccgacatggggtattggattgagtctgaaaagaatgagacctggaaacttgcccgcgcttccttcatcgaagtgaagacatgtacctggcccaagagccacacactctggtctaacggagtgctggagtccgagatgatcattccgaaaatctacggcgggcctattagccaacataattatcggcccggatactttacccagacggccggcccttggcacctggggaagctcgaactggatttcgacctttgcgagggaaccacagtcgtggttgatgaacactgcggcaacagaggcccctctctgcggaccacaaccgtgacggggaaaatcattcatgagtggtgttgccgcagctgtacactccctcccctgagatttcggggagaggacggctgctggtacgggatggaaatcagaccggtcaaggagaaagaagagaatctggtgcgctccatggttagcgcgggatctggcgaagtggattccttcagccttgggatcctctgtgtctccattatgatcgaggaggtgatgcggtctagatggagccgcaagatgctgatgaccggaacactggctgtttttctcctgcttattatgggccagctgacctggaacgacctcatcagactgtgcattatggtgggcgccaatgcctccgaccggatggggatgggaaccacatatctggctcttatggccacgttcaagatgcgccctatgtttgcggtcggcctcctcttcagacggctgacctctcgcgaagtgctcctgcttacaatcgggctgagcctcgtggcttccgtcgagctgcccaactctctggaagaacttggagatggcctggccatggggattatgatgctcaaactgctcaccgaatttcaaccccaccagctgtggacaacccttctgagcctcacgttcgttaagacaaccctgtccctggactacgcctggaaaaccacagctatggcccttagcatcgtgtctctgtttcctctctgtctgtccaccacaagccagaagacgacctggctcccggtgctgcttggatctttcggctgcaaacccctgacaatgtttctgatcaccgagaacaagatttggggcagaaagtcctggcctctcaatgaggggatcatggctattggaatcgtcagcattctgctttcttccctgctcaaaaacgatgtgcccctggccggccctctcatcgccgggggaatgctgatcgcctgttatgttattagcggctccagcgctgacctttctctggaaaaggccgctgaggtgagctgggaacaggaggccgaacattccggggcctctcacagcatcctggtcgaggtgcaagatgacggaacaatgaaaattaaggatgaggaacgggacgataccctcacgatcctgcttaaagctaccctgctcgcggtttccggcgtgtaccccatgtctattcctgccacactgttcgtctggtatttctggcagaagaaaaagcagcgcagcggcgtgctctgggacaccccctccccgcctgaggtcgaaagagctgtgctggataatgggatctaccggatccttcagcgcggactgctgggcagatctcaagttggggtgggagtctttcaggacggcgtgttccatacaatgtggcacgttaccagaggggcggtgctcatgtatcagggaaagcggctggagcccagctgggcctccgtcaaaaaggatcttattagctacggcggcgggtggcgctttcagggatcttggaacacaggcgaggaagtgcaagtgatcgctgttgagcctgggaaaaatcccaagaacgtccagacgaccccgggaacattcaaaacccctgaaggcgaggtgggggccattgcgctggactttaagcccggaacctccggcagccctatcgtgaatcgggaaggcaagattgtcgggctctacggaaacggcgtggttacaacgtctgggacctatgtgtccgctatcgcccaggccaaagctagccaagagggacccctgcccgagattgaagacgaggtcttcaagaaaagaaatctcacaatcatggatctgcaccctggctccgggaagacccgccggtaccttccggccatcgtgagagaagcgattaaacgcaagctgcggacactgatcctcgctcccaccagagttgtggcctctgagatggccgaagctctgaagggcatgcctattcgctatcagacgacagccgtcaaaagcgagcataccggacgggagatcgtggaccttatgtgccacgctacctttacaatgagactgctctcccccgttcgggtgcctaactacaatatgattatcatggatgaagcccatttcaccgaccccgcgagcatcgccgctcgcggctatatttctacaagagtcgggatgggagaggccgctgccatctttatgaccgccacgcctccgggctccgtggaggctttcccccagagcaacgcggtgattcaggatgaggaacgggacatccctgagcgctcttggaatagcgggtacgattggattacagactttcccggaaagaccgtctggttcgttccttccatcaaatctggcaacgatatcgccaattgtctgagaaagaacgggaaacgggtgattcaactgagcagaaagacattcgacaccgagtatcagaagacgaaaaacaatgattgggactacgtggtcaccacagacatctccgaaatgggcgctaactttcgcgccgatcgggtgattgaccccagacgctgcctcaagccggttatccttaaagatggacctgagcgggtgattctggccggccccatgcccgtcaccgctgcctctgcggctcagagacgcgggcggatcggaagaaatcagaacaaggaaggcgaccaatacgtgtatatggggcagcctctgaataacgatgaggaccacgcccattggacagaggccaaaatgctcctggataatattaacacccccgaaggaatcatccctgctcttttcgagccggaacgcgaaaagagcgccgcgattgacggcgaatacagactgagaggggaagcccgcaagacatttgttgagctcatgagacggggcgatctgcccgtgtggctgtcctataaagtcgctagcgaaggattccagtactctgaccgcagatggtgctttgatggcgagcggaataaccaggtgctcgaagagaatatggacgtcgaaatctggaccaaggagggggagcgcaagaaacttcgccctcggtggctggatgccagaacgtattccgaccccctggctctccgcgagttcaaagagtttgccgctggacggagaagcgtgtccggcgacctgattcttgaaatcgggaagctgcctcaacacctcacactgcgggcccagaacgcgctggataatctcgttatgcttcacaactctgagcagggaggcaaagcctaccgccatgctatggaggaactgcccgacaccattgagaccctgatgctcctggcccttatcgctgtgctgacaggcggggtgaccctcttctttctgagcggaaagggcctggggaagacatccatcggactcctttgtgtcacggcctctagcgccctgctgtggatggcttccgttgaaccgcactggattgcggccagcatcattctcgagttctttctgatggtgcttctgatccctgaacccgatagacagcggacccctcaagacaatcagctcgcttatgtggtcattggcctgctgttcatgatcctcacagtggccgccaacgagatggggcttctggagaccaccaagaaggatctgggaatcggctacgttgctgccgaaaaccatcagcacgcgaccatgctcgacgtggatctgcaccccgcctctgcttggacgctttacgccgtcgctaccacagtgattacccctatgatgcgccatacaatcgagaataccacggccaacatttccctgacagcgatcgccaatcaagctgccattctcatgggcctggacaaagggtggcccatcagcaagatggatattggagtcccgctgctcgctcttggctgctattctcaggtgaaccctctgaccctgacagccgctgttctcatgctggtggcccactacgcgatcatcgggcccggacttcaggccaaagctaccagagaagcccagaagcggaccgctgccggcattatgaagaatcccacagtcgacgggatcgtggccattgatctggaccctgttgtgtatgatgcgaaatttgagaagcaactcggacagatcatgctgctgattctctgtacgtcccagatccttctgatgcgcaccacatgggctctgtgcgaaagcatcaccctcgccacaggcccgctgaccacgctttgggagggctctcccgggaaattctggaacacaaccattgctgtcagcatggccaatatcttcagaggatcctacctggccggcgctgggctcgccttttctctgatgaaaagcctgggaggcgggcggcgcggaaccggcgcgcagggcgagacactcggggaaaaatggaagagacaacttaaccagctgtccaagagcgagttcaatacctataaacggtccggaattatggaagtggacagatctgaggccaaggaaggcctgaaacgcggggagacaacgaagcatgctgtgagccggggaaccgccaaactcagatggtttgttgagcgcaacctggtcaagcctgaaggcaaggtgatcgaccttgggtgtggacggggcggctggtcctactattgcgctgggctgaaaaaggtgacagaggtcaaaggatacaccaagggcgggcccggacacgaggaacctattcccatggccacatacggctggaatctcgttaaactgcattctgggaaggatgtgttctttatgcctccggaaaaatgtgacaccctgctctgcgatatcggagagagctcccccaaccctacgatcgaggaaggcagaacccttcgcgtgctgaagatggtcgagccctggctgcggggcaatcagttctgtattaagatcctcaacccttatatgccctctgtggttgaaacactggagagaatgcagcgcaaacacgggggaatgcttgtgcggaatccgctgagcagaaactccacccacgagatgtactgggtcagctgcggcacagggaatattgtgtctgcggttaacatgacctcccgcatgctcctgaaccggtttacaatggcccatagaaagcctacctatgaacgcgacgtggatctgggagctggcacgagacacgtcgccgtggagcccgaagtggctaatctcgacatcattgggcaacggatcgagaacattaaaaatgaacataagagcacatggcactacgatgaggacaacccctataaaacctgggcctaccacggatcttatgaggtcaagccttccggcagcgcttcttccatggttaatggcgtggtgcgcctgcttaccaagccctgggatgtcatccctatggtgacacagatcgccatgacggacaccacaccgttcgggcagcaaagagtttttaaagaaaaggtggatacccggacacccagagcgaaacggggaaccacacagattatggaggtcaccgccaagtggctgtggggcttcctcagccgcaacaaaaagcctagaatctgtacgcgggaagagtttacccgcaaggtgagatccaatgctgccattggggctgttttcgtggacgaaaaccagtggaatagcgccaaagaggccgtcgaggacgaacggttttgggatctggtgcatcgcgagagagaacttcacaagcagggaaaatgcgcgacatgcgtttacaacatgatgggcaagcgggagaaaaagctgggggagttcggcaaggctaaaggatctcgcgccatctggtacatgtggctcggcgccagattcctggagtttgaggctctggggttcatgaatgaagaccattggtttagccgggagaactccctctctggagtggaaggcgaggggctgcacaaacttggatatattctgcgcgatatcagcaaaatccccggcgggaatatgtacgccgacgataccgctggctgggacacaagagtcaccgaggatgacctccaaaacgaagccaagattacggatatcatggagcctgaacatgcgctgcttgccacatccattttcaaactgacctatcagaataaggtggtccgggtgcagcgccccgctaaaaacggaacagttatggacgtgatctctagacgggatcagagaggcagcgggcaagtcggaacctacggcctcaacacgtttaccaatatggaggtgcagctgattcgccagatggaatccgaggggatcttcctgccgtctgagctcgaaacacctaacctggccgagcgggctcttgactggctggaaaagcacggagccgagagactcaagcgcatggcgatcagcggcgatgactgtgtggttaaacccattgacgatcggtttgccaccgctctgacagcccttaatgacatggggaaggtgagaaaagatatccctcagtgggaaccctccaagggctggaacgactggcaacaggtccctttctgcagccaccattttcaccagctgattatgaaagatggacgcgagatcgtggttccctgtcggaatcaggacgagctcgtgggcagagctcgcgtctctcaaggggccggatggtccctgcgggaaaccgcttgcctgggcaagagctatgcccagatgtggcagctcatgtacttccatagacgcgatctgcggcttgcggccaacgctatttgttctgccgtgccggtcgactgggtgcctacatccagaaccacgtggagcatccacgcccaccatcaatggatgacaaccgaggatatgctgtccgtttggaatcgggtgtggatcgaagagaacccctggatggaagacaagacccacgtctctagctgggaggaggtgccctatctcgggaaaagagaagatcagtggtgcggatccctgattggccttacagctcgcgccacctgggcgacaaatatccaggttgctattaaccaggtgcggagactgatcgggaatgagaactacctcgactacatgacgagcatgaagcgctttaaaaatgaatctgactccgagggcgccctgtggtga

SEQ ID NO: 18725 - RNA, 9879 nt, synthetic construct
  misc_feature 1..9879: note = derived and/or modified CDS sequence (opt5) from DENV-1__KJ189362__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacactcgtcgatagaggctggggcaatgggtgtggactgttcggcaaagggagccttctgacctgcgccaagtttaagtgcgtgacaaaactcgaaggaaagattgttcagtacgagaacctgaaatattctgtgatcgtcacggtgcacaccggcgaccagcatcaagttgggaatgaaacaaccgagcacggaacaatcgctaccattacgccccaggcccctacctccgaaatccagctgacagattacggcgccctcaccctggactgtagcccccggacaggccttgacttcaacgagatggtgctgctcaccatgaaggagaaatcttggctggtccataagcagtggtttcttgatctgcctctcccctggacgtccggggctagcacatcccaagaaacctggaatcgccaggacctgctggtgacattcaaaaccgcgcacgccaagaagcaggaggtcgtggttctcggatctcaagaaggcgctatgcacaccgccctgacaggggccacggagattcagaccagcggaacaaccacaatctttgctggccatcttaaatgcagactgaagatggataaactcaccctgaaggggatgtcctatgtgatgtgtacgggcagcttcaaactggaaaaggaggtcgccgagacacagcacggaaccgtgcttgttcaggtgaagtacgaaggcaccgacgcgccgtgcaaaattcctttctctacacaagatgagaaggggatgacccagaacggacggctcatcacagctaatcccatcgtcacggacaaagaaaagcctgtgaacattgagaccgagcccccctttggcgaatcctatatcgtggttggggccggagagaaagccctgaagctgagctggttcaagagaggctctagcattgggaaaatgtttgaagctacagcccgcggcgctcggagaatggccatcctcggagataccgcgtgggacttcggctccattgggggagtctttacatctgtgggcaagctggtgcatcagatcttcgggaccgcctacggagtcctttttagcggcgtgtcctggacgatgaaaatcgggattggcatcctgctcacctggctgggactgaatagccgctctacatcccttagcatgacctgtattgctgttggcatggtgacactctacctgggggtcatggtgcaggccgattctggatgcgttatcaactggaagggccgggagctgaaatgtgggtccggaattttcgtgaccaacgaagtccacacatggaccgagcaatataagtttcaggctgacagccctaagagactctccgccgcgatcggcaaagcctgggaggaaggggtgtgcggcattcgctctgctacgcggctggagaatatcatgtggaagcagatcagcaacgaacttaatcatattctgctcgagaacgatatgaaattcacagttgtggtcggagacgccaatggcatcctggctcaggggaagaaaatgattagaccgcaacccatggaacacaagtactcctggaaatcttggggaaaggccaagatcattggcgccgacatccagaacaccacctttatcattgatgggcctgacacacccgagtgtcctgatggacagcgcgcttggaatatctgggaggtggaagactatggcttcggcgtgtttaccacgaacatttggctgaaacttcgggatagctacacacagatgtgcgaccacagactcatgtccgcggccatcaaggatagcaaagctgtccatgccgacatggggtattggattgagtctgaaaagaatgagacctggaaactggcccgcgcttccttcatcgaagttaagacatgtacctggcccaagagccacacactgtggtctaacggagtgctcgagtccgagatgatcattccgaaaatctacggcgggcctattagccaacataattatcggcccggatacttcacccagacggccggcccttggcacctggggaagcttgaactggattttgacctctgcgagggaaccacagtggtcgtggatgaacactgcggcaacagaggcccctctctgcggaccacaaccgttacggggaaaatcattcatgagtggtgttgccgcagctgtacactgcctccccttagattccggggagaggacggctgctggtacgggatggaaatcagaccggtgaaggagaaagaagagaatctcgtccgctccatggtgagcgcgggatctggcgaagttgattcctttagcctggggatcctgtgtgtgtccattatgatcgaggaggtcatgcggtctagatggagccgcaagatgctcatgaccggaacactggctgtgttccttctgctcattatgggccagctgacctggaacgacctgatcagactttgcattatggttggcgccaatgcctccgaccggatggggatgggaaccacatatctggctctcatggccacgtttaagatgcgccctatgttcgcggtgggcctgctctttagacggctgacctctcgcgaagtccttctgctcacaatcgggctgagcctggtggcttccgtggagcttcccaactctctggaagagctcggagatggcctggccatggggattatgatgctcaaactgcttaccgaattccaaccccaccagctgtggacaaccctcctgagcctgacgtttgtcagaacaaccctttccctggactacgcctggaagaccacagctatggccctcagcatcgtttctctgttccctctctgtctgtccaccacaagccagaaaacgacctggcttccggtgctgctgggatcttttggctgcaagcccctcacaatgttcctgatcaccgagaacaaaatttggggccggaagtcctggcctcttaatgaggggatcatggctattggaatcgtgagcattctgctctcttccctgctcaagaacgatgtccccctggccggccctcttatcgcggggggaatgctgatcgcctgttatgtgattagcggctccagcgctgacctgtctctcgaaaaagccgctgaggttagctgggaacaggaggccgaacattccggggcctctcacagcatcctggtggaggtccaagatgacggaacaatgaagattaaagatgaggaacgcgacgatacccttacgatcctgctcaaggctaccctgctcgcggtgtccggcgtttaccccatgtctattcctgccacactgtttgtgtggtatttctggcagaaaaagaaacagagaagcggcgtcctttgggacaccccctccccgcctgaggtggaacgggctgtcctggataatgggatctaccgcatcctgcagagaggactcctgggccggtctcaagtgggggttggagtgttccaggacggcgtctttcatacaatgtggcacgtgaccagaggggccgttcttatgtatcagggaaagcgcctggagcccagctgggcctccgtgaagaaagatctcattagctacggcggcgggtggcggttccagggatcttggaacacaggcgaggaagtccaagtgatcgctgtggagcctgggaagaatcccaaaaacgttcagacgaccccgggaacatttaagacccctgaaggcgaggtcggggccattgcgctggacttcaaacccggaacctccggcagccctatcgtgaatagagaaggcaagattgtggggctctacggaaacggcgtcgtgacaacgtctgggacctatgtttccgctatcgcccaggccaaggctagccaagagggacccctgcccgagattgaagacgaggtgtttaaaaagcgcaatcttacaatcatggatctgcaccctggctccgggaaaacccggagatacctgccggccatcgtccgcgaagcgattaagcggaaactcagaacactgatccttgctcccacccgcgtggttgcctctgagatggccgaagctctgaagggcatgcctattcggtatcagacgacagccgtgaagagcgagcataccggaagagagatcgtcgacctcatgtgccacgctaccttcacaatgcggctgctgtcccccgtgcgcgttcctaactacaatatgattatcatggatgaagcccattttaccgaccccgcgagcatcgccgctagaggctatatttctacacgggtggggatgggagaggccgctgccatcttcatgaccgccacgcctccgggctccgtcgaagcttttccccagagcaacgcggtgattcaggatgaggaacgcgacatccctgagagatcttggaatagcgggtacgattggattacagacttccccggaaaaaccgtgtggtttgtcccttccatcaagtctggcaacgatatcgccaattgtctccggaaaaacgggaagagagttattcaacttagccgcaaaacattcgacaccgagtatcagaagacgaagaacaatgattgggactacgtggtgaccacagacatctccgaaatgggcgctaacttccgggccgatagagtcattgacccccgccggtgcctgaaaccggtgatcctgaaggatggacctgagagagttattctcgccggccccatgcccgtgaccgctgcctctgcggctcagcgccgggggagaatcggacgcaatcagaacaaagaaggcgaccaatacgtctatatggggcagcctctgaataacgatgaggaccacgcccattggacagaggccaagatgcttctggataatattaacacccccgaaggaatcatccctgctctctttgagccggaaagagagaaaagcgccgcgattgacggcgaataccggctgcgcggggaggccagaaagacattcgtggagctgatgcggcgcggcgatctccccgtttggctttcctataaggtggctagcgaaggatttcagtactctgacagacggtggtgcttcgatggcgagagaaataaccaggtcctggaagagaatatggacgtggaaatctggaccaaagagggggagcgcaagaaactgcggcctagatggctcgatgcccgcacgtattccgaccccctggctcttcgggaatttaaggagttcgccgctggaagacggagcgtctccggcgacctgattctcgaaatcgggaaactgcctcaacacctgacactccgcgcccagaacgcgcttgataatctggtgatgctgcacaactctgagcagggaggcaaggcctacagacatgctatggaagagctccccgacaccattgagaccctgatgcttctggccctcatcgctgttctgacaggcggggtgaccctgtttttcctcagcggaaaaggccttgggaagacatccatcggactgctgtgtgtgacggcctctagcgtcctcctgtggatggcctccgttgaaccgcactggattgctgcgagcatcattcttgagtttttcctgatggtgctcctgatccctgaacccgatcggcagcgcacccctcaagacaatcagctggcctatgtggtcattggcctcctttttatgatcctgacagtggctgccaacgagatggggctgctcgagaccacaaagaaagatctgggaatcggctacgttgccgctgaaaaccatcagcacgccaccatgcttgacgtggatctgcaccccgcgtctgcctggacgctctacgctgtcgccaccacagtgattacccctatgatgagacatacaatcgagaataccacggctaacatttccctgacagccatcgcgaatcaagccgctattctgatgggcctcgacaaggggtggcccatcagcaaaatggatattggagtcccgcttctggccctgggctgctattctcaggtgaaccctctcaccctgacagctgccgttcttatgctggtggctcactacgccatcatcgggcccggactccaggcgaaggccacccgggaagctcagaaacgcaccgccgctggcattatgaagaatcccacagtcgacgggatcgtggccattgatctggaccctgttgtgtatgatgccaagttcgagaaacaactgggacagatcatgctccttattctgtgtacgtcccagatcctgctcatgagaaccacatgggcgctgtgcgaaagcatcacccttgctacaggcccgctgaccacgctctgggagggctctcccgggaagttttggaacacaaccattgccgtcagcatggctaatatcttccggggatcctacctggccggcgccgggctggctttctctctcatgaaaagccttggaggcgggcgcagaggaaccggcgcccagggcgagacactgggggaaaagtggaaacggcaactgaaccagctctccaagagcgagtttaatacctataagagatccggaattatggaagtggaccgctctgaggcgaaagaaggcctgaagcggggggagacaacgaaacatgccgtgagcagaggaaccgctaagcttcgctggttcgttgagcggaacctggtcaaacctgaaggcaaggtgatcgacctcgggtgtggaagaggcggctggtcctactattgcgccgggctgaagaaagtgacagaggtcaagggatacaccaaaggcgggcccggacacgaagagcctattcccatggctacatacggctggaatctggttaagctccattctgggaaagatgtgtttttcatgcctccggaaaagtgtgacacccttctgtgcgatatcggagagagctcccccaaccctacgatcgaggaaggccgcaccctgcgggtgctcaaaatggtcgagccctggctgagaggcaatcagttttgtattaagatccttaacccttatatgccctctgtggttgaaacactggagcgcatgcagcggaagcacgggggaatgctcgtgagaaatccgctgagccgcaactccacccacgagatgtactgggtcagctgcggcacagggaatattgtgtctgccgttaacatgacctcccggatgctgctcaacagattcacaatggcgcatcgcaaacctacctatgaaagagacgtggatctgggagccggcacgcggcacgtcgctgtggagcccgaagtggccaatcttgacatcattgggcaacgcatcgagaacattaagaatgaacataaaagcacatggcactacgatgaggacaacccctataagacctgggcttaccacggatcttatgaggtcaaaccttccggcagcgcctcttccatggttaatggcgtggtgagactgctcaccaagccctgggatgtcatccctatggtgacacagatcgctatgacggacaccacaccgtttgggcagcaacgggttttcaaggaaaaagtggataccagaacaccccgggccaagcgcggaaccacacagattatggaggtcaccgcgaaatggctgtggggctttcttagcagaaacaagaaacctcggatctgtacgcgcgaagagttcaccagaaaggtgcggtccaatgccgctattggggccgtttttgtggacgaaaaccagtggaatagcgctaaggaggccgtcgaggacgaacgcttctgggatctggtgcatagagagcgggaactccacaaacagggaaagtgcgccacatgcgtttacaacatgatgggcaaacgcgagaagaaactgggggaatttggcaaggcgaagggatctagagctatctggtacatgtggctgggcgcccggttcctcgagttcgaggccctggggtttatgaatgaagaccattggttcagccgcgagaactccctttctggagtggaaggcgaggggctgcacaaactcggatatattctgagagatatcagcaagatccccggcgggaatatgtacgctgacgataccgccggctgggacacacgggtcaccgaggatgaccttcaaaacgaagctaaaattacggatatcatggagcctgaacatgccctgctcgcgacatccatttttaagctgacctatcagaataaagtggtccgcgtgcagagacccgccaagaacggaacagttatggacgtgatctctcggagagatcagcgcggcagcgggcaagtcggaacctacggcctgaacacgttcaccaatatggaggtgcagctcattcggcagatggaatccgaggggatctttctgccgtctgagcttgaaacacctaacctggctgagagagccctcgactggctggaaaaacacggagctgagcgccttaagcggatggccatcagcggcgatgactgtgtggttaagcccattgacgatagattcgcgaccgccctgacagctctcaatgacatggggaaagtgcgcaaggatatccctcagtgggaaccctccaaaggctggaacgactggcaacaggtccctttttgcagccaccatttccaccagctgattatgaaggatggacgggagatcgtggttccctgtagaaatcaggacgagctggtgggccgcgcccgggtctctcaaggggctggatggtccctcagagaaaccgcctgcctgggcaaaagctatgctcagatgtggcagcttatgtactttcatcgccgggatctgagactcgccgcgaacgccatttgttctgctgtgccggtcgactgggtgcctacatcccggaccacgtggagcatccacgcccaccatcaatggatgacaaccgaggatatgctgtccgtttggaatagagtgtggatcgaagagaacccctggatggaaaataagacccacgtctctagctgggaggaggtgccctatcttgggaagcgcgaagaccagtggtgcggatccctgattggcctcacagcccgggctacctgggccacaaacatccaggttgcgattaatcaggtgagacgcctgatcgggaacgagaattacctggattacatgacgagcatgaaaagattcaagaacgaatctgactccgagggcgctctctggtga

SEQ ID NO: 18726 - RNA, 9879 nt, synthetic construct
  misc_feature 1..9879: note = derived and/or modified CDS sequence (opt5) from DENV-1__KJ189363__SS-prME
  source 1..9879: mol_type = other RNA
agcgtgaccatgctgctcatgctgcttcccaccgccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcatggtgatcgcctttttcctggcgcatgccattgggacctctatcacacagaagggaatcatttttatcctcctgatgcttgtcacccctagcatggctatgagatgcgtgggcattgggaaccgggacttcgttgagggactgtccggcgccacctgggtggatgtcgtgctcgaacacgggagctgtgtgacaacgatggctaagaataaacccaccctggacatcgagctgctcaagacagaagtcaccaaccctgccgttctgcgcaaactttgcattgaggcgaagatctctaatacaaccacggattccagatgtccgacacaaggagaagccaccctggtggaggagcaggacgctaactttgtgtgccggcgcaccttcgtcgatagaggctggggcaatgggtgtggactctttggcaaagggagcctgcttacatgcgccaagttcaagtgcgtgaccaaactggaaggaaagattgttcagtacgagaacctcaaatattctgtgatcgtcacagtgcacacgggcgaccagcatcaagttgggaatgaaaccacagagcacggaaccatcgctacaattacaccccaggcccctacgtccgaaatccagctgaccgattacggcgccctgacactcgactgtagcccccggaccggcctggactttaacgagatggtgcttctgacaatgaaggagaaatcttggctcgtccataagcagtggttcctggatcttcctctgccctggacctccggggctagcacgtcccaagaaacatggaatcgccaggacctcctggtgacctttaaaacagcgcacgccaagaagcaggaggtcgtggttctgggatctcaagaaggcgctatgcacaccgccctcaccggggccacagagattcagacgagcggaaccacaaccatcttcgctggccatctgaaatgcagacttaagatggataaactgacactcaaggggatgtcctatgtgatgtgtaccggcagcttcaaactggaaaaggaggtcgccgagacgcagcacggaacagtgctggttcaggtgaagtacgaaggcaccgacgcgccgtgcaaaattcctttttctacccaagatgagaagggggtcacacagaacggacggcttatcaccgctaatcccatcgtgacagacaaagaaaagcctgtgaacattgagacggagccgcccttcggcgaatcctatatcgttgtcggggccggagagaaagccctcaagctgagctggtttaagagaggctctagcattgggaaaatgttcgaagctaccgcccgcggcgctcggagaatggccatcctgggagatacagcgtgggactttggctccattgggggagtgttcacctctgtgggcaagctcgtccatcagatctttgggacagcctacggagtgctgttcagcggcgtttcctggaccatgaaaatcgggattggcatccttctgacgtggctcggactgaatagccgctctacctccctgagcatgacatgtattgctgtgggcatggtcaccctttacctcggggtgatggttcaggccgattctggatgcgtgatcaactggaagggccgggagctgaaatgtgggtccggaatttttgtcacaaacgaagtgcacacctggacagagcaatataagttccaggctgacagccctaagagactgtccgccgcgatcggcaaagcctgggaggaaggggtttgcggcattcgctctgctacccggctcgagaatatcatgtggaagcagatcagcaacgaactgaatcatattcttctggagaacgatatgaaatttacggtggtcgtgggagacgccaatggcatcctcgctcaggggaagaaaatgattagaccgcaacccatggaacacaagtactcctggaaatcttggggaaaggccaagatcattggcgccgacatccagaacacaaccttcatcattgatgggcctgacacccccgagtgtcctgatggacagcgcgcttggaatatctgggaggtggaagactatggctttggcgtcttcacaaccaacatttggctgaaactgcgggatagctacacgcagatgtgcgaccacagacttatgtccgcggccatcaaggatagcaaagctgttcatgccgacatggggtattggattgagtctgaaaagaatgagacatggaaactcgcccgcgcttccttcatcgaagtgaagacctgtacatggcccaagagccacaccctgtggtctaacggagtgctggagtccgagatgatcattccgaaaatctacggcgggcctattagccaacataattatcggcccggatactttacacagaccgccggcccttggcacctcgggaagctggaacttgatttcgacctgtgcgagggaacgaccgtcgtggttgatgaacactgcggcaacagaggcccctctctccggacaaccacagtgaccgggaaaatcattcatgagtggtgttgccgcagctgtacgctgcctcccctgagatttcggggagaggacggctgctggtacgggatggaaatcagaccggtcaaggagaaagaagagaatcttgtgcgctccatggttagcgcgggatctggcgaagtggattccttcagcctcgggatcctgtgtgtctccattatgatcgaggaggtgatgcggtctagatggagccgcaagatgctgatgacaggaaccctcgctgtttttctgcttctgattatgggccagctcacatggaacgacctgatcagactgtgcattatggtgggcgccaatgcctccgaccggatggggatgggaaccacctatcttgctctgatggccacattcaagatgcgccctatgtttgcggtcggcctcctgttcagacggctcacgtctcgcgaagtgctgcttctgaccatcgggctcagcctggtggcttccgtcgagctgcccaactctcttgaagaactgggagatggcctcgccatggggattatgatgctgaaactcctgacagaatttcaaccccaccagctttggaccacactgctcagcctgaccttcgttaagacgacactgtcccttgactacgcctggaaaaccaccgctatggccctgagcatcgtgtctctctttcctctgtgtctctccacaaccagccagaagacaacgtggctgccggtgcttctgggatctttcggctgcaaacccctgaccatgtttctcatcacagagaacaagatttggggcagaaagtcctggcctctgaatgaggggatcatggctattggaatcgtcagcattcttctgtcttccctcctgaaaaacgatgtgcccctcgccggccctctgatcgccgggggaatgcttatcgcctgttatgttattagcggctccagcgctgacctgtctctggaaaaggccgctgaggtgagctgggaacaggaggccgaacattccggggcctctcacagcatcctcgtcgaggtgcaagatgacggaaccatgaaaattaaggatgaggaacgggacgatacactgaccatccttctgaaagctacgctcctggcggtttccggcgtgtaccccatgtctattcctgccaccctcttcgtctggtatttctggcagaagaaaaagcagcgcagcggcgtgctgtgggacacaccctccccgcctgaggtcgaaagagctgtgcttgataatgggatctaccggatcctgcagcgcggactgctcggcagatctcaagttggggtgggagtctttcaggacggcgtgttccataccatgtggcacgttacaagaggggcggtgctgatgtatcagggaaagcggcttgagcccagctgggcctccgtcaaaaaggatctgattagctacggcggcgggtggcgctttcagggatcttggaacaccggcgaggaagtgcaagtgatcgctgttgagcctgggaaaaatcccaagaacgtccagacaacgccgggaaccttcaaaacacctgaaggcgaggtgggggccattgcgctcgactttaagcccggaacctccggcagccctatcgtgaatcgggaaggcaagattgtcgggctgtacggaaacggcgtggttaccacatctgggacgtatgtgtccgctatcgcccaggccaaagctagccaagagggacccctccccgagattgaagacgaggtcttcaagaaaagaaatctgaccatcatggatcttcaccctggctccgggaagacacgccggtacctgccggccatcgtgagagaagcgattaaacgcaagctgcggaccctcatcctggctcccacaagagttgtggcctctgagatggccgaagctcttaagggcatgcctattcgctatcagaccacggccgtcaaaagcgagcatacaggacgggagatcgtggacctgatgtgccacgctacctttaccatgagactcctgtcccccgttcgggtgcctaactacaatatgattatcatggatgaagcccatttcacagaccccgcgagcatcgccgctcgcggctatatttctaccagagtcgggatgggagaggccgctgccatctttatgacagccacccctccgggctccgtggaggctttcccccagagcaacgcggtgattcaggatgaggaacgggacatccctgagcgctcttggaatagcgggtacgattggattacggactttcccggaaagacagtctggttcgttccttccatcaaatctggcaacgatatcgccaattgtctgagaaagaacgggaaacgggtgattcaactcagcagaaagaccttcgacacagagtatcagaagaccaaaaacaatgattgggactacgtggtcacgaccgacatctccgaaatgggcgctaactttcgcgccgatcgggtgattgaccccagacgctgccttaagccggttatcctgaaagatggacctgagcgggtgattctggccggccccatgcccgtcacagctgcctctgcggctcagagacgcgggcggatcggaagaaatcagaacaaggaaggcgaccaatacgtgtatatggggcagcctctcaataacgatgaggaccacgcccattggaccgaggccaaaatgctgcttgataatattaacacacccgaaggaatcatccctgctctgttcgagccggaacgcgaaaagagcgccgcgattgacggcgaatacagactcagaggggaagcccgcaagacctttgttgagctgatgagacggggcgatctgcccgtgtggctctcctataaagtcgctagcgaaggattccagtactctgaccgcagatggtgctttgatggcgagcggaataaccaggtgcttgaagagaatatggacgtcgaaatctggacaaaggagggggagcgcaagaagctgcgccctcggtggctggatgccagaacctattccgaccccctcgctctgcgcgagttcaaagagtttgccgctggacggagaagcgtgtccggcgaccttattctggaaatcgggaagctccctcaacacctgacgctgcgggcccagaacgcgctcgataatcttgttatgctgcacaactctgagcagggaggcaaagcctaccgccatgctatggaggaactgcccgacacaattgagaccctcatgctgcttgccctgatcgctgtgctcaccggcggggtgacactgttctttctgagcggaaagggcctcgggaagacctccatcggacttctgtgtgtcacagcctctagcgccctgctctggatggcttccgttgaaccgcactggattgcggccagcatcattctggagttctttcttatggtgctgctcatccctgaacccgatagacagcggacgcctcaagacaatcagctggcttatgtggtcattggcctcctgttcatgatccttaccgtggccgccaacgagatggggctgctggagacaaccaaaaaggatctcggaatcggctacgttgctgccgaaaaccatcagcacgcgacaatgctggacgtggatcttcaccccgcctctgcttggaccctgtacgccgtcgctacgaccgtgattacacctatgatgcgccataccatcgagaatacaaccgccaacatttccctcacggcgatcgccaatcaagctgccattctgatgggcctggacaaagggtggcccatcagcaagatggatattggagtcccgctccttgctctgggctgctattctcaggtgaaccctctgacactcaccgccgctgttctgatgcttgtggcccactacgcgatcatcgggcccggactgcaggccaaagctacaagagaagcccagaagcggaccgctgccggcattatgaagaatcccaccgtcgacgggatcgtggccattgatctcgaccctgttgtgtatgatgcgaaatttgagaagcaactgggacagatcatgctgctcattctttgtacatcccagatcctgctgatgcgcacgacctgggctctctgcgaaagcatcacactggccaccggcccgcttacaaccctgtgggagggctctcccgggaaattctggaacacgacaattgctgtcagcatggccaatatcttcagaggatcctacctcgccggcgctgggctggccttttctctgatgaaaagcctcggaggcgggcggcgcggaaccggcgcgcagggcgagacccttggggaaaaatggaagagacaactgaaccagctgtccaagagcgagttcaatacatataaacggtccggaattatggaagtggacagatctgaggccaaggaaggcctcaaacgcggggagaccacaaagcatgctgtgagccggggaacggccaaactgagatggtttgttgagcgcaaccttgtcaagcctgaaggcaaggtgatcgacctggggtgtggacggggcggctggtcctactattgcgctgggctcaaaaaggtgaccgaggtcaaaggatacacaaagggcgggcccggacacgaggaacctattcccatggccacctacggctggaatctggttaaactgcattctgggaaggatgtgttctttatgcctccggaaaaatgtgacacactcctttgcgatatcggagagagctcccccaaccctaccatcgaggaaggcagaacgctgcgcgtgctgaagatggtcgagccctggctccggggcaatcagttctgtattaagatcctgaacccttatatgccctctgtggttgaaacccttgagagaatgcagcgcaaacacgggggaatgctggtgcggaatccgctcagcagaaactccacacacgagatgtactgggtcagctgcggcaccgggaatattgtgtctgcggttaacatgacatcccgcatgctgctgaaccggtttaccatggcccatagaaagcctacatatgaacgcgacgtggatctcggagctggcaccagacacgtcgccgtggagcccgaagtggctaatctggacatcattgggcaacggatcgagaacattaaaaatgaacataagagcacgtggcactacgatgaggacaacccctataaaacatgggcctaccacggatcttatgaggtcaagccttccggcagcgcttcttccatggttaatggcgtggtgcgccttctgaccaagccctgggatgtcatccctatggtgacccagatcgccatgacagacacgaccccgttcgggcagcaaagagtttttaaagaaaaggtggatacacggacccccagagcgaaacggggaacaacccagattatggaggtcacagccaagtggctctggggcttcctgagccgcaacaaaaagcctagaatctgtacccgggaagagtttacgcgcaaggtgagatccaatgctgccattggggctgttttcgtggacgaaaaccagtggaatagcgccaaagaggccgtcgaggacgaacggttttgggatcttgtgcatcgcgagagagaactgcacaagcagggaaaatgcgcgacctgcgtttacaacatgatgggcaagcgggagaaaaagctcggggagttcggcaaggctaaaggatctcgcgccatctggtacatgtggctgggcgccagattcctggagtttgaggctctcgggttcatgaatgaagaccattggtttagccgggagaactccctgtctggagtggaaggcgaggggcttcacaagctgggatatattctccgcgatatcagcaaaatccccggcgggaatatgtacgccgacgatacagctggctgggacaccagagtcacagaggatgacctgcaaaacgaagccaagattaccgatatcatggagcctgaacatgcgcttctggccacgtccattttcaaactcacatatcagaataaggtggtccgggtgcagcgccccgctaaaaacggaaccgttatggacgtgatctctagacgggatcagagaggcagcgggcaagtcggaacatacggcctgaacacctttacgaatatggaggtgcagctgattcgccagatggaatccgaggggatcttcctcccgtctgagctggaaacccctaaccttgccgagcgggctctggactggctcgaaaagcacggagccgagagactgaagcgcatggcgatcagcggcgatgactgtgtggttaaacccattgacgatcggtttgccacagctcttaccgccctgaatgacatggggaaggtgagaaaagatatccctcagtgggaaccctccaagggctggaacgactggcaacaggtccctttctgcagccaccattttcaccagctcattatgaaagatggacgcgagatcgtggttccctgtcggaatcaggacgagctggtgggcagagctcgcgtctctcaaggggccggatggtccctgcgggaaacagcttgcctcggcaagagctatgcccagatgtggcagctgatgtacttccatagacgcgatcttcggctggcggccaacgctatttgttctgccgtgccggtcgactgggtgcctacctccagaacaacctggagcatccacgcccaccatcaatggatgacgacagaggatatgctctccgtttggaatcgggtgtggatcgaagagaacccctggatggaaaataagacccacgtctctagctgggaggaggtgccctatctggggaaaagagaagaccagtggtgcggatcccttattggcctgaccgctcgcgccacatgggcgaccaacatccaggttgctattaatcaggtgcggagactcatcgggaacgagaattacctggattacatgacaagcatgaagcgctttaaaaacgaatctgactccgagggcgccctgtggtga

SEQ ID NO: 18727 - RNA, 9879 nt, synthetic construct
  misc_feature 1..9879: note = derived and/or modified CDS sequence (opt5) from DENV-1__KJ189364__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaaggggatgacccagaacggacggcttatcacagctaatcccatcgtcacggacaaagaaaagcctgtgaacattgagaccgagccccccttcggcgaatcctatatcgtggttggggccggagagaaagccctcaagctgagctggtttaagagaggctctagcattgggaaaatgttcgaagctacagcccgcggcgctcggagaatggccatcctgggagataccgcgtgggactttggctccattgggggagtcttcacatctgtgggcaagctcgtgcatcagatctttgggaccgcctacggagtcctgttcagcggcgtgtcctggacgatgaaaatcgggattggcatccttctgacctggctcggactgaatagccgctctacatccctgagcatgacctgtattgctgttggcatggtgacactttacctcggggtcatggtgcaggccgattctggatgcgttatcaactggaagggccgggagctgaaatgtgggtccggaatttttgtgaccaacgaagtccacacatggaccgagcaatataagttccaggctgacagccctaagagactgtccgccgcgatcggcaaagcctgggaggaaggggtgtgcggcattcgctctgctacgcggctcgagaatatcatgtggaagcagatcagcaacgaactgaatcatattcttctggagaacgatatgaaatttacagttgtggtcggagacgccaatggcatcctcgctcaggggaagaaaatgattagaccgcaacccatggaacacaagtactcctggaaatcttggggaaaggccaagatcattggcgccgacatccagaacaccaccttcatcattgatgggcctgacacacccgagtgtcctgatggacagcgcgcttggaatatctgggaggtggaagactatggctttggcgtgttcaccacgaacatttggctgaaactgcgggatagctacacacagatgtgcgaccacagacttatgtccgcggccatcaaggatagcaaagctgtccatgccgacatggggtattggattgagtctgaaaagaatgagacctggaaactcgcccgcgcttccttcatcgaagttaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgacctgtgcgagggaaccacagtggtcgtggatgaacactgcggcaacagaggcccctctctccggaccacaaccgttacggggaaaatcattcatgagtggtgttgccgcagctgtacactgcctcccctgagatttcggggagaggacggctgctggtacgggatggaaatcagaccggtgaaggagaaagaagagaatcttgtccgctccatggtgagcgcgggatctggcgaagttgattccttcagcctcgggatcctgtgtgtgtccattatgatcgaggaggtcatgcggtctagatggagccgcaagatgctgatgaccggaacactcgctgtgtttctgcttctgattatgggccagctcacctggaacgacctgatcagactgtgcattatggttggcgccaatgcctccgaccggatggggatgggaaccacatatcttgctctgatggccacgttcaagatgcgccctatgtttgcggtgggcctcctgttcagacggctcacctctcgcgaagtcctgcttctgacaatcgggctcagcctggtggcttccgtggagctgcccaactctcttgaagagctgggagatggcctcgccatggggattatgatgctgaaactcctgaccgaatttcaaccccaccagctttggacaaccctgctcagcctgacgttcgtcagaacaaccctgtcccttgactacgcctggaagaccacagctatggccctgagcatcgtttctctctttcctctgtgtctctccaccacaagccagaaaacgacctggctgccggtgcttctgggatctttcggctgcaagcccctgacaatgtttctcatcaccgagaacaaaatttggggccggaagtcctggcctctgaatgaggggatcatggctattggaatcgtgagcattcttctgtcttccctcctgaagaacgatgtccccctcgccggccctctgatcgcggggggaatgcttatcgcctgttatgtgattagcggctccagcgctgacctgtctctggaaaaagccgctgaggttagctgggaacaggaggccgaacattccggggcctctcacagcatcctcgtggaggtccaagatgacggaacaatgaagattaaagatgaggaacgcgacgataccctgacgatccttctgaaggctaccctcctggcggtgtccggcgtttaccccatgtctattcctgccacactcttcgtgtggtatttctggcagaaaaagaaacagagaagcggcgtcctgtgggacaccccctccccgcctgaggtggaacgggctgtccttgataatgggatctaccgcatcctgcagagaggactgctcggccggtctcaagtgggggttggagtgtttcaggacggcgtcttccatacaatgtggcacgtgaccagaggggccgttctgatgtatcagggaaagcgccttgagcccagctgggcctccgtgaagaaagatctgattagctacggcggcgggtggcggtttcagggatcttggaacacaggcgaggaagtccaagtgatcgctgtggagcctgggaagaatcccaaaaacgttcagacgaccccgggaacattcaagacccctgaaggcgaggtcggggccattgcgctcgactttaaacccggaacctccggcagccctatcgtgaatagagaaggcaagattgtggggctgtacggaaacggcgtcgtgacaacgtctgggacctatgtttccgctatcgcccaggccaaggctagccaagagggacccctccccgagattgaagacgaggtgttcaaaaagcgcaatctgacaatcatggatcttcaccctggctccgggaaaacccggagatacctgccggccatcgtccgcgaagcgattaagcggaaactgagaacactcatcctggctcccacccgcgtggttgcctctgagatggccgaagctcttaagggcatgcctattcggtatcagacgacagccgtgaagagcgagcataccggaagagagatcgtcgacctgatgtgccacgctacctttacaatgcggctcctgtcccccgtgcgcgttcctaactacaatatgattatcatggatgaagcccatttcaccgaccccgcgagcatcgccgctagaggctatatttctacacgggtggggatgggagaggccgctgccatctttatgaccgccacgcctccgggctccgtcgaagctttcccccagagcaacgcggtgattcaggatgaggaacgcgacatccctgagagatcttggaatagcgggtacgattggattacagactttcccggaaaaaccgtgtggttcgtcccttccatcaagtctggcaacgatatcgccaattgtctgcggaaaaacgggaagagagttattcaactcagccgcaaaacattcgacaccgagtatcagaagacgaagaacaatgattgggactacgtggtgaccacagacatctccgaaatgggcgctaactttcgggccgatagagtcattgacccccgccggtgccttaaaccggtgatcctgaaggatggacctgagagagttattctggccggccccatgcccgtgaccgctgcctctgcggctcagcgccgggggagaatcggacgcaatcagaacaaagaaggcgaccaatacgtctatatggggcagcctctcaataacgatgaggaccacgcccattggacagaggccaagatgctgcttgataatattaacacccccgaaggaatcatccctgctctgttcgagccggaaagagagaaaagcgccgcgattgacggcgaataccggctccgcggggaggccagaaagacatttgtggagctgatgcggcgcggcgatctgcccgtttggctctcctataaggtggctagcgaaggattccagtactctgacagacggtggtgctttgatggcgagagaaataaccaggtccttgaagagaatatggacgtggaaatctggaccaaagagggggagcgcaagaaactgcggcctagatggctggatgcccgcacgtattccgaccccctcgctctgcgggaattcaaggagtttgccgctggaagacggagcgtctccggcgaccttattctggaaatcgggaaactccctcaacacctgacactgcgcgcccagaacgcgctcgataatcttgtgatgctgcacaactctgagcagggaggcaaggcctacagacatgctatggaagagctgcccgacaccattgagaccctcatgctgcttgccctgatcgctgttctcacaggcggggtgaccctgttctttctgagcggaaaaggcctcgggaagacatccatcggacttctgtgtgtgacggcctctagcgccctgctctggatggcttccgtcgaaccgcactggattgcggccagcatcattctggagttctttcttatggttctgctcatccctgaacccgatcggcagcgcacccctcaagacaatcagctggcttatgtggtgattggcctgctcttcatgatccttacagtcgccgccaacgagatggggctgctggagaccacaaagaaagatctcggaatcggctacgtggctgccgaaaaccatcagcacgcgaccatgctggacgttgatcttcaccccgcctctgcttggacgctgtacgccgtggctaccacagtcattacccctatgatgagacatacaatcgagaataccacggccaacatttccctcacagcgatcgccaatcaagctgccattctgatgggcctggacaaggggtggcccatcagcaaaatggatattggagtgccgctccttgctctgggctgctattctcaggtcaaccctctgaccctcacagccgctgtgctgatgcttgttgcccactacgcgatcatcgggcccggactgcaggccaaggctacccgggaagcccagaaacgcaccgctgccggcattatgaagaatcccacagtggacgggatcgtcgccattgatctcgaccctgtggtttatgatgcgaagtttgagaaacaactgggacagatcatgctgctcattctttgtacgtcccagatcctgctgatgagaaccacatgggctctctgcgaaagcatcaccctggccacaggcccgcttaccacgctgtgggagggctctcccgggaagttctggaacacaaccattgctgtgagcatggccaatatcttccggggatcctacctcgccggcgctgggctggccttttctctgatgaaaagcctcggaggcgggcgcagaggaaccggcgcgcagggcgagacacttggggaaaagtggaaacggcaactgaaccagctgtccaagagcgagttcaatacctataagagatccggaattatggaagtcgaccgctctgaggccaaagaaggcctcaagcggggggagacaacgaaacatgctgtgagcagaggaaccgccaagctgcgctggtttgtggagcggaaccttgttaaacctgaaggcaaggtcatcgacctggggtgtggaagaggcggctggtcctactattgcgctgggctcaagaaagtgacagaggtgaagggatacaccaaaggcgggcccggacacgaagagcctattcccatggccacatacggctggaatctggtcaagctgcattctgggaaagatgttttctttatgcctccggaaaagtgtgacaccctcctttgcgatatcggagagagctcccccaaccctacgatcgaggaaggccgcaccctgcgggtgctgaaaatggtggagccctggctcagaggcaatcagttctgtattaagatcctgaacccttatatgccctctgtcgtggaaacacttgagcgcatgcagcggaagcacgggggaatgctggttagaaatccgctcagccgcaactccacccacgagatgtactgggtgagctgcggcacagggaatattgtctctgcggtgaacatgacctcccggatgctgctgaacagatttacaatggcccatcgcaaacctacctatgaaagagacgttgatctcggagctggcacgcggcacgtggccgtcgagcccgaagtggctaatctggacatcattgggcaacgcatcgagaacattaagaatgaacataaaagcacatggcactacgatgaggacaacccctataagacctgggcctaccacggatcttatgaggtgaaaccttccggcagcgcttcttccatggtcaatggcgttgtgagacttctgaccaagccctgggatgtgatccctatggtcacacagatcgccatgacggacaccacaccgttcgggcagcaacgggtgtttaaggaaaaagttgataccagaacaccccgggcgaagcgcggaaccacacagattatggaggtgaccgccaaatggctctggagcttcctgtccagaaacaagaaacctcggatctgtacgcgcgaagagtttaccagaaaggtccggagcaatgctgccattggcgctgtgttcgttgacgaaaaccagtggaattctgccaaggaggccgtggaggacgaacgcttttgggatcttgtccatagagagcgggaactgcacaaacaggggaagtgcgcgacatgcgtgtacaacatgatgggaaaacgcgagaagaaactcggcgaattcgggaaggctaagggcagcagagccatctggtacatgtggctgggagcccggttcctggagtttgaggctctcggcttcatgaatgaagaccattggttttcccgcgagaactctctgagcggggttgaaggagagggccttcacaaactggggtatattctcagagatatctccaagatccccggaggcaatatgtacgccgacgataccgctgggtgggacacacgggtgaccgaggatgacctgcaaaacgaagccaaaattacggatatcatggagcctgaacatgcgcttctggccacatctattttcaagctcacctatcagaataaagtcgtgcgcgtccagagacccgctaagaacggcacagtgatggacgttatcagccggagagatcagcgcggatccggccaagtggggacctacggactgaacacgtttaccaatatggaggtccagctgattcggcagatggaatctgagggcatcttcctcccgagcgagctggaaacacctaaccttgccgagagagctctggactggctcgaaaaacacggggccgagcgcctgaagcggatggcgatctccggagatgactgtgtggtgaagcccattgacgatagatttgccaccgctcttacagccctgaatgacatgggcaaagttcgcaaggatatccctcagtgggaacccagcaaagggtggaacgactggcaacaggtgcctttctgctctcaccattttcaccagctcattatgaaggatggccgggagatcgtcgtgccctgtagaaatcaggacgagctggttggacgcgctcgggtgtcccaaggcgccgggtggagcctgagagaaaccgcttgcctcggaaaatcttatgcccagatgtggcagctgatgtacttccatcgccgggatcttagactggcggccaacgctatttgttccgccgtcccggtggactgggtccctacaagccggaccacgtggtccatccacgcccaccatcaatggatgacaaccgaggatatgctctctgtgtggaatagagtttggatcgaagagaacccctggatggaaaataagacccacgtgagctcctgggaggaggtcccctatctgggcaagcgcgaagaccagtggtgcgggagccttattggactgacagctcgggccacctgggcgacaaacatccaggtggctattaatcaggttagacgcctcatcggcaacgagaattacctggattacatgacgtctatgaaaagatttaagaacgaatccgacagcgagggggccctgtggtga

SEQ ID NO: 18728 - RNA, 9879 nt, synthetic construct
  misc_feature 1..9879: note = derived and/or modified CDS sequence (opt5) from DENV-1__KJ189365__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcagatctttgggaccgcctacggagtgctgttcagcggcgtttcctggacgatgaaaatcgggattggcatccttctgacctggctcggactgaatagccgctctacatccctgagcatgacctgtattgtggtcggcatggtgacactttacctcggggttatggtgcaggctgattctggatgcgtcatcaactggaagggccgggagctgaaatgtgggtccggaatttttgtgaccaacgaagttcacacatggaccgagcaatataagttccaggccgacagccctaagagactgtccgctgccatcggcaaagcgtgggaggaaggggtgtgcggcattcgctctgccacgcggctcgagaatatcatgtggaagcagatcagcaacgaactgaatcatattcttctggagaacgatatgaaatttacagtcgtggtgggagacgctaatggcatcctcgcccaggggaagaaaatgattagaccgcaacccatggaacacaagtactcctggaaatcttggggaaaggctaagatcattggcgccgacatccagaacaccaccttcatcattgatgggcctgacacacccgagtgtcctgatggacagcgcgcctggaatatctgggaggtcgaagactatggctttggcgttttcaccacgaacatttggctgaaactgcgggatagctacacacagatgtgcgaccacagacttatgtccgctgcgatcaaggatagcaaagccgtgcatgctgacatggggtattggattgagtctgaaaagaatgagacctggaaactcgcccgcgcctccttcatcgaagtgaagacatgtacctggcccaagagccacacactgtggtctaacggagtcctggagtccgagatgatcattccgaaaatctacggcgggcctattagccaacataattatcggcccggatactttacccagacggctggcccttggcacctcgggaagctggaacttgatttcgacctgtgcgagggaaccacagtggttgtggatgaacactgcggcaacagaggcccctctctccggaccacaaccgtcacggggaaaatcattcatgagtggtgttgccgcagctgtacactgcctcccctgagatttcggggagaggacggctgctggtacgggatggaaatcagaccggtgaaggagaaagaagagaatcttgttcgctccatggtgagcgccggatctggcgaagtcgattccttcagcctcgggatcctgtgtgtgtccattatgatcgaggaggttatgcggtctagatggagccgcaagatgctgatgaccggaacactcgcggtgtttctgcttctgattatgggccagctcacctggaacgacctgatcagactgtgcattatggtcggcgctaatgcctccgaccggatggggatgggaaccacatatcttgccctgatggctacgttcaagatgcgccctatgtttgccgtgggcctcctgttcagacggctcacctctcgcgaagtgctgcttctgacaatcgggctcagcctggtcgcgtccgttgagctgcccaactctcttgaagagctgggagatggcctcgctatggggattatgatgctgaaactcctgaccgaatttcaaccccaccagctttggacaaccctgctcagcctgacgttcgtgaagacaaccctgtcccttgactacgcctggaaaaccacagccatggctctgagcatcgtgtctctctttcctctgtgtctctccaccacaagccagaagacgacctggctgccggtccttctgggatctttcggctgcaaacccctgacaatgtttctcatcaccgagaacaagatttggggcagaaagtcctggcctctgaatgaggggatcatggccattggaatcgtgagcattcttctgtcttccctcctgaaaaacgatgttcccctcgctggccctctgatcgccgggggaatgcttatcgcgtgttatgtgattagcggctccagcgccgacctgtctctggaaaaggctgccgaggtcagctgggaacaggaggctgaacattccggggcctctcacagcatcctcgtggaggttcaagatgacggaacaatgaaaattaaggatgaggaacgggacgataccctgacgatccttctgaaagccaccctcctggctgtgtccggcgtctaccccatgtctattcctgcgacactcttcgtgtggtatttctggcagaagaaaaagcagcgcagcggcgtcctgtgggacaccccctccccgcctgaggtggaaagagccgttcttgataatgggatctaccggatcctgcagcgcggactgctcggcagatctcaagtgggggtcggagtgtttcaggacggcgttttccatacaatgtggcacgtgacccggggggctgtcctgatgtatcagggaaagagacttgagcccagctgggcctccgtgaaaaaggatctgattagctacggcggcgggtggcgctttcagggatcttggaacacaggcgaggaagtgcaagttatcgccgtcgagcctgggaaaaatcccaagaacgtgcagacgaccccgggaacattcaaaacccctgaaggcgaggtgggggctattgccctcgactttaagcccggaacctccggcagccctatcgtcaatcgggaaggcaagattgtggggctgtacggaaacggcgttgtgacaacgtctgggacctatgtctccgcgatcgctcaggccaaagccagccaagagggacccctccccgagattgaagacgaggtgttcaagaaaagaaatctgacaatcatggatcttcaccctggctccgggaagacccgccggtacctgccggctatcgttagagaagccattaaacgcaagctgcggacactcatcctggcgcccaccagagtggtcgcttctgagatggccgaagcccttaagggcatgcctattcgctatcagacgacagctgtgaaaagcgagcataccggacgggagatcgttgacctgatgtgccacgccacctttacaatgagactcctgtcccccgtgcgggtccctaactacaatatgattatcatggatgaagctcatttcaccgaccccgccagcatcgcggcccgcggctatatttctacaagagtggggatgggagaggctgccgctatctttatgaccgccacgcctccgggctccgtggaagccttcccccagagcaacgctgtcattcaggatgaggaacgggacatccctgagcgctcttggaatagcgggtacgattggattacagactttcccggaaagaccgtttggttcgtgccttccatcaaatctggcaacgatatcgcgaattgtctgagaaagaacgggaaacgggtgattcaactcagcagaaagacattcgacaccgagtatcagaagacgaaaaacaatgattgggactacgtcgtgaccacagacatctccgaaatgggcgccaactttcgcgctgatcgggttattgaccccagacgctgccttaagccggtgatcctgaaagatggacctgagcgggtcattctggccggccccatgcccgtgaccgccgcttctgccgcgcagagacgcgggcggatcggaagaaatcagaacaaggaaggcgaccaatacgtttatatggggcagcctctcaataacgatgaggaccacgctcattggacagaggccaaaatgctgcttgataatattaacacccccgaaggaatcatccctgccctgttcgagccggaacgcgagaagagcgctgccattgacggcgaatacagactccggggggaggcgcgcaagacatttgtggagctgatgagacggggcgatctgcccgtctggctctcctataaagtggccagcgaaggattccagtactctgaccgcagatggtgctttgatggcgagcggaataaccaggtccttgaagagaatatggacgtggaaatctggaccaaggagggggagagaaaaaagctgcgccctcggtggctggatgctagaacgtattccgaccccctcgccctgcgcgaattcaaagagtttgctgccggacggagaagcgtttccggcgaccttattctggaaatcgggaagctccctcaacacctgacactgcgggctcagaacgccctcgataatcttgtgatgctgcacaactctgagcagggaggcaaagcgtaccgccatgccatggaagagctgcccgacaccattgagaccctcatgctgcttgctctgatcgccgtgctcacaggcggggtcaccctgttctttctgagcggaaagggcctcgggaagacatccatcggacttctgtgtgttacggcttctagcgccctgctctggatggcctccgtggaaccgcactggattgctgcgagcatcattctggagttctttcttatggtgctgctcatccctgaacccgatagacagcggacccctcaagacaatcagctggcctatgtcgtgattggcctgctcttcatgatccttacagttgctgccaacgagatggggctgctggagaccacaaaaaaggatctcggaatcggctacgtggccgctgaaaaccatcagcacgccaccatgctggacgtcgatcttcaccccgcgtctgcctggacgctgtacgctgtggccaccacagtcattacccctatgatgcgccatacaatcgagaataccacggctaacatttccctcacagccatcgcgaatcaagccgctattctgatgggcctggacaaagggtggcccatcagcaagatggatattggagtgccgctccttgccctgggctgctattctcaggttaaccctctgaccctcacagctgccgtgctgatgcttgtcgctcactacgccatcatcgggcccggactgcaggcgaaagccaccagagaagctcagaagcggaccgccgctggcattatgaagaatcccacagtggacgggatcgttgccattgatctcgaccctgtggtctatgatgccaaatttgagaagcaactgggacagatcatgctgctcattctttgtacgtcccagatcctgctgatgcgcaccacatgggcgctctgcgaaagcatcaccctggctacaggcccgcttaccacgctgtgggagggctctcccgggaaattctggaacacaaccattgccgtgagcatggctaatatcttcagaggatcctacctcgccggcgccgggctggctttttctctgatgaagagcctcggaggcgggcggcgcggaaccggcgcccagggcgagacacttggggaaaaatggaagagacaactgaaccagctgtccaagagcgagttcaatacctataaacggtccggaattatggaagtggacagatctgaggcgaaggaaggcctcaaacgcggggagacaacgaagcatgccgttagccggggaaccgctaaactgagatggtttgtcgagcgcaaccttgtgaagcctgaaggcaaggtgatcgacctggggtgtggacggggcggctggtcctactattgcgccgggctcaaaaaggtcacagaggttaaaggatacaccaagggcgggcccggacacgaagagcctattcccatggctacatacggctggaatctggtgaaactgcattctgggaaggatgtgttctttatgcctccggaaaaatgtgacaccctcctttgcgatatcggagagagctcccccaaccctacgatcgaggaaggcagaaccctgcgcgtcctgaagatggtggagccctggctccggggcaatcagttctgtattaagatcctgaacccttatatgccctctgttgtggaaacacttgagagaatgcagcgcaaacacgggggaatgctggtccggaatccgctcagcagaaactccacccacgagatgtactgggtgagctgcggcacagggaatattgtttctgccgtgaacatgacctcccgcatgctgctgaaccggtttacaatggcgcatagaaagcctacctatgaacgcgacgtcgatctcggagccggcacgagacacgtggctgtggagcccgaagtcgccaatctggacatcattgggcaacggatcgagaacattaaaaatgaacataagagcacatggcactacgatgaggacaacccctataaaacctgggcttaccacggatcttatgaggttaagccttccggcagcgcctcttccatggtgaatggcgtggtccgccttctgaccaagccctgggatgtgatccctatggttacacagatcgctatgacggacaccacaccgttcgggcagcaaagagtgtttaaagaaaaggtcgatacccggacacccagagccaaacggggaaccacacagattatggaggtgaccgcgaagtggctctggggcttcctgagccgcaacaaaaagcctagaatctgtacgcgggaagagtttacccgcaaggttagatccaatgccgctattggggccgtgttcgtcgacgaaaaccagtggaatagcgctaaagaggccgtggaggacgaacggttttgggatcttgttcatcgcgagagagaactgcacaagcagggaaaatgcgccacatgcgtgtacaacatgatgggcaagcgggagaaaaagctcggggaattcggcaaggcgaaaggatctcgcgctatctggtacatgtggctgggcgccagattcctggagtttgaggccctcgggttcatgaatgaagaccattggtttagccgggagaactccctgtctggagtcgaaggcgaggggcttcacaagctgggatatattctccgcgatatcagcaaaatccccggcgggaatatgtacgctgacgataccgccggctgggacacaagagtgaccgaggatgacctgcaaaacgaagctaagattacggatatcatggagcctgaacatgcccttctggcgacatccattttcaaactcacctatcagaataaggtcgtgcgggttcagcgccccgccaaaaacggaacagtgatggacgtcatctctagacgggatcagagaggcagcgggcaagtgggaacctacggcctgaacacgtttaccaatatggaggtgcagctgattcgccagatggaatccgaggggatcttcctcccgtctgagctggaaacacctaaccttgctgagcgggccctggactggctcgaaaagcacggagctgagagactgaagcgcatggccatcagcggcgatgactgtgttgtgaaacccattgacgatcggtttgcgaccgcccttacagctctgaatgacatggggaaggtcagaaaagatatccctcagtgggaaccctccaagggctggaacgactggcaacaggtgcctttctgcagccaccattttcaccagctcattatgaaagatggacgcgagatcgttgtgccctgtcggaatcaggacgagctggtcggcagagcccgcgtgtctcaaggggctggatggtccctgcgggaaaccgcctgcctcggcaagagctatgctcagatgtggcagctgatgtacttccatagacgcgatcttcggctggccgcgaacgccatttgttctgctgtcccggtggactgggttcctacatccagaaccacgtggagcatccacgcccaccatcaatggatgacaaccgaggatatgctctccgtgtggaatcgggtctggatcgacgaaaacccctggatggagaataagacccacgtgtctagctgggaagaggttccctatctggggaaaagagaggatcagtggtgcggatcccttattggcctgacagcccgcgctacctgggccacaaacatccaggtggcgattaatcaggtccggagactcatcgggaacgaaaattacctggactacatgacgagcatgaagcgctttaaaaacgagtctgactccgaaggcgctctgtggtga

SEQ ID NO: 18729 - RNA, 9879 nt, synthetic construct
  misc_feature 1..9879: note = derived and/or modified CDS sequence (opt5) from DENV-1__KJ189366__SS-prME
  source 1..9879: mol_type = other RNA
agcgtgaccatgctgctcatgctgcttcccaccgccctggctttccacctcacgacccggggcggggagcctcatatgatcgtctccaaacaggaacggggaaaatctctgctttttaagacaagcgccggcgttaacatgtgcaccctgattgcgatggacctcggggagctgtgtgaagatacaatgacctacaaatgccccagaatcgctgaggccgaacccgacgatgtggactgttggtgcaatgccacagatacctgggtgacgtatggaacctgttcccaaacaggcgagcaccggcgggagaagcgctctgtcgctctggcccctcatgtggggctcggactggaaaccagaacagagacctggatgagctccgaaggcgcttggaaacagattcagcgggttgagacgtgggcccttcgccaccccggcttcacagtgatcgcgtttttcctggcccatgctattgggacctctatcacacagaagggaatcatttttatcctcctgatgcttgtcacccctagcatggccatgagatgcgtgggcattgggaaccgggacttcgttgagggactgtccggcgctacctgggtggatgtcgtgctcgaacacgggagctgtgtgacaacgatggccaagaataaacccaccctggacatcgagctgctcaagacagaagtcaccaaccctgcggttctgcgcaaactttgcattgaggccaagatctctaatacaaccacggattccagatgtccgacacaaggagaagctaccctggtggaggagcaggacgccaactttgtgtgccggcgcaccttcgtcgatagaggctggggcaatgggtgtggactctttggcaaagggagcctgcttacatgcgctaagttcaagtgcgtgaccaaactggaaggaaagattgttcagtacgagaacctcaaatattctgtgatcgtcacagtgcacacgggcgaccagcatcaagttgggaatgaaaccacagagcacggaaccatcgccacaattacaccccaggcccctacgtccgaaatccagctgaccgattacggcgctctgacactcgactgtagcccccggaccggcctggactttaacgagatggtgcttctgacaatgaaggagaaatcttggctcgtccataagcagtggttcctggatcttcctctgccctggacctccggggcgagcacgtcccaagaaacatggaatcgccaggacctcctggtgacctttaaaacagcccacgctaagaagcaggaggtcgtggttctgggatctcaagaaggcgccatgcacaccgccctcaccggggctacagagattcagacgagcggaaccacaaccatcttcgccggccatctgaaatgcagacttaagatggataaactgacactcaaggggatgtcctatgtgatgtgtaccggcagcttcaaactggaaaaggaggtcgcggagacgcagcacggaacagtgctggttcaggtgaagtacgaaggcaccgacgctccgtgcaaaattcctttttctacccaagatgagaagggggtcacacagaacggacggcttatcaccgccaatcccatcgtgacagacaaagaaaagcctgtgaacattgagacggagccgcccttcggcgaatcctatatcgttgtcggggccggagagaaagctctcaagctgagctggtttaagagaggctctagcattgggaaaatgttcgaagccaccgctcgcggcgcccggagaatggcgatcctgggagatacagcctgggactttggctccattgggggagtgttcacctctgtgggcaagctcgtccatcagatctttgggacagcttacggagtgctgttcagcggcgtttcctggaccatgaaaatcgggattggcatccttctgacgtggctcggactgaatagccgctctacctccctgagcatgacatgtattgccgtgggcatggtcaccctttacctcggggtgatggttcaggctgattctggatgcgtgatcaactggaagggccgggagctgaaatgtgggtccggaatttttgtcacaaacgaagtgcacacctggacagagcaatataagttccaggccgacagccctaagagactgtccgcggccatcggcaaggcttgggaggaaggggtttgcggcattcgctctgccacccggctcgagaatatcatgtggaagcagatcagcaacgaactgaatcatattcttctggagaacgatatgaaatttacggtggtcgtgggagacgctaatggcatcctcgcccaggggaagaaaatgattagaccgcaacccatggaacacaagtactcctggaaatcttggggaaaggccaagatcattggcgctgacatccagaacacaaccttcatcattgatgggcctgacacccccgagtgtcctgatggacagcgcgcgtggaatatctgggaggtggaagactatggctttggcgtcttcacaaccaacatttggctgaaactgcgggatagctacacgcagatgtgcgaccacagacttatgtccgccgctatcaaggatagcaaagccgttcatgccgacatggggtattggattgagtctgaaaagaatgagacatggaaactcgctcgcgcctccttcatcgaagtgaagacctgtacatggcccaagagccacaccctgtggtctaacggagtgctggagtccgagatgatcattccgaaaatctacggcgggcctattagccaacataattatcggcccggatactttacacagaccgcgggcccttggcacctcgggaagctggaacttgatttcgacctgtgcgagggaacgaccgtcgtggttgatgaacactgcggcaacagaggcccctctctccggacaaccacagtgaccgggaaaatcattcatgagtggtgttgccgcagctgtacgctgcctcccctgagatttcggggagaggacggctgctggtacgggatggaaatcagaccggtcaaggagaaagaagagaatcttgtgcgctccatggttagcgctggatctggcgaagtggattccttcagcctcgggatcctgtgtgtctccattatgatcgaggaggtgatgcggtctagatggagccgcaagatgctgatgacaggaaccctcgccgtttttctgcttctgattatgggccagctcacatggaacgacctgatcagactgtgcattatggtgggcgccaatgcttccgaccggatggggatgggaaccacctatcttgccctgatggcgacattcaagatgcgccctatgtttgctgtcggcctcctgttcagacggctcacgtctcgcgaagtgctgcttctgaccatcgggctcagcctggtggcctccgtcgagctgcccaactctcttgaggaactgggagatggcctcgccatggggattatgatgctgaaactcctgacagaatttcaaccccaccagctttggaccacactgctcagcctgaccttcgttaagacgacactgtcccttgactacgcttggaaaaccaccgccatggctctgagcatcgtgtctctctttcctctgtgtctctccacaaccagccagaagacaacgtggctgccggtgcttctgggatctttcggctgcaaacccctgaccatgtttctcatcacagagaacaagatttggggcagaaagtcctggcctctgaatgaggggatcatggccattggaatcgtcagcattcttctgtcttccctcctgaaaaacgatgtgcccctcgcgggccctctgatcgccgggggaatgcttatcgcttgttatgttattagcggctccagcgccgacctgtctctggaaaaggctgccgaggtgagctgggaacaggaggccgaacattccggggcttctcacagcatcctcgtcgaggtgcaagatgacggaaccatgaaaattaaggatgaggaacgggacgatacactgaccatccttctgaaagcgacgctcctggccgtttccggcgtgtaccccatgtctattcctgctaccctcttcgtctggtatttctggcagaagaaaaagcagcgcagcggcgtgctgtgggacacaccctccccgcctgaggtcgaaagagccgtgcttgataatgggatctaccggatcctgcagcgcggactgctcggcagatctcaagttggggtgggagtctttcaggacggcgtgttccataccatgtggcacgttacaagaggggccgtgctgatgtatcagggaaagagacttgagcccagctgggcttccgtcaaaaaggatctgattagctacggcggcgggtggcgctttcagggatcttggaacaccggcgaggaagtgcaagtgatcgccgttgagcctgggaaaaatcccaagaacgtccagacaacgccgggaaccttcaaaacacctgaaggcgaggtgggggcgattgctctcgactttaagcccggaacctccggcagccctatcgtgaatcgggaaggcaagattgtcgggctgtacggaaacggcgtggttaccacatctgggacgtatgtgtccgccatcgcccaggctaaagccagccaagagggacccctccccgagattgaagacgaggtcttcaagaaaagaaatctgaccatcatggatcttcaccctggctccgggaagacacgccggtacctgccggcgatcgtgagagaagctattaaacgcaagctgcggaccctcatcctggcccccacaagagttgtggcctctgagatggctgaagcccttaagggcatgcctattcgctatcagaccacggctgtcaaaagcgagcatacaggacgggagatcgtggacctgatgtgccacgccacctttaccatgagactcctgtcccccgttcgggtgcctaactacaatatgattatcatggatgaagcgcatttcacagaccccgccagcatcgctgcccgcggctatatttctaccagagtcgggatgggagaggctgccgccatctttatgacagctacccctccgggctccgtggaagcgttcccccagagcaacgccgtgattcaggatgaggaacgggacatccctgagcgctcttggaatagcgggtacgattggattacggactttcccggaaagacagtctggttcgttccttccatcaaatctggcaacgatatcgctaattgtctgagaaagaacgggaaacgggtgattcaactcagcagaaagaccttcgacacagagtatcagaagaccaaaaactccgattgggactacgtggtcacgaccgacatctctgaaatgggcgccaattttcgcgccgatcgggtgattgaccccagacgctgccttaagccggttatcctgaaagatggacctgagcgggtgattctggctggccccatgcccgtcacagccgcgagcgctgcccagagacgcgggcggatcggaagaaaccagaataaggaaggcgaccaatacgtgtatatggggcagcctctcaacaatgatgaggaccacgcccattggaccgaggctaaaatgctgcttgataacattaatacacccgaaggaatcatccctgccctgttcgagccggaacgcgagaagtccgcggccattgacggcgaatacagactcagaggggaagctcgcaagacctttgttgagctgatgagacggggcgatctgcccgtgtggctcagctataaagtcgcctctgaaggattccagtactccgaccgcagatggtgctttgatggcgagcggaacaatcaggtgcttgaagagaacatggacgtcgaaatctggacaaaggagggggagcgcaagaaactgcgccctcggtggctggatgctagaacctatagcgaccccctcgccctgcgcgagttcaaagagtttgctgccggacggagatccgtgtctggcgaccttattctggaaatcgggaaactccctcaacacctgacgctgcgggcgcagaatgccctcgataaccttgttatgctgcacaatagcgagcagggaggcaaggcttaccgccatgccatggaggaactgcccgacacaattgagaccctcatgctgcttgctctgatcgccgtgctcaccggcggggtgacactgttctttctgtccggaaagggcctcgggaagacctctatcggacttctgtgtgtcacagccagctccgctctgctctggatggcgagcgttgaaccgcactggattgccgcttctatcattctggagttctttcttatggtgctgctcatccctgaacccgatagacagcggacgcctcaagacaaccagctggcctatgtggtcattggcctcctgttcatgatccttaccgtggccgctaatgagatggggctgctggagacaaccaaaaaggatctcggaatcggctacgttgccgcggaaaaccatcagcacgtgacaatgctggacgtcgatcttcaccccgcctccgcttggaccctgtacgccgtggctacgaccgtcattacacctatgatgcgccataccatcgagaacgccacagcgaatattagcctcaccgccatcgctaaccaagccgctattctgatgggcctggacaaagggtggcccatctctaagatggatattggagtgccgctccttgccctgggctgctattcccaggttaatcctctgacgctcacagctgccgtgctgatgcttgtcgcgcactacgccatcatcgggcccggactgcaggctaaagccaccagagaagctcagaagcggacagccgccggcattatgaagaaccccaccgtggacgggatcgttgcgattgatctcgaccctgtggtctatgatgctaaatttgagaagcaactgggacagatcatgctgctcattctttgtaccagccagatcctgctgatgcgcacaacgtgggccctctgcgaatctatcaccctggctacaggcccgcttaccacactgtgggagggcagccccgggaaattctggaataccacgattgccgtgtccatggccaacatcttcagaggatcttacctcgctggcgccgggctggcgtttagcctgatgaagtccctcggaggcgggcggcgcggaacaggcgcccagggcgagacccttggggaaaaatggaagagacaactgaatcagctgagcaagtccgagttcaacacctataaacggtctggaattatggaagtggacagaagcgaggctaaggaaggcctcaaacgcggggagacaaccaagcatgccgtttcccggggaacagctaaactgagatggtttgtcgagcgcaatcttgtgaagcctgaaggcaaggtgatcgacctggggtgtggacggggcggctggtcttactattgcgccgggctcaaaaaggtcacggaggttaaaggatacaccaagggcgggcccggacacgaggaacctattcccatggcgacatacggctggaacctggtgaaactgcatagcgggaaggatgtgttctttatgcctccggaaaaatgtgacaccctcctttgcgatatcggagagtcctctcccaatcctacagtcgaggaaggcagaaccctgcgcgtgctgaagatggttgagccctggctccggggcaaccagttctgtatcaagattctgaatccttatatgcccagcgtggtcgaaacgcttgagagaatgcagcgcaaacacgggggaatgctggtgcggaacccgctctccagaaatagcacccacgagatgtactgggtttcttgcggcacagggaacatcgtgtccgccgtcaatatgaccagccgcatgctgctgaaccggtttacaatggctcatagaaagcctacctatgaacgcgacgtggatctcggagccggcacaagacacgtggctgtcgagcccgaagttgccaacctggacattatcgggcaacggattgagaatatcaaaaacgaacataagtctacctggcactacgatgaggacaatccctataaaacgtgggcttaccacggatcctatgaggtgaagcctagcggctctgcctccagcatggtgaacggcgtcgtgcgccttctgacaaagccctgggatgttattcctatggtgacccagatcgcgatgaccgacacaacgccgttcgggcagcaaagagtctttaaagaaaaggtggatacccggacacccagagccaaacggggaaccacacagatcatggaggttaccgctaagtggctctggggcttcctgtcccgcaataaaaagcctagaatttgtacacgggaagagtttacccgcaaggtgagaagcaacgccgctgtcggggccgtgttcgttgacgaaaatcagtggaactctgccaaagaggcggtggaggacgaacggttttgggatcttgtccatcgcgagagagaactgcacaagcagggaaaatgcgctacgtgcgtgtacaatatgatgggcaagcgggagaaaaagctcggggagttcggcaaggccaaaggaagccgcgccatctggtacatgtggctgggcgctagattcctggagtttgaggccctcgggttcatgaacgaagaccattggttttcccgggaaaattctctgagcggagtcgaaggcgaggggcttcacaagctgggatatattctccgcgatatctccaaaattcccggcgggaacatgtacgctgacgataccgccggctgggacacaagagtgaccgaggatgacctgcaaaatgaagcgaagatcacagatatcatggagcctgaacatgcccttctggctacctctattttcaaactcacgtatcagaacaaggttgtgcgggtccagcgccccgccaaaaatggaacagtgatggacgtgatcagcagacgggatcagagaggctccgggcaagttggaacctacggcctgaacacatttaccaacatggaggtgcagctgattcgccagatggaatctgaggggatcttcctcccgagcgagctggaaacgcctaatcttgctgagcgggccctggactggctcgaaaagcacggagcggagagactgaagcgcatggccatttccggcgatgactgtgtcgtgaaacccatcgacgatcggtttgctaccgcccttacagctctgaacgacatggggaaggttagaaaagatatccctcagtgggaacccagcaagggctggaatgactggcaacaggtgcctttctgctctcaccattttcaccagctcattatgaaagatggacgcgagatcgtcgtgccctgtcggaaccaggacgagctggtcggcagagcccgcgtgtcccaaggggctggatggagcctgcgggaaaccgcctgcctcggcaagtcttatgcgcagatgtggcagctgatgtacttccatagacgcgatcttcggctggccgctaatgccatttgttccgccgttccggtggactgggtccctacaagcagaaccacatggtccatccacgctcaccatcaatggatgaccacggaggatatgctctctgtgtggaaccgggtttggattgaagagaatccctggatggaaaacaagacacacgtgagctcctgggaggaggtcccctatctggggaaaagagaagaccagtggtgcggaagccttatcggcctgaccgcccgcgcgacctgggctacaaatatccaggtggccattaaccaggtgcggagactcatcgggaatgagaactacctggattacatgacctctatgaagcgctttaaaaatgaatccgacagcgagggcgccctgtggtga

SEQ ID NO: 18730 - RNA, 9879 nt, synthetic construct
  misc_feature 1..9879: note = derived and/or modified CDS sequence (opt5) from DENV-1__JN819417__SS-prME
  source 1..9879: mol_type = other RNA
agcgtgaccatgctgctcatgctgcttcccacagctctggctttccacctcacgaccagaggcggggagcctcatatggtcgtttccaagcaggaacgggggaaatctctgctttttaagacaagcgccggcgtgaatatgtgcaccctgatcgcgatggacctcggggagctgtgtgaagatacaatgacctacaaatgccccagaattacagaggctgaacccgacgatgtggactgttggtgcaatgccaccgatacgtgggtcacctatggaacatgttcccaaaccggcgagcacagacgggacaagcgctctgtggccctggctcctcatgttgggctcggactggagacaagaaccgaaacgtggatgagctccgagggcgcctggaaacagatccagaaggtggaaacatgggcccttcggcaccccggcttcaccgtcattgccctgtttctcgcgcatgccatcgggacatctattacccagaagggaatcatcttcattctgcttatgctggtgacccctagcatggctatgcgctgcgttggcatcgggaacagagattttgtggagggactctccggcgccacatgggtcgacgtggtgctggagcacgggagctgtgtcacgaccatggctaaaaataagcccacactggatattgaactcctgaaaaccgaggttacaaaccctgccatccttcggaagctgtgcattgaagcgaaaatctctaataccacgacagactcccgctgtccgacccaaggagaggccaccctcgtggaagaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagcacgaaaacctgaagtactctgtgatcgtcacggtgcataccggcgatcagcaccaagttgggaatgagacaaccgaacatggaacaatcgctaccattacgccccaggcccctacctccgagatccagctgacagactatggcgccctcaccctggactgtagccccagaacaggccttgatttcaacgaaatggtgctgctcaccatgaaagagaagtcttggctggtccacaaacagtggtttcttgacctgcctctcccctggacgtccggggctagcacatcccacgagacctggaatcggcaagatctgctggtgacattcaagaccgcgcatgccaagaaacaggaagtcgtggttctcggatctcaggagggcgctatgcacaccgccctgacaggggccacggaaattcaaaccagcggaacaaccacaatctttgctggccatcttaagtgccgcctgaaaatggacaagctcaccctgaaagggatgtcctacgtgatgtgtacgggcagcttcaagctggagaaggaagtcgccgagacacagcacggaaccgtgcttgttcaggtgaaatatgagggcaccgatgcgccgtgcaagattcctttctctacacaggacgaaaaaggggtcacccaaaacggaagactcatcacagctaatcccatcgtgacggataaggagaaacctgtgaacattgaaaccgagccgccctttggcgagtcctacatcgttgtcggggccggagaaaaggccctgaagctgagctggttcaaaaagggctctagcattgggaaaatgtttgaggctacagcccggggcgctagacgcatggccatcctcggagacaccgcgtgggatttcggctccattgggggagtgtttacatctgtgggcaagctggtccatcaggtgttcgggaccgcctatggagttctttttagcggcgtgtcctggacgatgaaaatcgggatcggcattctgctcacctggctgggactgaatagccggtctacatcccttagcatgacctgtatcgctgtcggcatggtgacactctacctgggggttatggtgcaggccgactctggatgcgtcattaactggaagggcagagaactgaagtgtgggtccggaatcttcgtgaccaacgaggttcacacatggaccgaacagtacaaatttcaagctgatagccctaagcgcctctccgccgcgattggcaaagcctgggaggagggggtgtgcggcatccggtctgctacgagactggaaaatattatgtggaagcagatcagcaacgagcttaatcacatcctgctcgaaaacgacatgaaattcacagtcgtggtgggagacgcctccggcattctggctcaggggaagaaaatgatccgcccgcagcccatggagcataagtattcttggaaaagctggggaaaggccaagattatcggcgccgatacccaaaataccacatttattatcgacgggcctgatacccccgaatgtcctgacgatcagcgggcttggaacatctgggaggtcgaggactacggattcggcatttttacgacaaatatctggctgaaacttagagattcctatacccagatgtgcgaccaccgcctcatgagcgcggccattaaggattctaaagctgttcatgccgacatgggctactggatcgaatccgagaagaacgaaacatggaagctggcccgggctagcttcattgaggtgaaaacctgtatctggcccaagtctcacacactgtggtccaatggggtgctcgaaagcgagatgatcattccgaaaatctatggaggccctatttctcagcacaactacagacccgggtatttcacccaaacggccggaccttggcatctgggcaaacttgagctggattttgacctctgcgaagggaccacagtcgtggttgatgagcactgcggaaatcgcggccccagcctgcggaccacaaccgtgacgggcaaaatcattcatgaatggtgttgcagatcctgtacactgcctccccttcggttccgcggggaggacggatgctggtacggcatggagatcagaccggtcaaggaaaaggaggaaaacctcgtgcggagcatggtttctgcggggtccggagaggtggacagcttttccctgggcatcctgtgtgtctctattatgatcgaagaggtgatgagaagccgctggtcccggaaaatgctcatgaccgggacactggctgttttccttctgctcattatgggacagctgacctggaatgatctgatcagactttgcattatggtgggcgccaacgcctctgaccgcatgggcatggggaccacatacctggctctcatgggaacgtttaagatgagacctatgttcgccgtcggcctgctctttcggcgcctgaccagcagagaggtgcttctgctcacaatcgggctgtccctggtggcgtctgtcgaacttcccaatagcctggaggaactcggagatggcctggctatggggattatgatgctcaaactgcttaccgagttccagccccaccaactgtggacaaccctcctgtccctgacgtttatcaagacaacccttagcctggactatgcctggaaaaccatggccatggttctctctatcgtgtccctgttccctctctgtctgagcacaacctctcagaagacaacgtggcttccggtgctgctgggatcctttggctgcaagcccctcaccatgttcctgattacagaaaacaaaatctggggcagaaagagctggcctcttaacgaggggattatggctatcggaattgtctctatcctgctctccagcctgctcaaaaatgatgtgcccctggccggccctcttatcgctgggggaatgctgattgcctgttacgttatctccggcagctctgcggacctgagcctcgagaaggccgctgaaatttcctgggaggaagaggccgaacattctgggaccagccacaacatcctggtggaggtccaggatgacggaacaatgaaaattaaggatgaggaacgcgacgatacccttacgatcctgctcaaagctaccctgctcgccgtgtccggcgtttatcccatgtctatccctgccacactgtttgtgtggtacttctggcagaagaagaaacaaagaagcggcgtcctttgggacaccccctccccgcctgaggtggaacgggctgtcctggatgacgggatttatcgcatcctgcagagaggactcctgggccggtctcaggtgggggttggagtgttccaggacggcgtctttcacacaatgtggcatgtgacccgcggggcggttcttatgtaccaaggaaagagactggagcccagctgggcctccgtgaaaaaggatctcattagctatggcggcgggtggcggttccagggatcttggaatacaggcgaggaagtccaggtgatcgctgtggagcctgggaaaaaccccaagaatgttcagacgaccccgggaacatttaagacccctgaaggcgaggtcggggccattgccctggacttcaaacccggaacctccggcagccctatcgtgaacagagaaggcaagattgtggggctctacggaaatggcgtcgtgacaacgtctgggacctacgtttccgctatcgcccaagcgaaagctagccaggagggacccctgcccgagatcgaagatgaggtgtttaagaaacgcaaccttacaattatggacctgcaccctggctccgggaagacccggagatatctgccggccatcgtccgcgaagccattaagcggaaactcagaacactgatccttgctcccacccgcgtggttgcctctgagatggcggaagctctgaagggcatgcctattcggtaccagacgacagccgtgaaaagcgagcataccggaagagagatcgtcgatctcatgtgccacgccaccttcacaatgcgcctgctgtcccccgtgcgggttcctaattataacatgatcattatggacgaagctcattttaccgatcccgccagcatcgctgccagaggctacatttctacacgggtggggatgggagaggcggccgctatcttcatgaccgccacgcctccgggctccgtcgaggcttttccccaaagcaatgccgtgattcaggacgaggaacgcgatatccctgagagatcttggaacagcgggtatgactggatcacagatttccccggaaagaccatttggtttgtgccttccatcaaatctggcaatgacattgccaactgtctccggaagaatgggaagcgcgtcatccagcttagcagaaaaacattcgacaccgagtaccagaagacgaaaaacaacgattgggactatgttgtgaccacagatatttccgaaatgggcgctaatttccgggcggacagagtgatcgatccccgccggtgcctgaagccggtcattctgaaagacggacctgagagagtgatcctcgccggccccatgcccgttaccgtggcttctgccgcccaacgccgggggagaatcggacgcaaccagaataaggaaggcgatcagtacgtctacatggggcagcctctgaacaatgacgaggatcacgctcactggacagaggccaagatgcttctggacaacattaatacccccgaaggaatcattcctgcgctctttgagccggaacgggagaaaagcgctgccatcgatggcgaatatagactgcgcggggaggccagaaagacattcgtggagctgatgcggcgcggcgacctccccgtttggctttcctacaaagtggctagcgaaggatttcaatattctgatagacggtggtgcttcgacggcgagcgcaacaatcaggtcctggaagagaacatggacgtggaaatttggaccaaggagggggagcgcaagaagctgcggcctagatggctcgatgcccgcacgtactccgaccccctggcgcttcgggaatttaaagagttcgccgctggaagacgcagcatctccggcgatctgatcctcgaaattgggaagctgcctcagcatctgacactccgggcccagaatgctcttgacaacctggtcatgctgcacaattctgagcaaggaggcaaggcctatagacatgctatggaggaactccccgataccatcgagaccctgatgcttctggccctcattgcggtgctgacaggcggggttaccctgtttttcctcagcggaaaaggccttgggaagacatccatcggactgctgtgtgtgatggcctctagcgctctcctgtggatggccaacgtggaaccgcactggattgctgcctccatcatccttgagtttttcctgatggtcctcctgattcctgaacccgaccggcagcgcacgcctcaggataatcagctggcctacgttgtgatcggcctcctttttatgattctgaccgtggctgcgaacgagatggggctgctcgagacaaccaaaaaggacctgggaatcggccacgtcgccgctgaaaaccatcaccatgccacaatgcttgatgtggacctgagacccgccagcgcttggaccctctatgccgttgcgacgaccgtgattacacctatgatgcggcacaccatcgagaatacaaccgccaacatttctctgacggctatcgccaatcaagctgccatcctgatgggcctcgataaagggtggcccatttccaagatggacatcggagtcccgcttctggcgctgggctgctacagccaggtgaaccctctcacactgaccgccgctgtccttatgctggtggcccattacgctattatcgggcccggactccaggccaaggctacacgcgaagcccagaagcggaccgcggccggcattatgaagaatcccaccgttgatgggatcgtggctatcgacctggaccctgtcgtgtatgatgccaaattcgagaagcagctgggacagattatgctccttatcctgtgtacatctcagattctgctcatgcggacgacctgggctctgtgcgaatccatcacacttgccaccggcccgctgacaaccctctgggagggcagccccgggaaattttggaacacgacaattgccgtttctatggcgaatatcttccgcggaagctacctggctggcgccgggctggctttctccctcatgaagtctcttggaggcgggagacggggaaccggcgcccaaggcgagaccctgggggaaaagtggaaacgccagctgaaccagctcagcaagtccgagtttaatacatataaaagaagcggaatcatggaagtggaccggtccgaggccaaggaaggcctgaaaagaggggagaccacaaagcacgctgtctctcgcggaacggccaaacttcggtggttcgtggagagaaacctggtgaaacctgaaggcaaggttattgatctcgggtgtggacgcggcggctggagctactattgcgcggggctgaaaaaggtcaccgaggtgaaaggatacacaaagggcgggcccggacacgaggaacctatccccatggccacctatggctggaatctggtgaaactccattccgggaaggacgtctttttcacacctccggaaaagtgtgatacccttctgtgcgacattggagagtctagccccaaccctacgatcgaggaaggccggaccctgagagttctcaaaatggtggagccctggctgcgcggcaatcagttttgtattaagatccttaacccttacatgccctccgtggtcgaaacactggagcaaatgcagcggaaacacgggggaatgctcgtgagaaatccgctgtctcgcaacagcacccatgagatgtactgggtttcctgcggcacagggaatattgtgagcgctgtcaacatgacctctcggatgctgctcaacagattcacaatggcccaccgcaagcctacctatgaaaaagatgtggacctgggagctggcacgcggcacgttgccgtggagcccgaagtcgcgaatcttgatatcatcgggcagagaattgagaacatcaagaatgaacataagtccacatggcactacgacgaggataacccctataaaacctgggcctaccatggaagctatgaggtgaagccttctggctccgctagctctatggtgaatggcgtcgttcgcctgctcaccaaaccctgggacgtgattcctatggtgacacagatcgccatgacggacaccacaccgtttgggcaacagagagtcttcaaggaaaaagtggatacccggacaccccgcgctaagagaggaaccgcccagattatggaggttacagctaagtggctgtggggctttctttcccggaacaaaaagcctagaatctgtacccgggaagagttcacgaaaaaggtgcgcagcaatgccgcgatcggggccgtctttgtggacgaaaaccaatggaactccgctaaagaggccgttgaggatgaaagattctgggacctggtgcaccgggagcgcgaactccataagcagggaaagtgcgctacctgcgtctacaacatgatgggcaaaagagagaagaaactgggggaatttggcaaggccaaaggaagccgggccatttggtatatgtggctgggcgcgcgcttcctcgagttcgaggctctggggtttatgaatgaagatcactggttctctagagagaacagcctttccggagtggaaggcgaggggctgcacaagctcggatacatcctgcgggacatttctaaaatccccggcgggaatatgtacgccgatgacacagccggctgggatacccgcattacagaggacgatcttcagaacgaagctaagatcaccgacatcatggagcctgaacatgccctgctcgctacgagcatttttaagctgacatatcagaataaagttgtgagagtccaacggcccgccaagaacggaaacgtgatggatgtcatctcccgcagagaccagcggggctctggacaggtgggaacctacggcctgaatacattcaccaacatggaggttcagctcattcgccaaatggaaagcgaggggatctttctgccgtccgagcttgaaacgcctaatctggcggagagagtgctcgactggctggaaaaacacggagccgagcggcttaagagaatggctatttctggcgatgactgtgtcgtgaaacccatcgatgaccgcttcgccaccgctctgatcgccctcaacgatatggggaaggtgcggaaggacattcctcagtgggaacccagcaaaggctggaatgattggcagcaggttcctttttgctcccatcacttccaccaactgatcatgaaggacggaagagagattgtggtcccctgtcgcaaccaggatgagctggtgggccgggcgagagttagccagggggccggatggtctctccgcgaaacagcttgcctgggcaaatcctatgcccagatgtggcaacttatgtactttcatcggagagacctgcgcctcgctgccaatgctatctgtagcgccgtgccggtcgattgggtgcctacctctcggacaacctggtccattcacgcgcatcaccagtggatgacaaccgaggacatgctgagcgtctggaacagagtgtggatcgaagagaatccctggatggaagacaagacgcatgtttcctcttgggaggaggtgccctatcttgggaaacgcgaagatcagtggtgcggaagcctgattggcctcacagcccgggctacctgggccaccaacatccaagtcgccatcaatcaggtgagacggctgattgggaacgagaattacctggactatatgacatccatgaagagattcaagaacgaaagcgatcctgagggcgctctctggtga

SEQ ID NO: 18731 - RNA, 9879 nt, synthetic construct
  misc_feature 1..9879: note = derived and/or modified CDS sequence (opt5) from DENV-1__FJ687426__SS-prME
  source 1..9879: mol_type = other RNA
agcgtgaccatgctgctgatgctgatgcccacagcccttgctttccacctgacgacccggggcggggaacctcatatgatcgtgtccaagcaggaacggggaaagtctctcctgtttaagaccagcgccggcgttaacatgtgcacccttattgccatggacctgggggaactctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccagggagaggccaccctggtggaagaacaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagtacaaatattcttggaaaagctggggaaaggccaagatcattggcgctgacgtgcaaaattccacctttatcatcgatgggcctaacacccccgaatgtcctgacgatcagagagcgtggaatatttgggaggtcgaggactacggattcggcatctttacaaccaacatttggctgaaacttcgcgatagctatacgcaggtttgcgaccaccggctcatgtctgccgctatcaaagattccaaggccgtgcacgccgacatgggctactggattgaaagcgagaaaaatgaaacatggaagctggctggggcctctttcatcgaggtgaagacctgtatctggcccaaatcccatacactgtggagcaacggagtcctcgaatctgagatgattatcccgaagatttatggcgggcctatcagccaacacaattacagacccggatacttcacccagacagcgggcccttggcatctggggaaacttgagctggattttgacctctgcgaaggaaccacggtggttgtggatgagcactgcggcaaccgcggcccctccctgcggaccacaaccgtcacagggaagattatccacgaatggtgttgcagaagctgtaccctgcctccccttcggttccgcggagaggacggctgctggtatgggatggagatcagaccggtgaaagaaaaggaggaaaatctcgttaagtctatggtgtccgctggaagcggcgaggtcgactccttttctctggggctgctctgtattagcatcatgattgaagaggtgatgcggtccagatggtctcgcaaaatgctgatgacgggaacacttgccgttttctttctgctcatcatgggccagctgacctggaacgatctgattcggctttgcatcatggtgggcgccaatgctagcgacagaatggggatgggaacaacctacctggccctcatggcgaccttcaagatgcgccctatgtttgctgtcggcctgctgttcagacggctgacatcccgcgaggtgcttctgctcacgattgggctgtctctggtggccagcgtcgaacttcccaactccctggaggaactcggagatggcctggccatggggatcatgatcctcaaactgcttaccgactttcaaagccatcagctgtgggctacactcctgtctctgaccttcattaagacaaccctttccctgcactatgcctggaaaacgatggctatggttctcagcatcgtgtctctgtttcccctctgtctgtccacaaccagccagaagaccacatggcttcctgtgctgctgggatctctcggctgcaagccgctgaccatgttccttattgccgagaataaaatctggggcagaaagtcctggcccctgaacgaagggattatggcggtcggaatcgtgagcatcctcctgtccagcctcctgaaaaacgatgttcctcttgccggccccctgattgctgggggaatgctgatcgcctgttacgtgatttctggcagctccgctgacctctctctggagaaggccgccgaggtcagctgggaagaggaagctgagcattccggggcgtctcacaatatccttgtggaagttcaggatgacggaacaatgaaaattaaggatgaggagcgggacgatacgctgaccatcctcctgaaagccacactcctggctgtgagcggcgtctatcctctttccatccccgccaccctgtttgtgtggtacttctggcaaaagaagaaacagcgctctggcgtcctgtgggacacacctagccctcccgaagtggagagagccgttctcgatgacgggatttatcggatcatgcagcgcggactgcttggcagatcccaggtgggggtcggagtgttccaagaaaacgtttttcataccatgtggcacgtgacgcggggcgctgtcctgatgtaccaggggaagcgcctcgagcccagctgggcctctgtgaaaaaggacctgatttcctacggaggcggctggagactccaggggagctggaataccggagaggaagtgcaggttatcgcggtcgagcccggcaaaaaccctaagaatgtgcaaacagctcccgggaccttcaagacaccggaaggagaggtgggcgccattgccctggattttaaacctgggacctctggatcccccatcgtcaaccgggaaggcaagattgtgggcctttatgggaatggagttgtgacaacgagcggcacctacgtctccgctatcgcccaggcgaaggcttctcaggaggggcctctgcccgagatcgaagacgaggtgttcagaaagcgcaacctgacaattatggatctccaccccggaagcggcaaaacccggagatatctgcctgccatcgttcgcgaagccattaagcggaaacttagaaccctgatcctcgctccgacacgcgtggtcgcctccgagatggctgaagccctgaaagggatgcccattcggtaccaaacgaccgcggtcaagagcgagcatacaggcaaagagatcgttgacctgatgtgccacgccacctttacaatgagactcctttctcctgtgcgcgtccccaattataacatgatcattatggatgaagctcatttcaccgacccttccagcatcgccgctcggggatacatttctacgagagtgggcatgggggaggccgccgctatctttatgacagcgacaccccctggaagcgtggaagccttcccgcagtccaatgctgtcattcaggatgaggaacgggacatccccgagcgctcttggaacagcggctatgagtggatcaccgattttcctgggaagacagtttggttcgtgccctccattaaagccggaaatgacatcgccaactgtctgagaaagaatggcaagcgggtgattcagctgtctcgcaaaacctttgatacagaataccaaaagaccaaaaacaacgactgggactacgtcgtgacgacagatatcagcgagatgggggctaatttcagagccgaccgggttattgatcctagacgctgcctcaagcccgtgatcctgaaagacggcccggaacgggtcattcttgcgggacctatgcccgtgaccgttgcttccgccgcccagagacgcggccggatcgggagaaaccacaataaggagggagatcagtatatctacatgggccagcccctgaacaatgacgaggatcatgctcactggacagaagccaagatgctcctggacaacattaatacccctgaggggatcattcccgcgctgttcgaacctgagcgcgaaaagagcgccgctatcgatggagagtatcggctcagaggcgaggcccgcaagacgtttgtggaacttatgagaagaggggacctgccggtctggctgtcttacaaagtggcttccgagggcttccaatatagcgatcgcagatggtgctttgacggagaacggaacaatcaggtcctcgaggaaaacatggatgtggagatttggaccaaggagggcgaacgcaaaaagctgagaccccggtggcttgacgccagaacatactccgaccctctggctctccgcgagttcaaagaatttgccgcggggcggagatctgttagcggagatctgatcctggagatcggcaagctcccccagcaccttacccagcgcgcccaaaatgctctggacaacctggtgatgctccataattccgaacaagggggacgggcctatagacacgctatggaggagctgcctgatacaattgaaacccttatgctgctcgccctgatcgccgtgctgacaggcggcgtcaccctcttctttctttctgggaagggactgggcaaaacgagcattgggctgctctgtgttatggcttccagcgtgctgctttggatggcgtctgtggagccccattggatcgccgcttccattatcctggagttctttctcatggtcctgctgatcccggagcctgaccggcagcgcacaccccaggataaccaactcgcctacgtggttattggacttctgttcatgatcctgaccgtggccgctaatgagatgggcctcctggaaaccacaaagaaagaccttgggattggacacgtcgccgtggagaaccaccatcacgcggccatgctggatgtcgacctccatcctgctagcgcctggaccctgtacgctgtggccacaacgatcattacccccatgatgagacacacaatcgaaaacaccacagcgaatatttctctgaccgccatcgctaaccaggccgctatcctcatgggccttgataagggctggcctatttccaaaatggacatcggggttcccctgctggccctcggatgctatagccaggtgaatccgctgacgcttaccgctgccgtcctgatgctcgtggcgcattacgccattatcggccctgggctgcaagctaaggccacacgggaggctcagaagcgcaccgccgccggaattatgaaaaaccccacaatcgatggcatcgttgcgattgacctggatcccgtggtctatgacgctaagtttgaaaaacagctcgggcagatcatgcttctgattctgtgtacctctcaaatcctcctgatgagaacgacatgggccctttgcgagagcattaccctggctacaggacctctcaccaccctgtgggagggctccccgggcaagttctggaatacaacgatcgccgtgtctatggccaacatctttcgggggagctacctggctggagccggcctcgcgttctcccttatgaaaagcctcgggggaggccgcagagggaccggagcccagggcgaaacactgggcgagaagtggaagcggcagctcaatcagctgtccaaatctgagttcaacacctataagcgcagcgggattatggaggtggacagatccgaagctaaagagggacttaagcggggcgagacaaccaaacacgccgtttctagagggacggctaagctgcgctggtttgtcgaacggaatctcgtgaagcccgagggaaaagtgatcgatctgggctgtgggagaggaggctggagctactattgcgccggcctgaagaaagtcacagaagttaaggggtacaccaaaggaggccctgggcacgaggaacccattcctatggcgacctacggatggaacctcgtgaaacttcattccggcaaagacgtgttctttattccccctgagaagtgtgatacactgctgtgcgacatcggggagtctagcccgaatcccaccatcgaagagggacgcacactccgggtcctgaagatggtggaaccttggcttagaggcaaccaattctgtattaaaatcctgaatccctatatgccttccgttgtggagacgctcgagcagatgcagcgcaagcacggcgggatgctggtccggaaccccctgagcagaaattctacccatgaaatgtactgggtgtcctgcggaacaggcaacatcgttagcgccgtgaatatgacctctcgcatgctcctgaaccggtttacaatggctcacagaaaaccgacctatgagcgcgatgtcgaccttggggccggaacgcggcacgtggctgtggaacctgaggtcgccaacctggatattatcggccagagaattgaaaatatcaagcatgagcacaaatccacctggcattacgacgaggataacccctataagacatgggcttaccacgggagctatgaagttaagccctctggatccgccagctccatggtgaatggcgtggtcaaactcctgaccaagccttgggacgtgattcccatggttacacaaatcgcgatgaccgatacaacccctttcggccagcagcgcgtgtttaaagagaaggtcgacacgagaacaccgaaagccaagcgggggaccgctcaaatcatggaagtgaccgccaagtggctttggggattcctgagccgcaacaaaaagcccagaatttgtacacgggaggaatttacgagaaaagttcggtctaatgctgccatcggcgccgtgttcgtcgacgagaaccagtggaatagcgcgaaggaggctgtggaagatgaccgcttttgggatctcgttcatagagagcgggaactgcacaaacaggggaagtgcgcgacctgcgtgtacaacatgatgggaaagcgcgagaaaaagctgggcgagttcgggaaagccaagggctccagagctatttggtacatgtggctcggagcccggtttctggagttcgaggctcttggcttcatgaatgaagaccactggttttctcgcgagaacagcctgtccggggtcgaaggagagggcctccataaactggggtatatccttagagatatttctaagatccctggaggcaatatgtacgccgacgatacagcggggtgggacacccggatcacagaggatgacctgcagaacgaagccaaaattaccgatatcatggagcccgaacacgctctcctggccaagagcattttcaagctgacatatcaaaataaagtggtccgcgtgcagagacctgctaagaacggcaccgttatggacgtgatctcccggcgcgatcagagaggatctggccaggtcgggacgtacggactcaatacctttacaaacatggaggcccaactgattcggcagatggaaagcgagggcatcttctcccccaacgagcttgaaaccccgaatctggcggagcgcgtgctcgactggctggaaaaatatggggtggagagacttaagcggatggccatcagcggagacgattgtgttgtgaaacctattgacgatagatttgctacagccctgaccgctctcaacgacatgggcaaggtccgcaaggatatcccccagtgggaaccttctaaagggtggaatgactggcagcaagtgcccttctgctcccatcactttcaccagctgattatgaaggatggccgggagatcgttgtgccttgtagaaaccaggacgagctggtcggacgcgcccgggtgagccagggcgctgggtggtctctcagagaaacggcctgcctgggaaaatcctacgcgcaaatgtggcagcttatgtatttccatcgccgggatctgagactcgccgctaatgccatttgtagcgccgtccccgtggactgggttccgacatcccgcaccacatggtctatccacgctcatcaccagtggatgaccacggaggatatgctgagcgtgtggaaccgggtctggattgaagagaatccttggatggaagacaagaccagaatctccagctgggaggacgtgccctaccttggcaaacgcgaggatcaatggtgcgggtctctgatcggactcacagcccgggcgacctgggctacaaacattcaggttgccatcaatcaggtgagacggctgattggcaacgaaaattactccgactatatgaccagcatgaagagatttaagaacgagtctgaacccgagggggccctgtggtga

SEQ ID NO: 18732 - RNA, 9879 nt, synthetic construct
  misc_feature 1..9879: note = derived and/or modified CDS sequence (opt5) from DENV-1__FJ687428__SS-prME
  source 1..9879: mol_type = other RNA
agcgtgaccatgctgctgatgctgatgcccacagcccttgctttccacctgacgacccggggcggggaacctcatatgatcgtgtccaagcaggaacggggaaagtctctcctgtttaagaccagcgccggcgttaacatgtgcacccttattgccatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccagggagaggccaccctggtggaagaacaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagtacaaatattcttggaaaagctggggaaaggccaagatcattggcgctgacgtgcaaaattccacctttatcatcgatgggcctaacacccccgaatgtcctgacgatcagagagcgtggaatatttgggaggtcgaggactacggattcggcatctttacaaccaacatttggctgaaacttcgcgatagctatacgcaggtttgcgaccaccggctcatgtctgccgctatcaaagattccaaggccgtgcacgccgacatgggctactggattgaaagcgagaaaaatgaaacatggaagctggctggggcctctttcatcgaggtgaagacctgtatctggcccaaatcccatacactgtggagcaacggagtcctcgaatctgagatgattatcccgaagatttatggcgggcctatcagccaacacaattacagacccggatacttcacccagacagcgggcccttggcatctggggaaacttgagctggattttgacctctgcgaaggaaccacggtggttgtggatgagcactgcggcaaccgcggcccctccctgcggaccacaaccgtcacagggaagattatccacgaatggtgttgcagaagctgtaccctgcctccccttcggttccgcggagaggacggctgctggtatgggatggagatcagaccggtgaaagaaaaggaggaaaatctcgttaagtctatggtgtccgctggaagcggcgaggtcgactccttttctctggggctgctctgtattagcatcatgattgaagaggtgatgcggtccagatggtctcgcaaaatgctgatgacgggaacacttgccgttttctttctgctcatcatgggccagctgacctggaacgatctgattcggctttgcatcatggtgggcgccaatgctagcgacagaatggggatgggaacaacctacctggccctcatggcgaccttcaagatgcgccctatgtttgctgtcggcctgctgttcagacggctgacatcccgcgaggtgcttctgctcacgattgggctgtctctggtggccagcgtcgaacttcccaactccctggaggaactcggagatggcctggccatggggatcatgatcctcaaactgcttaccgactttcaaagccatcagctgtgggctacactcctgtctctgaccttcattaagacaaccctttccctgcactatgcctggaaaacgatggctatggttctcagcatcgtgtctctgtttcccctctgtctgtccacaaccagccagaagaccacatggcttcctgtgctgctgggatctctcggctgcaagccgctgaccatgttccttattgccgagaataaaatctggggcagaaagtcctggcccctgaacgaagggattatggcggtcggaatcgtgagcatcctcctgtccagcctcctgaaaaacgatgttcctcttgccggccccctgattgctgggggaatgctgatcgcctgttacgtgatttctggcagctccgctgacctctctctggagaaggccgccgaggtcagctgggaagaggaagctgagcattccggggcgtctcacaatatccttgtggaagttcaggatgacggaacaatgaaaattaaggatgaggagcgggacgatacgctgaccatcctcctgaaagccacactcctggctgtgagcggcgtctatcctctttccatccccgccaccctgtttgtgtggtacttctggcaaaagaagaaacagcgctctggcgtcctgtgggacacacctagccctcccgaagtggagagagccgttctcgatgacgggatttatcggatcatgcagcgcggactgcttggcagatcccaggtgggggtcggagtgttccaagaaaacgtttttcataccatgtggcacgtgacgcggggcgctgtcctgatgtaccaggggaagcgcctcgagcccagctgggcctctgtgaaaaaggacctgatttcctacggaggcggctggagactccaggggagctggaataccggagaggaagtgcaggttatcgcggtcgagcccggcaaaaaccctaagaatgtgcaaacagctcccgggaccttcaagacaccggaaggagaggtgggcgccattgccctggattttaaacctgggacctctggatcccccatcgtcaaccgggaaggcaagattgtgggcctttatgggaatggagttgtgacaacgagcggcacctacgtctccgctatcgcccaggcgaaggcttctcaggaggggcctctgcccgagatcgaagacgaggtgttcagaaagcgcaacctgacaattatggatctccaccccggaagcggcaaaacccggagatatctgcctgccatcgttcgcgaagccattaagcggaaacttagaaccctgatcctcgctccgacacgcgtggtcgcctccgagatggctgaagccctgaaagggatgcccattcggtaccaaacgaccgcggtcaagagcgagcatacaggcaaagagatcgttgacctgatgtgccacgccacctttacaatgagactcctttctcctgtgcgcgtccccaattataacatgatcattatggatgaagctcatttcaccgacccttccagcatcgccgctcggggatacatttctacgagagtgggcatgggggaggccgccgctatctttatgacagcgacaccccctggaagcgtggaagccttcccgcagtccaatgctgtcattcaggatgaggaacgggacatccccgagcgctcttggaacagcggctatgagtggatcaccgattttcctgggaagacagtttggttcgtgccctccattaaagccggaaatgacatcgccaactgtctgagaaagaatggcaagcgggtgattcagctgtctcgcaaaacctttgatacagaataccaaaagaccaaaaacaacgactgggactacgtcgtgacgacagatatcagcgagatgggggctaatttcagagccgaccgggttattgatcctagacgctgcctcaagcccgtgatcctgaaagacggcccggaacgggtcattcttgcgggacctatgcccgtgaccgttgcttccgccgcccagagacgcggccggatcgggagaaaccacaataaggagggagatcagtatatctacatgggccagcccctgaacaatgacgaggatcatgctcactggacagaagccaagatgctcctggacaacattaatacccctgaggggatcattcccgcgctgttcgaacctgagcgcgaaaagagcgccgctatcgatggagagtatcggctcagaggcgaggcccgcaagacgtttgtggaacttatgagaagaggggacctgccggtctggctgtcttacaaagtggcttccgagggcttccaatatagcgatcgcagatggtgctttgacggagaacggaacaatcaggtcctcgaggaaaacatggatgtggagatttggaccaaggagggcgaacgcaaaaagctgagaccccggtggcttgacgccagaacatactccgaccctctggctctccgcgagttcaaagaatttgccgcggggcggagatctgttagcggagatctgatcctggagatcggcaagctcccccagcaccttacccagcgcgcccaaaatgctctggacaacctggtgatgctccataattccgaacaagggggacgggcctatagacacgctatggaggagctgcctgatacaattgaaacccttatgctgctcgccctgatcgccgtgctgacaggcggcgtcaccctcttctttctttctgggaagggactgggcaaaacgagcattgggctgctctgtgttatggcttccagcgtgctgctttggatggcgtctgtggagccccattggatcgccgcttccattatcctggagttctttctcatggtcctgctgatcccggagcctgaccggcagcgcacaccccaggataaccaactcgcctacgtggttattggacttctgttcatgatcctgaccgtggccgctaatgagatgggcctcctggaaaccacaaagaaagaccttgggattggacacgtcgccgtggagaaccaccatcacgcggccatgctggatgtcgacctccatcctgctagcgcctggaccctgtacgctgtggccacaacgatcattacccccatgatgagacacacaatcgaaaacaccacagcgaatatttctctgaccgccatcgctaaccaggccgctatcctcatgggccttgataagggctggcctatttccaaaatggacatcggggttcccctgctggccctcggatgctatagccaggtgaatccgctgacgcttaccgctgccgtcctgatgctcgtggcgcattacgccattatcggccctgggctgcaagctaaggccacacgggaggctcagaagcgcaccgccgccggaattatgaaaaaccccacaatcgatggcatcgttgcgattgacctggatcccgtggtctatgacgctaagtttgaaaaacagctcgggcagatcatgcttctgattctgtgtacctctcaaatcctcctgatgagaacgacatgggccctttgcgagagcattaccctggctacaggacctctcaccaccctgtgggagggctccccgggcaagttctggaatacaacgatcgccgtgtctatggccaacatctttcgggggagctacctggctggagccggcctcgcgttctcccttatgaaaagcctcgggggaggccgcagagggaccggagcccagggcgaaacactgggcgagaagtggaagcggcagctcaatcagctgtccaaatctgagttcaacacctataagcgcagcgggattatggaggtggacagatccgaagctaaagagggacttaagcggggcgagacaaccaaacacgccgtttctagagggacggctaagctgcgctggtttgtcgaacggaatctcgtgaagcccgagggaaaagtgatcgatctgggctgtgggagaggaggctggagctactattgcgccggcctgaagaaagtcacagaagttaaggggtacaccaaaggaggccctgggcacgaggaacccattcctatggcgacctacggatggaacctcgtgaaacttcattccggcaaagacgtgttctttattccccctgagaagtgtgatacactgctgtgcgacatcggggagtctagcccgaatcccaccatcgaagagggacgcacactccgggtcctgaagatggtggaaccttggcttagaggcaaccaattctgtattaaaatcctgaatccctatatgccttccgttgtggagacgctcgagcagatgcagcgcaagcacggcgggatgctggtccggaaccccctgagcagaaattctacccatgaaatgtactgggtgtcctgcggaacaggcaacatcgttagcgccgtgaatatgacctctcgcatgctcctgaaccggtttacaatggctcacagaaaaccgacctatgagcgcgatgtcgaccttggggccggaacgcggcacgtggctgtggaacctgaggtcgccaacctggatattatcggccagagaattgaatccatcaagcatgagcacaaaagcacctggcattacgacgaggataatccctataagacatgggcttaccacgggtcttatgaagttaagccctccggaagcgcctccagcatggtgaacggcgtggtcaaactcctgaccaagccttgggacgtgattcccatggttacacaaatcgcgatgaccgatacaacccctttcggccagcagcgcgtgtttaaagagaaggtcgacacgagaacaccgaaagccaagcgggggaccgctcaaatcatggaagtgaccgccaagtggctttggggattcctgtctcgcaataaaaagcccagaatttgtacacgggaggaatttacgagaaaagttcggagcaacgctgccatcggcgccgtgttcgtcgacgagaatcagtggaactccgcgaaggaggctgtggaagatgaccgcttttgggatctcgttcatagagagcgggaactgcacaaacaggggaagtgcgcgacctgcgtgtacaatatgatgggaaagcgcgagaaaaagctgggcgagttcgggaaagccaagggctctagagctatttggtacatgtggctcggagcccggtttctggagttcgaggctcttggcttcatgaacgaagaccactggtttagccgcgaaaattccctgtctggggtcgaaggagagggcctccataaactggggtatatccttagagatattagcaagatccctggaggcaacatgtacgccgacgatacagcggggtgggacacccggatcacagaggatgacctgcagaatgaagccaaaattaccgatatcatggagcccgaacacgctctcctggccaagtccattttcaagctgacatatcaaaacaaagtggtccgcgtgcagagacctgctaagaatggcaccgttatggacgtgatctctcggcgcgatcagagaggaagcggccaggtcgggacgtacggactcaacacctttacaaatatggaggcccaactgattcggcagatggaatccgagggcatcttcagccccaacgagcttgaaaccccgaacctggcggagcgcgtgctcgactggctggaaaaatatggggtggagagacttaagcggatggccatctctggagacgattgtgttgtgaaacctattgacgatagatttgctacagccctgaccgctctcaatgacatgggcaaggtccgcaaggatatcccccagtgggaaccttccaaagggtggaacgactggcagcaagtgcccttctgcagccatcactttcaccagctgattatgaaggatggccgggagatcgttgtgccttgtagaaatcaggacgagctggtcggacgcgcccgggtgtctcagggcgctgggtggtccctcagagaaacggcctgcctgggaaaaagctacgcgcaaatgtggcagcttatgtatttccatcgccgggatctgagactcgccgctaacgccatttgttccgccgtccccgtggactgggttccgacatctcgcaccacatggagcatccacgctcatcaccagtggatgaccacggaggatatgctgtccgtgtggaatcgggtctggattgaagagaacccttggatggaagacaagaccagaatcagctcttgggaggacgtgccctaccttggcaaacgcgaggatcaatggtgcgggtccctgatcggactcacagcccgggcgacctgggctacaaatattcaggttgccatcaaccaggtgagacggctgattggcaatgaaaactacagcgactatatgacctctatgaagagatttaagaatgagagcgaacccgagggggccctgtggtga

SEQ ID NO: 18733 - RNA, 9879 nt, synthetic construct
  misc_feature 1..9879: note = derived and/or modified CDS sequence (opt5) from DENV-1__FJ687429__SS-prME
  source 1..9879: mol_type = other RNA
agcgtgaccatgctgctcatgctgatgcccacggcccttgctttccacctgacgaccagaggaggggaacctcatatgattgtctccaagcaggaacggggaaaatctctcctgtttaagaccagcgccggcgttaacatgtgcacccttattgccatggacctgggggaactctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatggatcgacgtggtcctcgagcacgggtcttgtattacgaccatggctaaggataaacccacactggacatcgaactgctcaagaccgaggtgacaaaccctgccgtgctgcgcaaactttgcattgaagcgaagatctccaataccacgacagatagcagatgtccgacccaaggagaggccaccctggtcgaagaacaggacgctaacttcgtttgccggcgcacatttgtggatagaggctggggcaatgggtgtggactcttcggcaaagggtctctgcttacctgcgccaagtttaagtgcgtgacaaaactggagggaaagatcgtccagtacgaaaacctcaaatattccgtgattgttacggtgcacaccggcgaccagcatcaagtcgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgttcataagcagtggtttctggatcttcctctgccctggacaagcggggcttccacctctcaagagacatggaatcgccaggacctcctggtgaccttcaaaaccgcgcacgccaagaagcaggaagtcgtggtcctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagttgccgagacccagcacggaaccgtgctggtccagatcaagtacgagggcacagacgcgccgtgcaaaatccctttctccacccaagatgaaaagggggtgacacagaacggacggcttattacggctaatcccatcgttaccgacaaagagaagcctgtgaacattgaagccgagccgccctttggcgagagctatatcgtcattggggccggagaaaaagctctcaagctgtcttggttcaagaaaggcagctccatcgggaagatgtttgaggccacagctagaggcgcccgccggatggcgatcctgggagataccgcctgggacttcggctctattgggggagtgtttacaagcgtgggcaaactcgttcatcagatcttcgggaccgcttacggagtcctgttttccggcgtgagctggacgatgaagattgggatcggcgtgcttctgacctggctcggactcaattctagatccacaagcctgtctatgacctgtattgccgtcggccttgtgacactctacctgggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctctctgcggccatcggcaaggcttgggaggagggggtgtgcggcatcagaagcgccacgcgcctggaaaacattatgtggaaacagatctccaacgagcttaatcatattctgctcgaaaacgacatgaagttcacagtcgtggttggagatgtggctggcatcctggcccaggggaaaaagatgattcggccgcaacccatggagtacaaatattcttggaaaagctggggaaaggccaagatcatcggcgctgacgtccaaaattccacctttattatcgatgggcctaacacccccgaatgtcctgacgatcagagagcgtggaatatttgggaggtggaggactacggattcggcatctttacaaccaacatttggctgaaacttcgcgatagctatacacaggtgtgcgaccaccggctcatgtctgccgctatcaaagattccaaggccgtccacgccgacatgggctactggatcgaaagcgagaaaaatgaaacatggaagctggctagagcctctttcattgaggttaagacctgtatctggcccaaatcccatacactgtggagcaacggggtgctcgaatctgagatgattatcccgaagatttatggaggccctatcagccaacacaattaccgccccgggtacttcacccagacagcgggaccttggcatctgggcaaacttgagctggattttgacctctgcgaagggaccacggtggtcgtggatgagcactgcggaaaccggggcccctccctgagaaccacaaccgttacaggcaagatcattcacgaatggtgttgccggagctgtaccctgcctccccttcgcttcagaggggaggacggatgctggtatggcatggagatccggccggtgaaagaaaaggaggaaaatctcgtcaagtctatggtgtccgctgggagcggagaggttgactccttttctctgggcctgctctgtattagcatcatgattgaagaggtgatgagatcccgctggtctcggaaaatgctgatgacggggacacttgccgtcttctttctgctcatcatgggacagctgacctggaacgatctgattagactttgcatcatggtgggcgccaatgctagcgaccgcatgggcatggggacaacctacctggccctcatggcgaccttcaagatgagacctatgtttgctgttggactgctgttccggcgcctgacatccagagaggtgcttctgctcacgatcggcctgtctctggtcgccagcgtggaacttcccaactccctggaggaactcggggatggactggccatgggcattatgatcctcaaactgcttaccgactttcaaagccatcagctgtgggctacactcctgtctctgaccttcattaagacaaccttttcccttcactatgcctggaaaacgatggctatggtgctgagcatcgtctctctcttccccctgtgtctctccacaaccagccagaagaccacatggctgcctgttcttctggggtctctgggatgcaagccgctcaccatgtttctgattgccgagaataaaatctggggccggaagtcctggccccttaacgaaggcatcatggcggtggggattgtgagcatcctgctctccagcctgctcaaaaacgatgtccctctggccggaccccttattgctggcgggatgctgatcgcctgttacgtgatttctggaagctccgctgacctgtctctcgagaaggccgccgaggttagctgggaagaggaagctgagcattccggcgcgtctcacaatatcctggtggaagtccaggatgacgggacaatgaaaatcaaggatgaggagcgcgacgatacgcttaccattctgctcaaagccacactgctcgctgtgagcggagtttatcctctgtccatccccgccacccttttcgtgtggtacttctggcaaaagaagaaacagagatctggcgtcctgtgggacacacctagccctcccgaagtggagcgggccgtcctggatgacggcatttatcgcatcatgcagagagggctcctgggacggtcccaggtgggcgttggggtgtttcaagaaaacgtcttccataccatgtggcacgtgacgcgcggagctgttcttatgtaccagggcaagagactggagcccagctgggcctctgtgaaaaaggacctcatttcctacgggggaggctggcggctgcagggcagctggaataccggggaggaagtccaggtgatcgcggtggagcccggcaagaaccctaagaatgttcaaacagctcccggcacctttaagacaccggaaggggaggtcggagccattgccctcgatttcaaacctggcacctctgggtcccccatcgtgaacagagaaggaaagatcgtgggcctgtatggcaatggggtcgtgacaacgagcggaacctacgtttccgctattgcccaggcgaaggcttctcaggagggccctcttcccgagatcgaagacgaggtgtttcgcaagcggaacctgacaattatggatctgcaccccgggagcggaaaaaccagacgctatctccctgccatcgtccgggaagccattaagagaaagctgcgcacccttatcctggctccgacacgggtggttgcctccgagatggctgaagccctcaaaggcatgcccatcagataccaaacgaccgcggtgaaaagcgagcatacagggaaagagattgtcgacctgatgtgccacgccaccttcacaatgcgcctgctctctcctgtgcgggttcccaattataacatgatcattatggatgaagctcattttaccgacccttccagcatcgccgctagaggctacatttctacgcgggtgggaatgggcgaggccgccgctatcttcatgacagcgacaccccctgggagcgtcgaagcctttccgcagtccaatgctgtgatccaggatgaggaacgcgacattcccgagagatcttggaacagcggatatgagtggatcaccgatttccctggcaagacagtgtggtttgtcccctccattaaagccgggaatgacatcgccaactgtcttcggaagaatggaaagcgcgttattcagctgtctagaaaaaccttcgatacagaataccaaaagaccaaaaacaacgactgggactacgtggtgacgacagatatcagcgagatgggcgctaatttccgggccgacagagtcattgatcctcgccggtgcctgaagcccgtgatcctcaaagacgggccggaaagagttatcctggcgggccctatgcccgtgaccgtcgcttccgccgcccagcgccggggaagaattggccgcaaccacaataaggagggggatcagtatatctacatgggacagccccttaacaatgacgaggatcatgctcactggacagaagccaagatgctgctcgacaacattaatacccctgagggcatcattcccgcgctgtttgaacctgagcgggaaaagagcgccgctatcgatggggagtatagactgcgcggagaggccagaaagacgttcgtggagctcatgcggcgcggcgaccttccggtttggctgtcttacaaagtggcttccgaggggtttcaatatagcgatagacggtggtgcttcgacggcgaacgcaacaatcaggtcctggaggaaaacatggatgtggagatctggaccaaggagggagaacgcaaaaagctccggcccagatggctggacgcccgcacatactccgaccctcttgctctgcgggagtttaaagagttcgccgcgggcagacgctctgtcagcggggatctcattctggagatcggaaagctgccccagcacctcacccagcgggcccaaaatgctcttgacaacctggtgatgctgcataattccgaacagggcgggagagcctatcggcacgctatggaggagctccctgatacaattgaaaccctgatgcttctggccctcatcgccgttctgacaggaggcgtgaccctgtttttcctctctggcaaggggcttggaaaaacgagcattggcctgctgtgtgtgatggcttccagcgtcctcctgtggatggcgtctgttgagccccattggatcgccgcttccatcattcttgaatttttcctgatggtgctcctgatcccggagcctgaccgccagagaacaccccaggataaccaactggcctacgtggtcattgggctcctttttatgatcctgaccgtggccgctaatgagatgggactgctcgaaaccacaaagaaagacctgggcattgggcacgttgccgtggagaaccaccatcacgcggccatgcttgatgtcgacctgcatcctgctagcgcctggaccctctacgctgtggccacaacgatcattacccccatgatgcggcacacaatcgaaaacaccacagcgaatatctctctgaccgccattgctaaccaggccgctatcctgatgggactcgataagggctggcctatttccaaaatggacatcggcgtcccccttctggccctggggtgctatagccaggtgaatccgctcacgctgaccgctgccgttcttatgctggtggcgcattacgccattatcggacctggcctccaagctaaggccacacgcgaggctcagaagagaaccgccgccgggatcatgaaaaaccccacaattgatggaatcgtcgcgattgacctggatcccgtggtttatgacgctaagttcgaaaaacagctgggccagatcatgctccttattctgtgtacctctcaaatcctgctcatgcggacgacatgggccctgtgcgagagcatcacccttgctacagggcctctgaccaccctctgggagggatccccgggcaagttttggaatacaacgattgccgtgtctatggccaacatcttccgcggcagctacctggctggggccggactggcgttctccctcatgaaaagccttggcgggggaagacggggcaccggggcccagggagaaacactgggcgagaagtggaagcgccagctgaatcagctctccaaatctgaatttaacacctataagagaagcggcattatggaggtcgaccggtccgaagctaaagaggggctgaagagaggagagacaaccaaacacgccgtgtctcgcggcacggctaaacttcggtggttcgtggaaagaaatctggttaagcccgaggggaaagtcatcgatctcggatgtggccgcgggggatggagctactattgcgccggcctgaagaaagtgacagaagtgaagggctacaccaaagggggacctggccacgaggaacccattcctatggcgacctacgggtggaacctggtcaagctccattccggaaaagacgtgtttttcattccccctgagaagtgtgatacacttctgtgcgacatcggcgagtctagcccgaatcccaccatcgaagaggggcggacactgagagttctcaagatggtggaaccttggctgcgcggaaaccaattttgtatcaaaattcttaatccctatatgccttccgtcgtggagacgctggagcagatgcagcggaagcacggcggcatgctcgttagaaaccccctgagccgcaattctacccatgaaatgtactgggtgtcctgcgggacaggaaacatcgtcagcgccgtgaatatgacctctcggatgctgctcaacagattcacaatggctcaccgcaaaccgacctatgagcgggatgttgacctgggcgccgggacgagacacgtggctgtcgaacctgaggtggccaaccttgatattatcggacagcgcattgaaaatatcaagcatgagcacaaatccacctggcattacgacgaggataacccctataagacatgggcttaccacggcagctatgaagtgaagccctctgggtccgccagctccatggtcaatggagttgtgaaactgctcaccaagccttgggacgtgatccccatggtcacacaaattgcgatgaccgatacaaccccttttggccagcagagagtgttcaaagagaaggttgacacgcggacaccgaaagccaagcgcggcaccgctcaaatcatggaagtgaccgccagatggctgtgggggtttcttagccggaacaagaaacccagaatttgtacacgggaggagttcacgcgcaaggtcagatctaatgctgccatcggagccgtgtttgttgacgagaaccagtggaatagcgcgaaagaggctgtggaagatgaccggttctgggatctggtccatcgcgagagagaactccacaagcagggcaaatgcgcgacctgcgtgtacaacatgatggggaagcgggagaagaaactgggagaatttggcaaggccaaagggtcccgcgctatttggtacatgtggctgggcgccagattcctcgagttcgaggctctgggatttatgaatgaagaccactggttctctcgggagaacagcctttccggcgttgaaggggagggactgcataagctcggctatatcctgcgcgatatctctaaaattcctgggggaaatatgtacgccgacgatacagcgggctgggacaccagaatcacagaggatgaccttcagaacgaagccaagattaccgatatcatggagcccgaacacgctctgctcgccaaaagcatttttaagctgacatatcaaaataaggtggtccgggtgcagcgccctgctaaaaacgggaccgtcatggacgtgatctccagacgggatcagcgcggctctggacaggttggcacgtacgggctgaataccttcacaaacatggaggcccaactcatcagacagatggaaagcgagggaatcttttcccccaacgagctggaaaccccgaatcttgcggagcgggtgctggactggctcgaaaagtatggcgtcgagagactgaaacgcatggccatcagcggggacgattgtgtggtgaagcctattgacgatcggttcgctacagcccttaccgctctgaacgacatgggaaaagttagaaaggatatcccccagtgggaaccttctaagggctggaatgactggcagcaagtgcccttttgctcccatcacttccaccagctcattatgaaagatgggcgcgagatcgtcgtgccttgtcggaaccaggacgagctggttggcagagcccgcgtgagccagggagctggctggtctctgcgggaaacggcctgcctcgggaagtcctacgcgcaaatgtggcagctgatgtattttcatagacgcgatcttcggctggccgctaatgccatttgtagcgccgtccccgtggactgggtcccgacatccagaaccacatggtctatccacgctcatcaccagtggatgaccacggaggatatgctcagcgtgtggaaccgcgtttggatcgaagagaatccttggatggaagacaaaacccggatttccagctgggaggacgtgccctacctgggaaagagagaggatcaatggtgcggctctcttatcgggctgacagcccgggcgacctgggctacaaacattcaggtcgccatcaatcaggtgagacgcctcattggaaacgaaaattactccgactatatgaccagcatgaaacggttcaagaacgagtctgaacccgagggcgccctgtggtga

SEQ ID NO: 18734 - RNA, 9879 nt, synthetic construct
  misc_feature 1..9879: note = derived and/or modified CDS sequence (opt5) from DENV-1__FJ850068__SS-prME
  source 1..9879: mol_type = other RNA
agcgtgaccatgctgctcatgctgatgcccacagcccttgctttccacctgacgacccggggcggggaacctcatatgatcgtgtccaagcaggaacggggaaaatctctcctgtttaagaccagcgccggcgttaacatgtgcacccttattgccatggacctgggggaactctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccagggagaggccaccctggtggaagaacaggacgctaacttcgtgtgccggcgcacatttgtcgatagaggctggggcaatgggtgtggactcttcggcaaagggtctctgcttacctgcgccaagtttaagtgcgtgacaaaactggagggaaagattgttcagtacgaaaacctcaaatattccgtgatcgtcacggtgcacaccggcgaccagcatcaagttgggaatgagagcacagaacacggaaccacagctaccatcacgccccaggcccctaccacagagattcagctgaccgactacggcgccctgacactcgattgttctccccggaccggcctggacttcaacgaaatggtgcttctgacgatgaaggagaaatcctggctcgtccataagcagtggtttctggatcttcctctgccctggacaagcggggcttccacctctcaagagacatggaatcgccaggacctcctggtgaccttcaaaaccgcgcacgccaagaagcaggaagtcgtggttctgggaagccaagagggcgctatgcacacagccctcacgggggccaccgaaatccagacatccggaaccacaaccatttttgctggccatctgaaatgcagacttaagatggataaactgacgctcaaggggatgagctatgtgatgtgtacaggctctttcaaactggagaaggaagtcgccgagacccagcacggaaccgtgctggttcagatcaagtacgagggcacagacgcgccgtgcaaaattcctttctccacccaagatgaaaagggggtgacacagaacggacggcttatcacggctaatcccatcgtcaccgacaaagagaagcctgtgaacattgaagccgagccgccctttggcgagagctatatcgtgattggggccggagaaaaagctctcaagctgtcttggttcaagaaaggcagctccatcgggaagatgtttgaggccacagctagaggcgcccgccggatggcgattctgggagataccgcctgggacttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacatcatgtggaaacagatctccaacgagcttaatcatattctgctcgaaaacgacatgaagttcacagttgtggtcggagatgtggctggcatcctggcccaggggaaaaagatgattcggccgcaacccatggagtacaaatattcttggaaaagctggggaaaggccaagatcattggcgctgacgtgcaaaattccacctttatcatcgatgggcctaacacccccgaatgtcctgacgatcagagagcgtggaatatttgggaggtcgaggactacggattcggcatctttacaaccaacatttggctgaaacttcgcgatagctatacgcaggtttgcgaccaccggctcatgtctgccgctatcaaagattccaaggccgtgcacgccgacatgggctactggattgaaagcgagaaaaatgaaacatggaagctggctggggcctctttcatcgaggtgaagacctgtatctggcccaaatcccatacactgtggagcaacggagtcctcgaatctgagatgattatcccgaagatttatggcgggcctatcagccaacacaattacagacccggatacttcacccagacagcgggcccttggcatctggggaaacttgagctggattttgacctctgcgaaggaaccacggtggttgtggatgagcactgcggcaaccgcggcccctccctgcggaccacaaccgtcacagggaagattatccacgaatggtgttgcagaagctgtaccctgcctccccttcggttccgcggagaggacggctgctggtatgggatggagatcagaccggtgaaagaaaaggaggaaaatctcgttaagtctatggtgtccgctggaagcggcgaggtcgactccttttctctggggctgctctgtattagcatcatgattgaagaggtgatgcggtccagatggtctcgcaaaatgctgatgacgggaacacttgccgttttctttctgctcatcatgggccagctgacctggaacgatctgattcggctttgcatcatggtgggcgccaatgctagcgacagaatggggatgggaacaacctacctggccctcatggcgaccttcaagatgcgccctatgtttgctgtcggcctgctgttcagacggctgacatcccgcgaggtgcttctgctcacgattgggctgtctctggtggccagcgtcgaacttcccaactccctggaggaactcggagatggcctggccatggggatcatgatcctcaaactgcttaccgactttcaaagccatcagctgtgggctacactcctgtctctgaccttcattaagacaaccttttcccttcactatgcctggaaaacgatggctatggttctgagcatcgtgtctctcttccccctgtgtctctccacaaccagccagaagaccacatggctgcctgtgcttctgggatctctgggctgcaagccgctcaccatgtttctgattgccgagaataaaatctggggcagaaagtcctggccccttaacgaagggattatggcggtcggaatcgtgagcatcctgctctccagcctgctcaaaaacgatgttcctctggccggcccccttattgctgggggaatgctgatcgcctgttacgtgatttctggcagctccgctgacctgtctctcgagaaggccgccgaggtcagctgggaagaggaagctgagcattccggggcgtctcacaatatcctggtggaagttcaggatgacggaacaatgaaaattaaggatgaggagcgggacgatacgcttaccatcctgctcaaagccacactgctcgctgtgagcggcgtctatcctctgtccatccccgccacccttttcgtgtggtacttctggcaaaagaagaaacagcgctctggcgtcctgtgggacacacctagccctcccgaagtggagagagccgttctggatgacgggatttatcggatcatgcagcgcggactcctgggcagatcccaggtgggggtcggagtgtttcaagaaaacgttttccataccatgtggcacgtgacgcggggcgctgtccttatgtaccaggggaagcgcctggagcccagctgggcctctgtgaaaaaggacctcatttcctacggaggcggctggagactgcaggggagctggaataccggagaggaagtgcaggttatcgcggtcgagcccggcaaaaaccctaagaatgtgcaaacagctcccgggacctttaagacaccggaaggagaggtgggcgccattgccctcgatttcaaacctgggacctctggatcccccatcgtcaaccgggaaggcaagattgtgggcctgtatgggaatggagttgtgacaacgagcggcacctacgtctccgctatcgcccaggcgaaggcttctcaggaggggcctcttcccgagatcgaagacgaggtgtttagaaagcgcaacctgacaattatggatctgcaccccggaagcggcaaaacccggagatatctccctgccatcgttcgcgaagccattaagcggaagctgagaacccttatcctggctccgacacgcgtggtcgcctccgagatggctgaagccctcaaagggatgcccattcggtaccaaacgaccgcggtcaagagcgagcatacaggcaaagagatcgttgacctgatgtgccacgccaccttcacaatgagactgctctctcctgtgcgcgtccccaattataacatgatcattatggatgaagctcattttaccgacccttccagcatcgccgctcggggatacatttctacgagagtgggcatgggggaggccgccgctatcttcatgacagcgacaccccctggaagcgtggaagcctttccgcagtccaatgctgtcattcaggatgaggaacgggacatccccgagcgctcttggaacagcggctatgagtggatcaccgatttccctgggaagacagtttggtttgtgccctccattaaagccggaaatgacatcgccaactgtcttagaaagaatggcaagcgggtgattcagctgtctcgcaaaaccttcgatacagaataccaaaagaccaaaaacaacgactgggactacgtcgtgacgacagatatcagcgagatgggggctaatttcagagccgaccgggttattgatcctagacgctgcctgaagcccgtgatcctcaaagacggcccggaacgggtcattctggcgggacctatgcccgtgaccgttgcttccgccgcccagagacgcggccggatcgggagaaaccacaataaggagggagatcagtatatctacatgggccagccccttaacaatgacgaggatcatgctcactggacagaagccaagatgctgctcgacaacattaatacccctgaggggatcattcccgcgctgtttgaacctgagcgcgaaaagagcgccgctatcgatggagagtatcggctgagaggcgaggcccgcaagacgttcgtggagctcatgagaagaggggaccttccggtctggctgtcttacaaagtggcttccgagggctttcaatatagcgatcgcagatggtgcttcgacggagaacggaacaatcaggtcctggaggaaaacatggatgtggagatttggaccaaggagggcgaacgcaaaaagctcagaccccggtggctggacgccagaacatactccgaccctcttgctctgcgcgagtttaaagagttcgccgcggggcggagatctgttagcggagatctcatcctggagatcggcaagctgccccagcacctcacccagcgcgcccaaaatgctcttgacaacctggtgatgctgcataattccgaacaagggggacgggcctatagacacgctatggaggagctccctgatacaattgaaaccctgatgcttctggccctcatcgccgtgctgacaggcggcgtcaccctgtttttcctctctgggaagggacttggcaaaacgagcattgggctgctgtgtgttatggcttccagcgtgctcctgtggatggcgtctgtggagccccattggatcgccgcttccattatccttgaatttttcctgatggtcctcctgatcccggagcctgaccggcagcgcacaccccaggataaccaactggcctacgtggttattggactcctttttatgatcctgaccgtggccgctaatgagatgggcctgctcgaaaccacaaagaaagacctggggattggacacgtcgccgtggagaaccaccatcacgcggccatgcttgatgtcgacctgcatcctgctagcgcctggaccctctacgctgtggccacaacgatcattacccccatgatgagacacacaatcgaaaacaccacagcgaatatttctctgaccgccatcgctaaccaggccgctatcctgatgggcctcgataagggctggcctatttccaaaatggacatcggggttccccttctggccctgggatgctatagccaggtgaatccgctcacgctgaccgctgccgtccttatgctggtggcgcattacgccattatcggccctgggctccaagctaaggccacacgggaggctcagaagcgcaccgccgccggaattatgaaaaaccccacaatcgatggcatcgttgcgattgacctggatcccgtggtctatgacgctaagttcgaaaaacagctggggcagatcatgctccttattctgtgtacctctcaaatcctgctcatgagaacgacatgggccctgtgcgagagcattacccttgctacaggacctctgaccaccctctgggagggctccccgggcaagttttggaatacaacgatcgccgtgtctatggccaacatcttccgggggagctacctggctggagccggcctggcgttctccctcatgaaaagccttgggggaggccgcagagggaccggagcccagggcgaaacactgggcgagaagtggaagcggcagctgaatcagctctccaaatctgaatttaacacctataagcgcagcgggattatggaggtggacagatccgaagctaaagagggactgaagcggggcgagacaaccaaacacgccgtttctagagggacggctaaacttcgctggttcgtcgaacggaatctggtgaagcccgagggaaaagtgatcgatctcggctgtgggagaggaggctggagctactattgcgccggcctgaagaaagtcacagaagttaaggggtacaccaaaggaggccctgggcacgaggaacccattcctatggcgacctacggatggaacctggtgaagctccattccggcaaagacgtgtttttcattccccctgagaagtgtgatacacttctgtgcgacatcggggagtctagcccgaatcccaccatcgaagagggacgcacactgcgggtcctcaagatggtggaaccttggctgagaggcaaccaattttgtattaaaatccttaatccctatatgccttccgttgtggagacgctggagcagatgcagcgcaagcacggcgggatgctcgtccggaaccccctgagcagaaattctacccatgaaatgtactgggtgtcctgcggaacaggcaacatcgttagcgccgtgaatatgacctctcgcatgctgctcaaccggttcacaatggctcacagaaaaccgacctatgagcgcgatgtcgacctgggggccggaacgcggcacgtggctgtggaacctgaggtcgccaaccttgatattatcggccagagaattgaaaatatcaagcatgagcacaaatccacctggcattacgacgaggataacccctataagacatgggcttaccacgggagctatgaagttaagccctctggatccgccagctccatggtgaatggcgtggtcaaactgctcaccaagccttgggacgtgattcccatggttacacaaatcgcgatgaccgatacaaccccttttggccagcagcgcgtgttcaaagagaaggtcgacacgagaacaccgaaagccaagcgggggaccgctcaaatcatggaagtgaccgcccgctggctgtggggatttcttagcagaaacaagaaaccccggatttgtacaagagaggagttcacgcggaaggttcgctctaatgctgccatcggcgccgtgtttgtcgacgagaaccagtggaatagcgcgaaagaggctgtggaagatgacagattctgggatctggttcatcgggagcgcgaactccacaagcaggggaaatgcgcgacctgcgtgtacaacatgatgggaaagagagagaagaaactgggcgaatttgggaaggccaaaggctcccgggctatttggtacatgtggctgggagcccgcttcctcgagttcgaggctctgggctttatgaatgaagaccactggttctctagagagaacagcctttccggggtcgaaggagagggcctgcataagctcgggtatatcctgcgggatatttctaaaatccctggaggcaatatgtacgccgacgatacagcggggtgggacacccgcatcacagaggatgaccttcagaacgaagccaagattaccgatatcatggagcccgaacacgctctgctcgccaaaagcatttttaagctgacatatcaaaataaggtggtcagagtgcagcggcctgctaaaaacggcaccgttatggacgtgatctcccgcagagatcagcggggatctggccaggtcgggacgtacggactgaataccttcacaaacatggaggcccaactcattcgccagatggaaagcgagggcatcttttcccccaacgagctggaaaccccgaatcttgcggagagagtgctggactggctcgaaaagtatggggtggagcggctgaaaagaatggccatcagcggagacgattgtgttgtgaagcctattgacgatcgcttcgctacagcccttaccgctctgaacgacatgggcaaagtccggaaggatatcccccagtgggaaccttctaaggggtggaatgactggcagcaagtgcccttttgctcccatcacttccaccagctcattatgaaagatggcagagagatcgttgtgccttgtcgcaaccaggacgagctggtcggacgggccagagtgagccagggcgctgggtggtctctgcgcgaaacggcctgcctcggaaagtcctacgcgcaaatgtggcagctgatgtattttcatcggagagatcttcgcctggccgctaatgccatttgtagcgccgtccccgtggactgggttccgacatcccggaccacatggtctatccacgctcatcaccagtggatgaccacggaggatatgctcagcgtgtggaacagagtctggattgaagagaatccttggatggaagacaaaacccgcatctccagctgggaggacgtgccctacctgggcaagcgggaggatcaatggtgcgggtctcttatcggactgacagccagagcgacctgggctacaaacattcaggttgccatcaatcaggtgcggagactcattggcaacgaaaattactccgactatatgaccagcatgaaacgcttcaagaacgagtctgaacccgagggggccctgtggtga

SEQ ID NO: 18735 - RNA, 9879 nt, synthetic construct
  misc_feature 1..9879: note = derived and/or modified CDS sequence (opt5) from DENV-1__FJ687430__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaagtctctcctgtttaagaccagcaccggcgttaatatgtgcacacttattgccatggacctgggggaactctgtgaagataccatgacatacaaatgcccccgcatcaccgaagcggaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagaaggttgaaacctgggccctgcggcaccccggcttcacagtgatcgctctttttctggcccatgcgattgggacctctatcacccagaagggaatcattttcatcctcctgatgcttgtcacacctagcatggccatgcgctgcgtgggcattgggtccagagattttgttgagggactgagcggcgctacgtgggtggacgtcgtgctcgagcacgggtcttgtgtgaccacaatggccaaagataagcccaccctggacatcgaactgctcaaaacagaggtcaccaaccctgctgttctgcggaaactttgcattgaagccaaaatctccaatacgacaaccgatagccgctgtccgacccaaggagaggcgacactggtggaagaacaggacgccaacttcgtgtgcagacggacctttgtcgatcgcggctggggcaatgggtgtggactcttcggcaaggggtctctgattacatgcgctaagtttaaatgcgtgacgaaacttgagggaaaaatcgttcagtacgaaaacctgaagtattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctcccagaacgggcctcgacttcaacgaaatggtgctgcttacaatgaaagagaagtcctggctggtccataaacagtggtttctcgatctgcctcttccctggaccagcggggcctccacatctcaagagacctggaatcggcaggacctgctcgtgaccttcaagacagctcacgcgaagaaacaggaagtcgtggttctgggaagccaagagggcgccatgcacacggctctgaccggggccacagaaattcagacctccggaacaaccacgatctttgccggccatctcaagtgccgcctgaaaatggataaacttacactgaaagggatgagctatgtgatgtgtaccggctctttcaagctcgagaaggaagtcgctgagacccagcacggaacaattctggtgcagatcaaatacgagggcaccgacgccccgtgcaagatccctttctccacacaagatgaaaaaggggttacgcagaacggaagactgattaccgcgaatcccatcgtgacagacaaggagaaacctgtcaacattgaagctgagccgccctttggcgagagctatatcgtgattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtgtttaccagcgttggcaagctggtccatcagatcttcgggacggcctacggagtgctcttttccggcgtgagctggaccatgaaaattgggatcggcgtcctgcttacatggctgggactcaattctcggtccaccagcctgtctatgacatgtattgctgtgggcctggttaccctttacctcggggtgatggtccaggccgattccggatgcgtgatcaactggaagggcagagaactgaagtgtgggagcggaattttcgttacaaatgaggtgcacacctggacggaacaatataaatttcaggctgactcccctaagcgcctgtctgccgcgatcggcaaagcctgggaggagggggtctgcggcatccggagcgctacaagactcgaaaacattatgtggaagcagatctccaacgagctgaatcatattcttctggaaaacgacatgaaattcaccgtggttgtgggagatgtcgccggcatcctcgctcaggggaagaaaatgattcgcccgcaacccatggagtacaagtattcttggaaaagctggggaaaggccaagatcatcggcgccgacgtgcagaatgctacctttattatcgatgggcctaacacacccgaatgtcctgacgatcagcgggcgtggaatatttgggaggtggaggactacggattcggcatctttaccacgaacatttggctgaaactgagagattcctatacacaggtctgcgaccaccgccttatgagcgccgctatcaaggattctaaagccgttcacgccgacatgggctactggatcgaatccgagaagaatgaaacctggaagctcgctcgggccagcttcattgaggtgaaaacatgtatctggcccaagtctcataccctgtggtccaacggggtgctggaaagcgagatgattatcccgaaaatttatggaggccctatctctcaacacaattacagacccgggtacttcacacagaccgcgggaccttggcatctcggcaagctggagcttgattttgacctgtgcgaagggacgaccgtcgtggttgatgagcactgcggaaaccgcggccccagcctccggacaaccacagtgaccggcaaaatcattcacgaatggtgttgcagatcctgtacgctgcctcccctgcggttccgcggggaggacggatgctggtatggcatggagatcagaccggtcaaggaaaaggaggaaaatcttgtgaaaagcatggtttctgctgggtccggagaggtggacagcttttccctcggcctgctgtgtatttctatcatgattgaagaggtcatgcggagcagatggtcccgcaagatgctcatgacagggaccctggccgtgttctttcttctgatcatgggacagctcacatggaacgatctgattcggctgtgcatcatggttggcgccaatgcttctgacaaaatgggcatggggaccacctaccttgccctgatggcgacattcaagatgagacctatgtttgctgtgggactcctgttccgcagactcacgagccgggaggtcctgcttctgaccatcggcctctccctggtggcctctgtggaactgcccaacagccttgaggaactgggggatggactcgccatgggcattatgatcctgaaactcctgacagactttcaatcccatcagctttgggctaccctgctcagcctgacattcattaagaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataaaatctggggccgcaagtcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagagagacgataccctgacaattcttctgaaggccaccctcctggctgtttctggagtgtatcctctcagcatccccgccacactgttcgtctggtacttctggcagaagaagaaacagcggtccggcgtgctttgggacaccccttctcccccggaagtcgagcgcgccgtgctggatgacggcatttatagaatcatgcagcgggggctgctcggacgcagccaggttggcgtgggggtctttcaagaaaacgtgttccatacgatgtggcacgttaccagaggagctgtgctgatgtaccagggcaagcggcttgagccttcctgggccagcgtcaaaaaggacctgatttcttacgggggaggctggcgcctccagggctcctggaatacaggggaggaagtccaggtgatcgcggttgagcccggaaagaaccctaaaaatgtccaaaccgctcccggcacatttaagaccccggaaggggaggtgggagccattgccctggatttcaaacctggcacaagcgggtctcccatcgtgaacagagaaggaaagatcgtcggcctctatggcaatggggtggttacgacctccggaacatacgtgagcgctattgcccaggcgaaggcttcccaggagggccctctgcccgagatcgaagacgaggtctttcggaagagaaaccttaccattatggatctgcaccccgggtctggaaagacccgccggtatctgcctgccatcgtgagagaagccattaaacgcaagctccggacactgatccttgctccgacgagagttgtggccagcgagatggctgaagccctgaaaggcatgcccatccgctaccaaaccacagcggtcaagtccgagcataccgggaaagagattgtggacctcatgtgccacgccacattcaccatgcggctgctgagccctgttagagtgcccaattataacatgatcattatggatgaagctcattttacggacccttcttccatcgccgctcgcggctacattagcacacgggtcggaatgggcgaggccgccgctatcttcatgaccgcgacaccccctgggtctgtggaagcctttccgcagagcaatgctgtgatccaggatgaggaaagagacattcccgagcggtcctggaactctggatatgagtggatcacagatttccctggcaagaccgtctggtttgttcccagcattaagtccgggaatgacatcgccaactgtctccgcaaaaatggaaagagagtgattcagctttctcggaaaacattcgataccgaataccaaaagacgaaaaacaacgactgggactacgtggtcacaaccgatatcagcgagatgggcgccaatttccgcgctgacagagtgattgatcctcggagatgcctgaagcccgttatcctgaaggacgggccggaacgcgtgatcctcgccggccctatgcccgtcacagtggcgtccgctgcccagcggagaggacgcattggccggaaccacaataaagagggggatcagtatatctacatgggacagcccctgaacaatgacgaggatcatgcccactggaccgaagctaagatgcttctggacaacattaatacgcctgagggcatcattcccgccctctttgaacctgagagagaaaagagcgcggccatcgatggggagtatcgcctgcggggagaggctagaaagaccttcgttgagctgatgcgcagaggcgacctcccggtgtggctttcttacaaagtcgcctccgaggggtttcaatatagcgatcggcgctggtgcttcgacggcgaaagaaacaatcaggtgctggaggaaaacatggatgtcgagatctggacaaaggagggagaacggaaaaagctgcgccccagatggctcgacgctcggacctactccgaccctctggcccttagagagtttaaggagttcgctgccggccgccggtctgtgagcggggatctgattctcgagatcggaaaactgccccagcacctgacacagagagcgcaaaatgccctcgacaaccttgttatgctgcataattccgaacagggcgggcgcgcttatcggcacgccctggaggagctccctgataccattgaaacactgatgcttctggctctcatcgccgtgctgaccggaggcgtgacgctgtttttcctctctggcagagggcttggaaagacaagcattggcctgctgtgtgtcatggcctccagcgttctcctgtggatggcttctgtggagccccattggatcgcggcctccatcattcttgaatttttcctgatggtgctcctgatcccggagcctgaccggcagcgcacaccccaggataaccaactggcttacgtcgtgattgggctcctttttatgatcctgaccgttgccgccaatgagatgggactgctcgaaacaaccaaaaaggacctgggcattgggcacgtggctgtcgagaaccaccatcacgccagcatgcttgatgtggacctgcatcctgcgtctgcctggacactctacgctgtcgccacgaccatcattacacccatgatgagacacaccatcgaaaacacaaccgctaatatctccctgacggccattgcgaaccaggccgctatcctgatgggactcgataaaggctggcctattagcaagatggacatcggcgtgccccttctggccctggggtgctattctcaggttaatccgctcaccctgacagctgccgtgcttatgctggtcgctcattacgccattatcggacctggcctccaagcgaaggccacccgggaggctcagaaacgcacagccgctgggatcatgaagaaccccaccgtggatggaattgttgccatcgacctggatcccgtggtctatgacgccaaattcgaaaagcagctgggccagattatgctccttatcctgtgtacgagccaaattctgctcatgagaacaacctgggcgctgtgcgagtccatcacacttgctaccgggcctctgaccacactctgggagggatctccgggcaaattttggaatacgaccatcgccgtgagcatggctaacattttccggggctcctacctggccggggccggactggctttcagcctcatgaagtcccttggcgggggacgcagaggcacaggggcccagggagaaaccctgggcgagaagtggaaacggcagctgaatcagctctctaagagcgaatttaacacatataaacgctccggcatcatggaggtggacagatctgaagcgaaggaggggctgaaacggggagagaccacgaagcacgccgttagcagaggcacagctaaacttcgctggttcgtcgaacggaatctggtgaaacccgaggggaaggtgattgatctcggatgtggcagagggggatggtcctactattgcgccggcctgaaaaaggtcaccgaagttaaaggctacaccaaagggggacctggccacgaggaacccatccctatggctacatacgggtggaacctggtgaaactccattctggaaaggacgtgtttttcattccccctgagaagtgtgatacccttctgtgcgacatcggcgagagctccccgaatcccacaattgaagaggggcgcacgctgcgggtcctcaaaatggtggaaccttggctgagaggaaaccaattttgtatcaagatccttaatccctatatgcctagcgttgtggagaccctggagcagatgcagcgcaaacacggcggcatgctcgtccggaaccccctgtctagaaattccacacatgaaatgtactgggtgagctgcgggaccggaaacattgtttctgccgtgaatatgacatcccgcatgctgctcaaccggttcaccatggcgcacagaaagccgacgtatgagcgcgatgtcgacctgggcgccgggacccggcacgtggctgtggaacctgaggtcgccaaccttgatatcattggacagagaatcgaaaatattaaacatgagcacaagagcacatggcattacgacgaggataacccctataagacctgggcttaccacggctcttatgaagttaaaccctccgggagcgcctccagcatggtgaatggagtggtcaagctgctcacaaaaccttgggacgtgatccccatggttacccaaacagctatgaccgatacgacaccttttggccagcagcgcgtgttcaaggagaaagtcgacaccagaaccccgaaggccaagcggggcacagcgcaaatcatggaagtgacggcccgctggctgtgggggtttctttctagaaacaaaaagccccggatttgtaccagagaggagttcacacggaaagttcgcagcaatgctgccatcggagctgtgtttgtcgacgagaaccagtggaactccgccaaggaggccgtggaagatgagagattctgggacctggttcatcgggaacgcgagctccacaaacagggcaagtgcgcgacctgcgtgtacaacatgatggggaagagagagaagaagctgggagagtttggcaaagctaaggggtctcgggccatttggtacatgtggctgggcgcccgcttcctcgagttcgaagctctgggatttatgaatgaggatcactggttcagcagagaaaactccctttctggcgtcgagggggagggactgcataaactcggctatatcctgcgggacattagcaagatccctgggggaaatatgtacgccgatgacacagctggctgggatacccgcatcacagaagacgatcttcagaacgaggccaaaattaccgacatcatggaacccgagcacgcgctgctcgccaagtccatttttaagctgacgtatcaaaataaagtggtcagagtgcagcggcctgctaagaacgggaccgttatggatgtgatctctcgcagagaccagcggggcagcggacaggtcggcacatacgggctgaataccttcacaaacatggaagcccaactcattcgccagatggagtccgagggaatctttagcccctctgaactggagaccccgaaccttgctgaaagagtgctggattggctcgagaaatatggcgtggaacggctgaagagaatggccatctccggggacgactgtgttgtgaaacctattgatgaccgcttcgcgacggcccttacagctctgaatgatatgggaaaggtccggaaggacatcccccagtgggagcctagcaaaggctggaacgattggcagcaagtgcccttttgctctcatcacttccaccagctcattatgaaggacgggagagagatcgttgtgccttgtcgcaatcaggatgaactggtcggccgggccagagtgtcccagggagctggctggagcctgcgcgagaccgcctgcctcgggaaatcctacgctcaaatgtggcagctgatgtattttcatcggagagaccttcgcctggccgcgaacgccatttgttctgctgtccccgtggattgggttccgacaagccggaccacgtggtccatccacgcccatcaccagtggatgaccacagaagacatgctcagcgtgtggaatagagtctggattgaggaaaacccttggatggaggataagacccatatctcttcctgggaggacgtgccctacctgggaaaacgcgaagaccaatggtgcggcagccttatcgggctgacagcccgggctacctgggccacaaatattcaggttgcgatcaaccaggtgagacggctcattggaaatgagaactacctggattatatgacctctatgaagagattcaagaatgaaagcgaccccgagggcgctctgtggtga

SEQ ID NO: 18736 - RNA, 9879 nt, synthetic construct
  misc_feature 1..9879: note = derived and/or modified CDS sequence (opt5) from DENV-1__FJ687432__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaagtctctcctgtttaagaccagcaccggcgttaatatgtgcacccttattgccatggacctgggggagctctgtgaagataccatgacatacaagtgcccccgcatcaccgaggcggaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaagcagattcagaaggttgaaacctgggccctgcggcaccccggcttcacagtgatcgctctttttctggcccatgcgattgggacctctatcacccagaagggaatcattttcatcctcctgatgcttgtcacacctagcatggccatgcgctgcgtgggcattgggtccagagattttgttgagggactgagcggcgctacgtgggtggacgtcgtgctcgagcacgggtcttgtgtgaccacaatggccaaagataagcccaccctggacatcgaactgctcaaaacagaggtcaccaaccctgctgttctgcggaaactttgcattgaagccaaaatctccaatacgacaaccgatagccgctgtccgacccaaggagaggcgacactggtggaagaacaagacgccaacttcgtgtgcagacggacctttgtcgatcgcggctggggcaatgggtgtggactcttcggcaaggggtctctgattacatgcgctaagtttaaatgcgtgacgaaacttgagggaaaaatcgttcagtacgaaaacctgaagtattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctcccagaacgggcctcgacttcaacgaaatggtgctgcttacaatgaaagagaagtcctggctggtccataaacagtggtttctcgatctgcctcttccctggaccagcggggcctccacatctcaagagacctggaatcggcaggacctgctcgtgaccttcaagacagctcacgcgaagaaacaggaagtcgtggttctgggaagccaagagggcgccatgcacacggctctgaccggggccacagaaattcagacctccggaacaaccacgatctttgccggccatctcaagtgccgcctgaaaatggataaacttacactgaaagggatgagctatgtgatgtgtaccggctctttcaagctcgagaaggaagtcgctgagacccagcacggaacaattctggtgcagatcaaatacgagggcaccgacgccccgtgcaagatccctttctccacacaagatgaaaaaggggttacgcagaacggaagactgattaccgcgaatcccatcgtgacagacaaggagaaacctgtcaacattgaagctgagccgccctttggcgagagctatatcgtgattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtgtttaccagcgttggcaagctggtccatcagatcttcgggacggcctacggagtgctcttttccggcgtgagctggaccatgaaaattgggatcggcgtcctgcttacatggctgggactcaattctcggtccaccagcctgtctatgacatgtattgctgtgggcctggttaccctttacctcggggtgatggtccaggccgattccggatgcgtgatcaactggaagggcagagaactgaagtgtgggagcggaattttcgttacaaatgaggtgcacacctggacggaacaatataaatttcaggctgactcccctaagcgcctgtctgccgcgatcggcaaagcctgggaggagggggtctgcggcatccggagcgctacaagactcgaaaacattatgtggaagcagatctccaacgagctgaatcatattcttctggaaaacgacatgaaattcaccgtggttgtgggagatgtcgccggcatcctcgctcaggggaagaaaatgattcgcccgcaacccatggagtacaagtattcttggaaaagctggggaaaggccaagatcatcggcgccgacgtgcagaatgctacctttattatcgatgggcctaacacacccgaatgtcctgacgatcagcgggcgtggaatatttgggaggtggaggactacggattcggcatctttaccacgaacatttggctgaaactgagagattcctatacacaggtctgcgaccaccgccttatgagcgccgctatcaaggattctaaagccgttcacgccgacatgggctactggatcgaatccgagaagaatgaaacctggaagctcgctcgggccagcttcattgaggtgaaaacatgtatctggcccaagtctcataccctgtggtccaacggggtgctggaaagcgagatgattatcccgaaaatttatggaggccctatctctcaacacaattacagacccgggtacttcacacagaccgcgggaccttggcatctcggcaagctggagcttgattttgacctgtgcgaagggacgaccgtcgtggttgatgagcactgcggaaaccgcggccccagcctccggacaaccacagtgaccggcaaaatcattcacgaatggtgttgcagatcctgtacgctgcctcccctgcggttccgcggggaggacggatgctggtatggcatggagatcagaccggtcaaggaaaaggaggaaaatcttgtgaaaagcatggtttctgctgggtccggagaggtggacagcttttccctcggcctgctgtgtatttctatcatgattgaagaggtcatgcggagcagatggtcccgcaagatgctcatgacagggaccctggccgtgttctttcttctgatcatgggacagctcacatggaacgatctgattcggctgtgcatcatggttggcgccaatgcttctgacagaatgggcatggggaccacctaccttgccctgatggcgacattcaaaatgcgccctatgtttgctgtgggactcctgttcagacggctcacgagccgcgaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaagacaacctggctccctgtgctgcttgggagcctgggatgcaaaccgctgacaatgtttctcattgccgagaataagatctggggcagaaaatcttggcccctgaacgaaggcatcatggcggtggggattgtctccatccttctgagctccctcctgaagaacgatgtgcctctcgccggacccctgattgctggcgggatgcttatcgcctgttacgttattagcggatctagcgctgacctgtccctggagaaagccgccgaggtgtcttgggaagaggaagctgagcatagcggcgcgtcccacaatatcctcgtcgaagtgcaggatgacgggacgatgaagatcaaagatgaggagcgggacgataccctgacaattcttctgaaggccaccctcctggctgtttctggagtgtatcctctcagcatccccgccacactgttcgtctggtacttctggcaaaagaaaaagcagcgctccggcgtgctttgggacaccccttctcccccggaagtcgagagagccgtgctggatgacggcatttatcggatcatgcagcgcgggctgctcggaagaagccaggttggcgtgggggtctttcaagaaaacgtgttccatacgatgtggcacgttacccggggagctgtgctgatgtaccagggcaaacgccttgagccttcctgggccagcgtcaagaaagacctgatttcttacgggggaggctggagactccagggctcctggaatacaggggaggaagtccaggtgatcgcggttgagcccggaaagaaccctaagaatgtccaaaccgctcccggcacatttaaaaccccggaaggggaggtgggagccattgccctggatttcaagcctggcacaagcgggtctcccatcgtgaaccgggaaggaaaaatcgtcggcctctatggcaatggggtggttacgacctccggaacatacgtgagcgctattgcccaggcgaaggcttcccaggagggccctctgcccgagatcgaagacgaggtctttagaaaacgcaaccttaccattatggatctgcaccccgggtctggaaagacccggagatatctgcctgccatcgtgcgcgaagccattaagcggaaactcagaacactgatccttgctccgacgcgcgttgtggccagcgagatggctgaagccctgaagggcatgcccatccggtaccaaaccacagcggtcaaatccgagcataccgggaaggagattgtggacctcatgtgccacgccacattcaccatgagactgctgagccctgttcgcgtgcccaattataacatgatcattatggatgaagctcattttacggacccttcttccatcgccgctcggggctacattagcacaagagtcggaatgggcgaggccgccgctatcttcatgaccgcgacaccccctgggtctgtggaagcctttccgcagagcaatgctgtgatccaggatgaggaacgggacattcccgagcgctcctggaactctggatatgagtggatcacagatttccctggcaaaaccgtctggtttgttcccagcattaagtccgggaatgacatcgccaactgtctcagaaagaatggaaaacgggtgattcagctttctcgcaagacattcgataccgaataccagaagacgaagaacaacgactgggactacgtggtcacaaccgatatcagcgagatgggcgccaatttcagagctgaccgggtgattgatcctagacgctgcctgaaacccgttatcctgaaggacgggccggaacgggtgatcctcgccggccctatgcccgtcacagtggcgtccgctgcccagagacgcggacggattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgcgaaaagagcgcggccatcgatggggagtatcggctgagaggagaggctcgcaaaaccttcgttgaactgatgagacggggcgacctcccggtgtggctttcttacaaggtcgcctccgaggggtttcaatatagcgatcgcagatggtgcttcgacggcgaacggaacaatcaggtgctggaggaaaacatggatgtcgagatctggacaaaagagggagaacgcaagaaactgagaccccggtggctcgacgctagaacctactccgaccctctggcccttcgcgagtttaaggagttcgctgccggccggagatctgtgagcggggatctgattctcgagatcggaaagctgccccagcacctgacacagcgcgcgcaaaatgccctcgacaaccttgttatgctgcataattccgaacagggcgggcgggcttatagacacgccctggaggagctccctgataccattgaaacactgatgcttctggctctcatcgccgtgctgaccggaggcgtgacgctgtttttcctctctggccgggggcttggaaaaacaagcattggcctgctgtgtgtcatggcctccagcgttctcctgtggatggcttctgtggagccccattggatcgcggcctccatcattcttgaatttttcctgatggtgctcctgatcccggagcctgaccgccagagaacaccccaggataaccaactggcttacgtcgtgattgggctcctttttatgatcctgaccgttgccgccaatgagatgggactgctcgaaacaaccaagaaagacctgggcattgggcacgtggctgtcgagaaccaccatcacgccagcatgcttgatgtggacctgcatcctgcgtctgcctggacactctacgctgtcgccacgaccatcattacacccatgatgcggcacaccatcgaaaacacaaccgctaatatctccctgacggccattgcgaaccaggccgctatcctgatgggactcgataagggctggcctattagcaaaatggacatcggcgtgccccttctggccctggggtgctattctcaggttaatccgctcaccctgacagctgccgtgcttatgctggtcgctcattacgccattatcggacctggcctccaagcgaaggccacccgcgaggctcagaagagaacagccgctgggatcatgaaaaaccccaccgtggatggaattgttgccatcgacctggatcccgtggtctatgacgccaagttcgaaaaacagctgggccagattatgctccttatcctgtgtacgagccaaattctgctcatgcggacaacctgggcgctgtgcgagtccatcacacttgctaccgggcctctgaccacactctgggagggatctccgggcaagttttggaatacgaccatcgccgtgagcatggctaacattttccgcggctcctacctggccggggccggactggctttcagcctcatgaaatcccttggcgggggaagacggggcacaggggcccagggagaaaccctgggcgagaagtggaagcgccagctgaatcagctctctaaaagcgaatttaacacatataagagatccggcatcatggaggtggaccggtctgaagcgaaagaggggctgaagagaggagagaccacgaaacacgccgttagccgcggcacagctaaacttcggtggttcgtcgaaagaaatctggtgaagcccgaggggaaagtgattgatctcggatgtggccgcgggggatggtcctactattgcgccggcctgaagaaagtcaccgaagttaagggctacaccaaagggggacctggccacgaggaacccatccctatggctacatacgggtggaacctggtgaagctccattctggaaaagacgtgtttttcattccccctgagaagtgtgatacccttctgtgcgacatcggcgagagctccccgaatcccacaattgaagaggggcggacgctgagagtcctcaagatggtggaaccttggctgcgcggaaaccaattttgtatcaaaatccttaatccctatatgcctagcgttgtggagaccctggagcagatgcagcggaagcacggcggcatgctcgtcagaaaccccctgtctcgcaattccacacatgaaatgtactgggtgagctgcgggaccggaaacattgtttctgccgtgaatatgacatcccggatgctgctcaacagattcaccatggcgcaccgcaaaccgacgtatgagcgggatgtcgacctgggcgccgggaccagacacgtggctgtggaacctgaggtcgccaaccttgatatcattggacagcgcatcgaaaatattaagcatgagcacaaaagcacatggcattacgacgaggataacccctataagacctgggcttaccacggctcttatgaagttaagccctccgggagcgcctccagcatggtgaatggagtggtcaaactgctcacaaagccttgggacgtgatccccatggttacccaaacagctatgaccgatacgacaccttttggccagcagagagtgttcaaagagaaggtcgacacccggaccccgaaagccaagcgcggcacagcgcaaatcatggaagtgacggccagatggctgtgggggtttctttctcggaacaagaaacccagaatttgtacccgggaggagttcacacgcaaggttagaagcaatgctgccatcggagctgtgtttgtcgacgagaaccagtggaactccgccaaagaggccgtggaagatgagcggttctgggacctggttcatcgcgaaagagagctccacaagcagggcaaatgcgcgacctgcgtgtacaacatgatggggaagcgggaaaagaaactgggagagtttggcaaggctaaagggtctcgcgccatttggtacatgtggctgggcgccagattcctcgagttcgaagctctgggatttatgaatgaggatcactggttcagccgggaaaactccctttctggcgtcgagggggagggactgcataagctcggctatatcctgcgcgacattagcaaaatccctgggggaaatatgtacgccgatgacacagctggctgggataccagaatcacagaagacgatcttcagaacgaggccaagattaccgacatcatggaacccgagcacgcgctgctcgccaaatccatttttaagctgacgtatcaaaataaggtggtccgggtgcagcgccctgctaaaaacgggaccgttatggatgtgatctctagacgggaccagcgcggcagcggacaggtcggcacatacgggctgaataccttcacaaacatggaagcccaactcattagacagatggagtccgagggaatctttagcccctctgaactggagaccccgaaccttgctgaacgggtgctggattggctcgagaagtatggcgtggaaagactgaaacgcatggccatctccggggacgactgtgttgtgaagcctattgatgaccggttcgcgacggcccttacagctctgaatgatatgggaaaagtcagaaaggacatcccccagtgggagcctagcaagggctggaacgattggcagcaagtgcccttttgctctcatcacttccaccagctcattatgaaagacgggcgcgagatcgttgtgccttgtcggaatcaggatgaactggtcggcagagcccgcgtgtcccagggagctggctggagcctgcgggagaccgcctgcctcgggaagtcctacgctcaaatgtggcagctgatgtattttcatagacgcgaccttcggctggccgcgaacgccatttgttctgctgtccccgtggattgggttccgacaagcagaaccacgtggtccatccacgcccatcaccagtggatgaccacagaagacatgctcagcgtgtggaatcgcgtctggattgaggaaaacccttggatggaggataaaacccatatctcttcctgggaggacgtgccctacctgggaaagcgggaagaccaatggtgcggcagccttatcgggctgacagccagagctacctgggccacaaatattcaggttgcgatcaaccaggtgcggagactcattggaaatgagaactacctggattatatgacctctatgaaacgcttcaagaatgaaagcgaccccgagggcgctctgtggtga

SEQ ID NO: 18737 - RNA, 9879 nt, synthetic construct
  misc_feature 1..9879: note = derived and/or modified CDS sequence (opt5) from DENV-1__JQ922547__SS-prME
  source 1..9879: mol_type = other RNA
agcgtgaccatgctgctcatgctgcttcccaccgccctggctttccacctcacgacccggggaggggagcctcatatgatcgtgtccaagcaggaacggggaaaatctctgctttttaagacgagcgccggcgttaatatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagagccgaaacctggatgagctccgagggcgcttggaaacagattcagaaggttgaaacgtgggcccttcggcaccccggcttcacagtgatcgcgctgtttctcgcccatgctattgggacctctatcacacagaagggaatcattttcatcctgcttatgctggtcacccctagcatggccatgcgctgcgtgggcattgggaacagagattttgttgagggactctccggcgctccctgggtggacgtcgtgctggagcacgggagctgtgtgaccacaatggccaaaaataagcctacgctggatatcgaactcctgaaaaccgaggtcacaaacccggcggttcttcggaagctgtgcattgaagccaaaatctctaataccacaaccgactcccgctgtcccacgcaaggagaggctacactcgtggaagaacaggatgccaactgcgtgtgtagacggaccttcgtcgaccgcggctggggcaatgggtgcggactgtttggcaaggggagccttattacctgcgctaagttcaaatgtgtgacaaagctggagggaaaaatcgttcagtacgaaaacctcaagtattctgtgatcgtcaccgtgcacacaggcgatcagcatcaagttgggaatgagacgaccacacacggaaccacagccaccattacgcctcaggcccccacctccgaaatccagctgacagactacggcgctctgaccctcgactgcagccctagaacaggcctggattttaacgagatggtgcttctgaccatgaaagaaaagtcttggctcgtccataaacagtggttcctggaccttcccctgccgtggacgtccggggcgagcacatcccaagagacctggaatcggcaggatctcctggtgacatttaagaccgcccacgctaagaaacaggaggtcgtggttctgggatctcaagaaggcgccatgcacaccgccctcacaggggctacggagattcagaccagcggaacaaccacaatcttcgccggccatctgaagtgtcgccttaaaatggacaagctgaccctcaaagggatgtcctatgtgatgtgcacgggcagctttaagctggaaaaggaggtcgcggaaacacagcacggaaccgtgctggttcaggtgaaatacgagggcaccgatgctccttgtaagattcccttctctacacaagacgagaaaggggccacccagaacggaagacttatcacagccaatcctatcgtcacggataaggaaaaacccgtgaacattgaggctgaaccccctttcggcgagtcctatatcgtggttggggccggagagaaggctctcaagctgagctggtttaaaaagggctctagcattgggaaaatgctggaagccaccgcgcggggcgccagacgcatggctatcctcggagacacagcctgggatttcggctccattgggggagtctttacctctatgggcaagctggtgcatcaggtgttcgggacagcttacggagtcctttttagcggcgtgtcctggaccatgaaaatcgggatcggcattctgctcacgtggctgggactgaatagccggaacacctctctttccatgatgtgcatcgccgttggcatggtgacactctacctgggggtcatggtgcaggcggacagcggatgtgttattaactggaagggcagagagctgctctgcgggaccggaatcttcgtgacaaatgaagtccacacctggacagatccgtataagtttcaagccgacccctctaaccgcctgtcccctattatcggcaaggcttgtgtgattcgggtttgcgggatcagaagcgccacccgccttgagaatatcatgtggaagcagatttccaacgaactgaatcatatcctcctggagaacgacatgaaattcacggtggtcgtgggcgatgtgtctggcattctggctcagggcgagaagatgatccggccccagcctatggaacacaaatacagctggaagtcctgggggaaagccaagattatcggagccgacgtccaaaatacaacctttatcattgatggccccaacaccccggagtgtcctgacaatcagagagcttggaacatctgggaagttgaggattatgggttcggaatttttacaaccaatatctggcttaagctccgcgactcttacacacaggtgtgcgatcaccggctgatgagcgcggccattaaagactccaaggctgtgcatgccgatatgggctattggatcgaaagcgagaaaaacgagacatggaagctggccagagcttctttcatcgaagtcaaaacctgcacatggcccaagtcccacaccctctggagcaatggcgtgctggagtctgaaatgattatccctaagatttacgggggacccatctcccagcataactatcgccctggctactttacacaaaccgccgggccctggcaccttggaaaactggagctcgacttcgatttctgtgaaggcacgaccgttgtggtcgacgagcactgcgggaatcggggaccgagcctgagaacaaccacagtgaccggcaagattatccatgagtggtgttgccggtcttgtacgctgcctccccttcgctttaaaggcgaagatgggtgctggtacggaatggagatcagacccgttaaggacaaagaagagaacctcgtgaaaagcatggtctccgcgggcagcggggaggtggactctttctccctgggactgctctgtattagcatcatgattgaagaggttatgcggtccagatggtctaagaaaatgctgatggtgggcacacttgctgtctttctgctcctgatcatggggcagctgacctggagcgatcttattcgcctgtgcatcatggtgggagccaacgcctccgaccggatgggcatgggcacaacctatctcgctctgatggccaccttcaagatgagacctatgtttgcggtggggctcctgttcccgaaacttacatctcgcgaagtcctgctcctgacgattggactgagccttgttgcttccgtggagctgccctctagcctcgaagaactgggcgatgggctcgccaagggaatcatgatgctgaaacttctgaccgactttcagtcccaccaactctgggccacactgctgagccttaccttcatcaagacaaccttttctctgcattacgcttggaagacgatggccatggtgctctccattgtcagcctgttccctctctgtctgtctacaacctcccagaaaaccacatggcttcccgtgctgctgggcagcctcgggtgcaagcctctgcccatgtttcttatcaccgagaataaaatttggggaagaaagtcttggcctctgaacgaaggcatcatggctgttggcattgtgtccatcctcctgagctccctcctgaaaaatgatgtcccccttgccgggccgctgatcgcgggaggcatgctggtggcctgttatgttattagcgggtctagcgctgacctctccctggagaaggccgctgaagtgtcttgggaggaagaggccgagcacagcggagcctcccataacatccttgtcgaagtgcaggatgacggcacacggaaaattaaggatgaggaacgcgacgatacgctgaccatcctcctgaaggctacactcctggcggtctctggggtgtaccctatgagcattcccgccacccttttcgtttggtatttttggcagaaaaagaatcaaagatccggagtgggcctgatcacaccttctcccccggaggtcgaacgggctgtgctggacgatggcatctaccgcattctccagagagggctgcttggacggagccaggttggcgtgggggtcttccaggagggagtgttccacaccatgtggcacgtgacgcgcggcgccgttctgatgtatcaagggaaaagactcgagccttcctgggccagcgtcaagaaagacctgatctcttacggaggcggctggcggtttcaggggtcctggaacaccggagaagaggtccaggtgattgctgtcgaacccggccgcaatcctaagaacgtgcagacagcccccgggaccttcaagacacccgagggagaggttggcgcgatccctctcgactttaaaccggggaccagcggatctcccattgtgaatagagaaggcaagatcgtcggcctgtacgggaacggagtggttacaacgtccggcacctatgtgagcgctattgcccgggccaaggcttcccaagaggggcctcttcccgaaatcgaggatgaagtcttcagaaagcgcaatctgacaatcatggacctgcatcctggatctggcaaaacccggagatacctccccgccattgtgcgcgaggcgatcaagcggaagctgagaacccttattctggctcctacacgcgttgtggccagcgagatggccgaagctctcaaaggggtcccgatccggtatcagacgaccgccgtgaagtccgagcacacaggcaaagaaattgtggatctgatgtgccatgctacctttacaatgagactgctcagccccgtccgcgttcctaactacaatatgatcatcatggacgaggcccacttcaccgatcccgcgtctattgccgctcggggatatatctccacgagagtgggcatgggggaagccgctgccatttttatgacagccacccctaccggaagcgtggaggctttcccccagtctaacgcgatcattcaagacgaggaacgggatatcccggagcgcagctggaactccggctacgactggatcacagattttcctgggaagaccgtctggttcgtgccctctattaaaagcggaaacgacatcgccaactgccttaagaagaatggcaaaagagttattcagctgtcccggaagacatttgataccgaatatcagaaaacgaagaacaatgactgggactacgtggtcacaaccgatatctctgagatgggggctaacttccgcgccgacagagtgattgatccccggagatgtctgaaacctgttatcctcaaggacggccccgaacgcgtgattctggccggacctatgccggtcacagtggctagcgccgcgcagcggagaggccgcatcgggcggaatcaaaacaaggagggagatcagtacatctatatgggccagccctccaataacgacgaggatcatgctcactggaccgaagccaaaatgcttctggacaatattaacacgcctgaggggatcattcccgccctcttcgaacctgagagagagaaaagcgctgccatcgatggagaataccgcctgcggggcgaagcgagaaaaacctttgtcgaactgatgcgcagaggggacctccccgtgtggctttcttataaggttgcctccgagggcttccagtacagcgatcggcgctggtgctttgacggagaaagaaataaccaagtgctggaggagaataaagatgtggaaatttggacaaaggagggcgaacggaaaaagctgcgcacctgttggctcgacgctagaacatattccgacccgctggcccttcgggagttcaaggaatttgctgccgggagacgctctgtcagcggagatctgatcctcgagatcggcaaactgcctcagcacctgacccagaaggctcagaaagccctcgacaaccttgttatgctgcataattccgagcaagggggaaaggcgtaccggcacgccatggaagaactgcccgatacaattgaaaccctcatgctgcttgctctgatcgccgtgctcacgggcggcgtgacactgttctttctgtctgggagaggactcggcaaaaccagcattgggcttctgtgcgtcatggcttccagcgtgctgctctggatggcctctgttgagcctcattggatcgccgcttccattatcctggagttctttcttatggtgctgctcatccccgagcctgaccgccagcggacaccccaggataaccagctggcgtatgtcgtgattggactcctgttcatgatccttacagtcgccgctaacgagatgggcctgctggaaaccacaaagaaggacctcgggattggacacgtggccgccgagaatcaccatcacgctacgatgctggatgttgaccttagaccggccagcgcgtggaccctgtacgccgtggctacaaccatcattacacctatgatgcggcataccatcgaaaacacgaccgccaatatttctctcacagctatcgccaaccaagcggccatcctgatgggcctggataaaggctggcccatttccaagatggacatcggggtccccctccttgctctgggatgttacagccaggtgaatcctctgaccctcacagccgctgttctgatgcttgtggcccactatgctattatcggcccggggctgcaggccaaagcgacccgcgaggcccaaaagagaacggctgccggaattatgaaaaaccccacagtcgatggcatcgtggctatcgacctcgatcctgtggtttacgacgccaagtttgagaagcagctggggcagattatgctgctcatcctttgcacctctcagattctgctgatgcggacaacctgggccctctgtgaaagcatcaccctggcgacaggaccccttacgaccctgtgggagggctcccctggccgcttctggaatacaaccattgctgtctctatggccaacatctttagagggagctatctcgctggagccggcctggccttctccctgatgaaaagcctcgggggaggccggcgcgggacaggagctcaaggcgaaacccttggcgagaagtggaaaagacagctgaatcagctgtccaagtctgagttcaacacgtacaaacggagcgggatcatggaggtggaccgctccgaggccaaggaaggactcaagagaggcgagacaaccaaacatgcggtgtctcgggggaccgccaagctgagatggtttgtcgaacgcaatcttgttaaacccgagggaaaggtgattgatctgggctgcgggcggggaggctggagctattactgtgctggcctcaaaaaggtgacagaagtcaaagggtataccaagggaggccctgggcacgaggagccgatccccatggccacatacggatggaacctggtgaagctgcactccggcaaagacgttttctttattcctcccgaaaagtgcgatacgctcctttgtgacatcggggagtctagccctaatcccaccattgaagagggaagaacactgcgcgtgctgaaaatggtcgaaccgtggctccggggcaaccagttctgcatcaagattctgaatccttacatgccctccgtggttgagacccttgagcaaatgcagagaaaacatggcgggatgctggtgcgcaaccccctcagcagaaattctacacacgaaatgtattgggtctcctgcggaaccggcaacatcgtgagcgctgtgaacatgacgtctagaatgctgctgaatcgctttaccatggcccatcggaagcctacatacgagagagatgtcgacctcggggcgggaacccgccacgttgccgtggaacccgaggtggctaacctggatatcattggccagcggatcgagaatattaagaacgaacacaaatccacatggcattatgacgaggataatccttacaagacctgggcctatcacgggagctacgaagtcaaaccgtctggatccgctagctccatggtgaacggcgttgtgagacttctgacaaagccctgggacgtcatccctatggtgacccagattgccatgacggatacaacccccttcggccaacagcgcgtttttaaagagaaggtggacaccagaacacctaaggctaaacgggggacggcccagatcatggaagtcaccgcgcgctggctctggggattcctgagcagaaataagaaaccccggatctgtacaagagaggagtttacccggaaggtgcgctctaacgccgctattggcgccgttttcgtggacgaaaatcaatggaacagcgctaaagaggccgtcgaagatgagagattttgggaccttgtgcatcgggaacgcgagctgcacaagcaggggaagtgcgccacatgtgtctataataaaatgggaaagagagagaaaaagctcggcgagttcgggaaagcgaagggctcccgggctatctggtacatgtggctgggagcccgctttctggagttcgaagccctcggcttcatgaacgaggatcattggttttctagagaaaatagcctgtccggggtggagggagagggccttcacaaactggggtacattctccgggacatctctcgcattccgggaggcaacatgtatgctgatgacaccgccgggtgggatacaagaatcaccgaagacgatctgcagaatgaggctaagatcacggacattatggaacctgagcacgcccttctggcgaccagcatcttcaagctcacataccagaacaaagttgtgcgggtccaacgccccgccaagaacggcaccgtgatggatgctatttccagacgggaccagcgcggatctggccaggtggggacatatggactgaatacctttctgcataaagaggcccagctcatcagacaaatggagttcgagggcatttttctgcctagcgaacttgagacgcccaacctggctgggcgggttctcgattggctggaacagtacggagtggagagacttaagcgcatggccatctccggcgacgactgcgtcgtgaaacctatcgatgaccggttcgcgacagccctgaccgctctcaatgatatggggaaggttagaaaggacattccccagtgggagccgagcaaaggctggggagattggcagcaagtgcctttttgttctcaccatttccaccagctgatcatgaaggacgtccgcgaaattgtggtcccctgccggaaccaggatgagctggtgggcagagcccgcgtttcccagggggctggatggagcctccgggaaacagcctgtctgggcaaatcttatgctcaaatgtggcagcttatgtactttcacagacgcgacctgcggctcgccgcgaatgccatctgctccgctgtgcccgtcgattgggtgcctaccagcagaacgacctggtccattcatgcccaccatcagtggatgacaaccgaggacatgctgtctgtttggaaccgcgtgtggatcgaagagaatccgtggatggaggataagacacacgtcagctcctgggaagacgtgccctatcttgggaaacgggaggaccaatggtgtggaagcctgattggcctcaccgccagagctacatgggccaccaacatccaggtggcgatcaatcaggttcggagactgattgggaacgaaaattacctggattacatgacgtctatgaagcgcttcaagaacgagtccgaccctgaaggcgctctctggtga

SEQ ID NO: 18738 - RNA, 9879 nt, synthetic construct
  misc_feature 1..9879: note = derived and/or modified CDS sequence (opt5) from DENV-1__EU482567__SS-prME
  source 1..9879: mol_type = other RNA
agcgtgaccatgctgctcatgctgcttcccaccgctctggctttccacctcacgacccggggcggggagcctcatatgatcgtctccaagcaggaacggggaaaatctctgctttttaagacaagcgccggcattaacatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttattctggtgacacctagcatggctatgcgctgcgtcggcatcgggaacagagattttgtggagggactctccggcgccacgtgggttgacgtggtcctggagcacgggagctgtgtgaccacaatggctaaagataagcccaccctggacattgaactcctgaaaacagaggtgaccaatcctgccgtccttcggaagctgtgcatcgaagcgaaaatttctaacacgacaaccgattcccgctgtccgacccaaggagaggccacactcgttgaggaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaatcgtgcagtacgaaaatctgaagtattccgttatcgtgaccgtccacacaggcgaccagcatcaagtggggaacgagaccacagaacacggaaccattgccacgatcacaccccaggctcctacaagcgagattcagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaatccagacatccggaaccacaaccatttttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagatccctttctccgcgcaagatgaaaaaggggtgacccagaatggaagactcatcacagctaaccccattgtcacggacaaggagaaacctgtgaatatcgaaaccgagccgccctttggcgagagctatattgtggttggggccggagaaaaggccctgaagctgtcttggttcaaaaagggcagctccatcgggaaaatgtttgaggctacagcccggggcgctagacgcatggccattctcggagataccgcgtgggacttcggctctatcgggggagtctttacaagcgccggcaagctggtgcatcaggtgttcggggctgcctacggagtcctcttttccggcgtgagctggaccatgaaaatcgggattggcatcctgctcacgtggctgggactgaactctcggtccaccagcctttctatgacatgtattgctgttggcatggtgaccctctacctgggggtcgtggttcaggccgattccggatgcgtgatcaattggaagggcagagaactgaagtgtgggagcggaattttcgtcacaaacgaggtgcacacctggacagaacaatataaatttcaggcggactcccctaagcgcctctctgccgctatcggcaaagcctgggaggagggggtttgcggcattcggagcgctaccagactggaaaacatcatgtggaagcagatctccaatgagcttaaccatattctgctcgaaaatgacatgaaattcacggtggtcgtgggagatgccaacggcatcctggcccaggggaagaaaatgattcgcccgcaacccatggagcaccggtactcttggaaaagctggggaaaggctaagatcattggcgcggacatccagaatgccacatttatcattgatgggcctgacacccccgaatgtcctgatgaccagagagcttggaacatctgggaggtggaggattatggattcggcatttttaccacaaatatctggctgaaacttcgcgactcctacacccagatgtgcgatcaccggctcatgagcgccgccattaaagactctaaggctgtccatgccgatatgggctattggatcgaatccgagaaaaacgaaacgtggaagctggcgagagctagcttcatcgaggttaagacatgtatttggcccaaatctcacaccctgtggtccaatggggtgctcgaaagcgagatgatcattccgaagatctacggaggccctatttctcaacataactatcgccccgggtacttcacacagaccgccggaccttggcacctgggcaaacttgagctggactttgatctctgcgaagggacaaccgtggtcgtggacgagcactgcggaaatcggggccccagcctgagaacgaccacagttaccggcaagatcatccatgaatggtgttgccggtcctgtacactgcctccccttcgcttcagaggggaggacggatgctggtacggcatggagattcggccggtgaaagaaaaggaggaaaacctcgtcagaagcatggtgtctgccgggtccggagaggttgatagcttttccctgggcatcctgtgtgtgtctattatgatcgaagaggtcatgcgcagccggtggtccagaaagatgctcatgaccgggacgctggctgtgttccttctgctcattatgggacagctgacatggaaagacctgatccgcctttgcattatggttggcgccaatgcgtctgatagaatgggcatggggaccacatatctggctctcatggccacctttaagatgcggcctatgttcgccgtgggactgctctttcgcagactgaccagccgggaggtccttctgctcacaatcggcctgtccctggtggcttctgtggaacttcccaacagcctggaggaactcggggacggactggccatgggcatcatgatgctcaaactgcttacggagttccaaccccaccagctgtggaccacactcctgtccctgacctttattaatacaacccttagcctggattacgcttggcgcacgatggccatggtcctctctatcatttccctgttccctctctgtctgagcacaacctctcagaagaccacatggcttccggttctgctggggtcctttggatgcaaacccctcaccatgttcctgatcacagaaaacaagatttggggcagaaagagctggcctcttaacgagggcatcatggcgatcgggattgtgtctatcctgctctccagcctgctcaaaaatgacgtgcccctggccggacctcttattgctggcgggatgctgatcgcctgttatgtcatttccggaagctctgctgatctgagcctcgagaaggccgccgaagtgtcctgggaggaagaggctgaacattctggcacgagccacaacatcctggttgaggtgcaggacgatgggaccatgaaaatcaaggacgaggaacgggatgacacacttaccattctgctcaaagcgacactgctcgccgtctccggagtgtaccccatgtctatccctgctaccctgtttgtttggtatttctggcaaaagaaaaagcagcgcagcggcgtgctttgggatacgccctccccgcctgaggtcgaaagagccgtgctggacgacggcatttaccggatcctgcagcgcgggctcctgggaagatctcaggtcggcgtgggggttttccaagatggagtgtttcataccatgtggcacgtcacacggggcgccgtgcttatgtatcaggggaagagactggagcccagctgggcttccgttaaaaaggacctcattagctacggaggcggctggcgcttccaggggtcttggaataccggagaggaagtgcaggtcatcgccgtggagcctggcaaaaaccccaagaatgtgcaaacaaccccggggacatttaaaacgcctgaaggagaggttggcgcgattgctctggatttcaagcccgggacctccggaagccctatcgtcaaccgggaaggcaagatcgtgggcctctacgggaatggagtggtcacaacctctggcacctatgtgtccgccattgcccaggctaaaacaagccaggaggggcccctgcccgagatcgaagacgaggtttttaagaaaagaaaccttacgattatggatctgcaccctggatccggcaagacccgccggtacctgccggccatcgtgagagaagcgattaaacgcaagctccggacactgatccttgctcccaccagagtcgtggcctctgagatggccgaagctctgaaggggatgcctatccgctatcaaacaaccgccgttaaaagcgagcatacgggccgggagattgtggacctcatgtgccacgctacattcaccatgagactgctgtcccccgtccgggtgcctaattacaacatgatcattatggatgaagcccattttaccgaccccgcgagcatcgccgctcgcggatatatttctacaagagttggcatgggggaggccgctgccatcttcatgaccgccacacctccgggatccgtggaggcttttccccagagcaatgcggtcatccaggatgaggaacgggacattcctgagcgctcttggaacagcggctacgattggatcaccgacttccccgggaagacggtgtggtttgtgccttccattaaatctggaaatgacatcgccaactgtctcagaaagaatggcaaacgggtcattcagcttagcagaaagacattcgataccgagtatcaaaagaccaagaataacgactgggattacgttgtgaccacggacatctccgaaatgggggctaatttccgcgccgatcgggtgattgaccccagacgctgcctgaagccggtcatcctgaaagatggccctgagcgggtgatcctcgccggacccatgcccgttaccgtggcttctgccgcgcagagacgcggccggattgggagaaaccagaataaggaaggagaccagtacgtctatatgggccaacctctgaacaatgatgaggaccacgctcattggacagaggccaaaatgcttctggataacatcaatacccccgaagggattatccctgccctctttgagccggaacgcgaaaagagcgctgccattgacggagaatacagactgcggggcgaggcgcgcaagacattcgtggagctgatgagaagaggggatctccccgtttggctttcctataaagtggccagcgaaggctttcagtactctgaccgcagatggtgcttcgacggagagcggaacaatcaggtcctggaagagaacatggatgtggaaatctggaccaaggagggcgagcgcaagaagctgcgccctcggtggctcgacgctagaacatattccgatcccctggcccttcgcgaatttaaagagttcgctgccgggcggagaagcgtctccggagacctgatcctcgaaattggcaagctgcctcagcacctgaccctccgggctcaaaatgcccttgataacctggtgatgctgcacaattctgagcaagggggaaaagcgtaccgccatgccatggaagaacttcccgacacgatcgagacactgatgcttctggctctcattgccgttctgaccggcggcgtgaccctgtttttcctcagcgggaagggacttggcaagacatccatcgggctgctgtgtgtgatggcttctagcgccctcctgtggatggccaacgtcgaaccgcactggattgctgcgtccatcatccttgagtttttcctgatggttctcctgattcctgaacccgatagacagcggacccctcaggacaatcaactggcctatgtggtgatcggactcctttttatgattctgacagtcgctgccaacgagatgggcctgctcgagacgaccaaaaaggatctggggatcggacatgtggccgctgaaaaccaccaccatgccacaatgcttgacgttgatctgcgccccgcgagcgcctggaccctctacgctgtggccacaaccgtcattacgcctatgatgagacacaccatcgagaatacaaccgctaacatttctctgacagccatcgcgaatcaggccgctatcctgatgggcctcgacaaaggctggcccatttccaagatggatatcggggtgccgcttctggccctgggatgctacagccaggtcaaccctctcaccctgacggctgccgtgcttatgctggttgctcattatgccattatcggccccgggctccaagcgaaagccacacgggaagctcagaagcgcaccgccgctggaattatgaagaatcccacagtggacggcatcgtcgccatcgacctggatcctgtggtttacgacgccaaattcgagaagcagctggggcagattatgctccttatcctgtgtacctctcaaattctgctcatgagaaccacatgggcgctgtgcgaatccatcacgcttgctaccggaccgctgacaaccctctgggagggcagccccggcaaattttggaacacaaccattgccgtgtctatggctaatatcttccgggggagctatctggccggagccggcctggctttctccctcatgaagtctcttgggggaggccgcagagggacgggagcccagggcgagacactgggcgaaaaatggaagcggcagctgaaccagctcagcaagtccgagtttaatacctacaaaagaagcgggatcatggaagtcgatcgctccgaggcgcgggaaggactgaagagaggcgagaccacaaaacacgccgtgtctcgcgggaccgctaaacttcggtggttcgtggagagaaacctggttaaacctgaaggaaaggtcattgacctcggctgtgggcgcggaggctggagctattactgcgccggcctgaagaaagtgacagaggtgaaggggtatacgaaaggaggccccgggcatgaggagcctatccccatggctacctacggatggaatctggtcaagctctactccggcaaagatgtgtttttcattcctccggaaaagtgtgacacacttctgtgcgatatcggggagtctagccccaaccctaccattgaggaaggacggacactgagagttctcaaaatggtggagccctggctgcgcggcaatcaattttgtatcaagattcttaacccttatatgccctccgtcgtggaaaccctggagcagatgcagcggaagcacggcgggatgctcgttagaaatccgctgtctcgcaacagcacgcacgagatgtactgggtgtcctgcggaaccggcaatatcgtcagcgccgtgaacatgacatctcggatgctgctcaacagattcaccatggcgcatcgcaaacctacatatgaaagagacgttgatctgggggccggaacccggcacgtggctgtcgagcccgaagtggccaatcttgacatcattggccagcgcatcgagaacattaagaatgaacataaatccacatggcactacgatgaggacaacccctataagacctgggcttaccacgggagctatgaggtgaaaccttctggatccgccagctctatggtcaatggcgttgtgagactgctcacgaagccctgggacgtgatccctatggtcacacaaattgctatgaccgataccacaccgtttggccagcagcgggtgttcaaggaaaaagttgacacgagaacaccccgggccaagcgcgggacagcgcaaatcatggaggtgaccgccaaatggctgtggggatttctttccagaaacaagaaacctcggatctgtacacgcgaagagttcaccagaaaggtccggagcaatgctgccattggcgctgtgtttgttgatgaaaaccagtggaactccgccaaggaggccgtggaggacgaacgcttctggaacctggtccatagagagcgggaactccacaaacaggggaagtgcgcgacatgcgtgtacaatatgatgggaaaacgcgagaagaaactgggcgaatttgggaaggctaagggcagcagagccatctggtacatgtggctgggagcccggttcctcgagttcgaggctctgggctttatgaacgaagatcattggttctctcgcgagaatagcttttccggggttgaaggagagggccttcacaaactggggtatattctcagagacatctctaagattcccggaggcaacatgtacgccgatgacaccgctgggtgggatacgcggatcaccgaggacgatctgcagaatgaagccaaaatcacagacattatggagcctgaacatgcgcttctggccaccagcatcttcaagctcacatatcaaaacaaagtggtccgcgtgcagagacccgctaagaacggcaccgtcatggatgtgatttcccggagagaccagcgcggatctggccaggttgggacgtacggactgaatacatttaccaacatggaggtgcaactgatccggcagatggaaagcgagggcattttcctcccgtccgagctggaaacacctaatcttgccgagagagtcctggactggctcgaaaaacacgggaccgagcgcctgaagcggatggctatctctggagatgactgtgtggtgaagcccgttgatgaaagatttgccacggcgcttatcgccctgaacgacatgggcaaagtgcgcaaggatattcctcagtgggagcccagcaaagggtggaatgactggcagcaagtccctttctgctcccaccattttcaccagctcatcatgaaggatggccgggagattgtggttccctgtagaaaccaggacgaactggtgggacgcgctcgggtcagccagggcgccgggtggtctctgagagagaccgcttgcctcggaaaatcctatgcccaaatgtggcagctgatgtacttccatcgccgggatcttagactggctgccaatgcgatctgtagcgccgtgccggtcgactgggtgcctacatctcggaccacatggtccattcacgctcaccatcagtggatgaccacagaagatatgctcagcgtttggaacagagtgtggatcgaggaaaatccctggatggaggacaagacccacgtctcctcttgggaggaagtgccctatctgggcaagcgcgaggaccaatggtgcgggagccttattggactgacggcccgggccacatgggctaccaacatccaggttgccatcaatcaggtgagacgcctcattggcaacgaaaattacctggattacatgacctccatgaaaagatttaagaacgagagcgaccctgagggggcgctgtggtga

SEQ ID NO: 18739 - RNA, 9879 nt, synthetic construct
  misc_feature 1..9879: note = derived and/or modified CDS sequence (opt5) from DENV-1__FJ390378__SS-prME
  source 1..9879: mol_type = other RNA
agcgtgaccatgctgcttatgctgcttcccaccgctctggctttccacctcacgaccagaggcggggagcctcatatgatcgtctccaagcaggaacggggaaagtctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatttacggaggccctatcagccaacataactatcgccccgggtacttcacacagaccgcgggaccttggcacctgggcaaacttgagctggactttgatctctgcgaagggacaaccgtggtcgtggacgagcactgcggaaatcggggcccctccctgagaacgaccacagttaccggcaagattatccatgaatggtgttgccggagctgtacactgcctccccttcgcttcagaggggaggacggatgctggtacggcatggagatccggccggtgaaagaaaaggaggaaaacctcgtcagatctatggtgtccgctgggagcggagaggttgattccttttctctgggcattctgtgtgtgagcatcatgattgaagaggtcatgcgctcccggtggtctagaaagatgctcatgaccgggacgctggccgtgttccttctgctcatcatgggacagctgacatggaatgacctgattcgcctttgcatcatggttggcgccaacgctagcgatagaatgggcatggggaccacatatctggccctcatggcgacctttaaaatgcggcctatgttcgctgtgggactgctctttcgcagactgacctcccgggaggtccttctgctcacaattggcctgtctctggtggccagcgtggaacttcccaattccctggaggaactcggggacggactggccatgggcatcatgatgctcaagctgcttacggagttccaaccccaccagctgtggaccacactcctgagcctgacctttatcaaaacaaccctttctctggattacgcttggcgcacgatggccatggtcctctccattgttagcctgttccctctctgtctgtctacaacctcccagaagaccacatggcttccggtgctgctggggagctttggatgcaaacccctcaccatgttcctgatcacagaaaacaagatttggggcagaaagtcttggcctcttaacgagggcatcatggctattgggatcgtgtccatcctgctcagctccctgctcaaaaatgacgtccccctggccggacctcttattgcgggcgggatgctgatcgcctgttatgtgattagcggatctagcgctgatctgtccctcgagaaggccgctgaagtttcttgggaggaagaggccgaacatagcggcacgtcccacaacatcctggtggaggtccaggacgatgggaccatgaaaattaaggacgaggaacgggatgacacacttaccatcctgctcaaagccacactgctcgctgtgtctggagtttaccccatgagcatccctgcgaccctgtttgtgtggtatttctggcaaaagaaaaagcagcgctccggcgtcctttgggatacgccctctccgcctgaggtggaaagagccgtcctggacgacggcatttaccggatcctgcagcgcgggctcctgggaagaagccaggtgggcgttggggtgttccaagatggagtctttcataccatgtggcacgtgacacggggcgctgttcttatgtatcaggggaagagactggagccctcctgggccagcgtgaaaaaggacctcatttcttacggaggcggctggcgcttccaggggtcctggaataccggagaggaagtccaggtgatcgccgtggagcctggcaaaaaccccaagaatgttcaaacaaccccggggacatttaaaacgcctgaaggagaggtcggcgctattgccctggatttcaagcccgggaccagcggatctcctatcgtgaaccgggaaggcaagattgtgggcctctacgggaatggagtcgtgacaacctccggcacctatgttagcgcgatcgctcaggccaaaacatcccaggaggggcccctgcccgagatcgaagaggaagtgtttaagaaaagaaaccttacgattatggacctgcaccctggatctggcaagacccgccggtacctgccggccatcgtcagagaggctattaaacgcaagctccggacactgatccttgcccccaccagagtggttgcgagcgaaatggctgaggccctgaaggggatgcctattcgctatcaaacaaccgccgtgaaatccgagcatacgggccgggaaatcgtcgatctcatgtgccacgctacattcaccatgagactgctgagccccgtgcgggttcctaattacaacatgatcattatggacgaggcccattttaccgatcccgcttctatcgccgcgcgcggatatatttccacaagagtgggcatgggggaagccgctgccatcttcatgaccgctacacctccgggaagcgtcgaggcctttccccagtctaatgccgtgattcaggacgaagaacgggatatccctgagcgcagctggaactccggctacgactggatcaccgatttccccgggaagacggtgtggtttgtcccttctattaaaagcggaaatgacatcgctaactgtctcagaaagaatggcaaacgggttattcagctttccagaaagacattcgacaccgaatatcaaaagacacgcaacaacgattgggactacgtggtgaccacggatatctctgagatgggggcgaatttccgggccgacagagtcattgatccccgccggtgcctgaaaccggtgatcctgaaggacggccctgaaagagttattctcgctggacccatgcccgtgaccgtcgccagcgccgctcagcgccggggcagaatcgggcgcaaccagaataaagagggagatcagtacgtgtatatgggccaacctctgaacaatgacgaggatcacgcccattggacagaagcgaagatgcttctggacaacatcaatacccccgaggggattatccctgctctctttgaaccggagagagaaaaatccgccgccattgatggagagtaccggctgcgcggcgaggctagaaagacattcgttgaactgatgcggcgcggggacctccccgtgtggcttagctataaggtcgcctctgagggctttcagtactccgatagacggtggtgcttcgacggagaaagaaacaatcaggtgctggaggaaaacatggacgtcgagatctggaccaaagagggcgaacgcaagaaactgcggcctagatggctcgatgcgcgcacatatagcgaccccctggcccttcgggagtttaaggagttcgctgccgggagacggtccgtgtctggagatctgattctcgagatcggcaaactgcctcagcacctgaccctccgcgctcaaaatgcccttgacaacctggttatgctgcacaatagcgaacaagggggaaaggcttacagacatgccatggaggagctccccgatacgatcgaaacactgatgcttctggcgctcattgccgtgctgaccggcggcgtgaccctgtttttcctctccgggaaaggacttggcaagacatctatcgggctgctgtgtgtcatggctagctccgccctcctgtggatggctaacgttgagccgcactggattgccgccagcatcattcttgaatttttcctgatggtgctcctgatccctgagcccgaccggcagcgcacccctcaggataatcaactggcttatgtggtcatcggactcctttttatgattctgacagtggcggccaacgagatgggcctgctcgaaacgaccaagaaagacctggggatcggatacgttgctgccgagaaccagcatcacgccacaatgcttgatgtggacctgagacccgcttctgcctggaccctctacgcggtcgccacaaccgtgattacgcctatgatgcggcacaccatcgaaaatacaaccgctaacatttccctgacagccatcgctaatcaggccgcgattctgatgggcctcgataagggctggcccatcagcaaaatggacatcggggtcccgcttctggccctgggatgctattctcaagtgaaccctctcaccctgacggctgccgttcttatgctggtggctcattacgccattatcggccccgggctccaggctaaggccacacgcgaggcgcagaaaagaaccgccgctggaattatgaagaatcccacagtcgatggcatcgtggccattgacctggaccctgttgtgtatgatgctaagttcgaaaaacagctggggcaaatcatgctccttatcctgtgtacctcccagattctgctcatgcggaccacatgggccctgtgcgagagcatcacgcttgccaccggaccgctgacaaccctctgggagggctctcccggcaagttttggaacacaaccattgcggtcagcatggctaatatcttccgcgggtcctacctggccggagctggcctggccttctctctcatgaaaagccttgggggaggcagacgggggacgggagcccagggcgaaacactgggcgagaagtggaaaagacagctgaaccaactctccaagagcgaatttaatacctataagcgctccgggattatggaggtggaccggtctgaagctaaagagggactgaagagaggcgagaccacaaaacacgccgtgagccgcgggaccgcgaaacttcggtggttcgttgaaagaaacctggtcaaacctgagggaaaggtgatcgatctcggctgtgggcgcggaggctggtcctactattgcgccggcctgaagaaagtgacagaagtcaaggggtacacgaaaggaggccccgggcatgaggaacctatccccatggctacctacggatggaatctggttaagctctattctggcaaagacgtgtttttcacacctccggagaagtgtgatacccttctgtgcgacattggggagagctcccccaaccctacaatcgaagagggacggaccctgagagtgctcaaaatggtcgaaccctggctgcgcggcaatcagttttgtattaagatccttaacccttacatgccctctgtggttgagacgctggagcagatgcagcggaagcacggcgggatgctcgtgagaaatccgctgagccgcaactccacccatgaaatgtattgggtcagctgcggaacaggcaatattgtgtctgccgttaacatgacctcccggatgctgctcaacagattcacaatgacccaccgcaaacctacatacgagagagatgtggacctgggggctggaacccggcacgtcgccgtggaacccgaggtggcgaatcttgatatcattggccaacgcatcgaaaacatcaagaatgagcataaaagcacgtggcactatgacgaggataacccctacaagacatgggcctatcatgggtcttacgaagtcaaaccttccggaagcgcttcttccatggttaatggcgtggtgagactgctcaccaagccctgggacgtcattcctatggtgacccagatcgccatgacagacacgaccccgtttggccagcaacgggttttcaaggagaaagtggatacaagaacaccccgggctaagcgcgggacagcccagattatggaagtcaccgctaaatggctgtggggatttcttagcagaaacaagaaacctcggatctgtacacgcgaggagttcaccagaaaggtgcggtccaatgccgcgattggcgccgtttttgtggacgagaaccagtggaatagcgctaaggaggccgtcgaagatgagcgcttctgggacctggtgcacagagaacgggagctccacaaacaggggaagtgcgctacgtgcgtttacaacatgatgggaaaacgcgaaaagaaactgggcgagtttgggaaggccaagggctctagagccatctggtatatgtggctgggagcgcggttcctcgagttcgaagctctgggctttatgaatgaggatcattggttcagccgcgaaaactccttttctggggtggagggagagggccttcacaaactggggtacatcctcagagacattagcaagatccccggaggcaatatgtatgccgatgacaccgccgggtgggatacacggattaccgaagacgatctgcaaaacgaggctaaaatcacagacattatggaacctgagcatgcccttctggctacctccatcttcaagctcacgtaccagaataaagtcgtgcgcgtccagagacccgccaagaacggcacagtgatggatgttatctctcggagagaccagcgcggaagcggccaagtggggacctatggactgaacacatttaccaatatggaagtccagctgattcggcagatggagtccgagggcatcttcctcccgtctgaactggagacgcctaaccttgcggaaagagtgctgaattggctcgagaaacacgggaccgaacgcctgaagcggatggccattagcggagacgattgtgtggttaagcccgtggacgatagatttgctacagcccttatcgctctgaacgacatgggcaaagtccgcaaggatattcctcagtgggagccctccaaagggtggaatgactggcaacaggtgcctttctgcagccatcactttcaccagctcatcatgaaggatggccgggagatcgttgtgccctgtagaaaccaggacgaactggtcggacgcgcccgggtgtctcaaggcgcggggtggtccctgagagagaccgcctgcctcggaaaaagctacgctcagatgtggcagctgatgtatttccatcgccgggatcttagactggccgctaatgccatttgttctgctgtcccggtggactgggttcctacatcccggaccacatggagcatccacgcccatcaccaatggatgaccacggaagatatgctctccgtgtggaacagagtctggattgaggaaaatccctggatggaggacaagacacacgtgtctagctgggaggaagttccctacctgggcaagcgcgaggaccagtggtgcgggtcccttatcggactgaccgcgcgggccacctgggctacaaacattcaggtggccatcaatcaggtcagacgcctcattggcaacgaaaattacctggattatatgaccagcatgaaaagatttaagaacgagtctgaccctgagggggccctgtggtga

SEQ ID NO: 18740 - RNA, 9879 nt, synthetic construct
  misc_feature 1..9879: note = derived and/or modified CDS sequence (opt5) from DENV-1__FJ205872__SS-prME
  source 1..9879: mol_type = other RNA
agcgtgaccatgctgctcatgctgcttcccaccgctctggctttccacctcacgaccagaggcggggagcctcatatgatcgtctccaagcaggaacggggaaaatctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagcctttttcctggcgcatgccattgggacctctatcacccagaagggaatcatttttatcctcctgatgcttgtgacacctagcatggctatgcgctgcgtcggcattgggaacagagatttcgtggagggactgtccggcgccacgtgggttgacgtggtcctcgagcacgggagctgtgtgaccacaatggctaaagataagcccaccctggacatcgaactgctcaaaacagaggtgaccaatcctgccgtcctgcggaaactttgcattgaagcgaaaatctctaacacgacaaccgattcccgctgtccgacccagggagaggccacactggttgaagaacaggacagcaattttgtgtgcagacggaccttcgtggatcgcggctggggcaacgggtgtggactctttggcaaggggtctctgcttacatgcgctaagttcaaatgcgtcacgaagctggagggaaaaattgtgcagtacgaaaatctcaagtattccgttatcgtgaccgtccacacaggcgaccagcatcaagtggggaacgagaccacagaacacggaaccatcgccacgattacaccccaggctcctacaagcgagatccagctgaccgactacggcgccctgacactcgattgttctcccagaaccggcctggactttaatgaaatggttcttctgacgatgaaagagaagtcctggctcgtgcataaacagtggttcctggatcttcctctgccctggacaagcggggcctccacctctcaagagacatggaaccggcaggacctcctggtcacctttaagaccgctcacgcgaagaaacaggaagtggtcgtgctgggaagccaagagggcgccatgcacacagctctcacgggggccaccgaaattcagacatccggaaccacaaccatcttcgccggccatctgaagtgccgccttaaaatggataagctgacgctcaaagggatgagctatgttatgtgtacaggctctttcaagctggagaaggaagtggctgagacccagcacggaaccgtcctggtgcaggttaaatacgagggcacagacgccccgtgcaagattcctttttccgcgcaagatgaaaaaggggtgacccagaatggaagacttatcacagctaaccccatcgtcacggacaaggagaaacctgtgaatattgaaaccgagccgcccttcggcgagagctatatcgtggttggggccggagaaaaggccctcaagctgtcttggtttaaaaagggcagctccattgggaaaatgttcgaggctacagcccggggcgctagacgcatggccatcctgggagataccgcgtgggactttggctctattgggggagtcttcacaagcgtgggcaagctcgtgcatcaggtctttggggccgcttacggagtgctgttctccggcgttagctggaccatgaaaatcgggatcggcattcttctgacgtggctcggactgaactctcggtccaccagcctgtctatgacatgtatcgccgtgggcatggtcaccctttacctcggggtgatggttcaggctgattccggatgcgtgattaattggaagggcagagaactgaagtgtgggagcggaatctttgtcacaaacgaggtgcacacctggacagaacaatataaattccaggccgactcccctaagcgcctgtctgcggccattggcaaggcttgggaggagggggtttgcggcatccggagcgccaccagactcgaaaacattatgtggaagcagatctccaatgagctgaaccatatccttctggaaaatgacatgaaatttacggtggtcgtgggagatgctaacggcattctcgcccaggggaagaaaatgatccgcccgcaacccatggagcaccggtactcttggaaaagctggggaaaggccaagattatcggcgctgacattcaaaattccacattcatcatcgatgggcctgacacccccgaatgtcctgatgaccagagagcgtggaacatttgggaggtggaggattatggatttggcatcttcaccacaaatatttggctgaagctgcgcgacagctacacccagatgtgcgatcaccggcttatgtctgccgctatcaaagactccaaggccgtccatgccgatatgggctattggattgaaagcgagaaaaacgaaacgtggaagctcgctagagcctctttcatcgaggttaagacatgtatctggcccaaatcccacaccctgtggagcaatggggtgctggaatctgagatgattatcccgaagatttacggaggccctatcagccaacataactatcgccccgggtactttacacagaccgcgggaccttggcacctcggcaaactggagcttgacttcgatctgtgcgaagggacaaccgtggtcgtggacgagcactgcggaaatcggggcccctccctcagaacgaccacagttaccggcaagattatccatgaatggtgttgccggagctgtacactgcctcccctgcgctttagaggggaggacggatgctggtacggcatggagatccggccggtgaaagaaaaggaggaaaaccttgtcagatctatggtgtccgctgggagcggagaggttgattccttctctctcggcattctgtgtgtgagcatcatgattgaagaggtcatgcgctcccggtggtctagaaagatgctgatgaccgggacgctcgccgtgtttctgcttctgatcatgggacagctcacatggaatgacctgattcgcctgtgcatcatggttggcgccaacgctagcgatagaatgggcatggggaccacatatcttgccctgatggcgaccttcaaaatgcggcctatgtttgctgtgggactcctgttccgcagactcacctcccgggaggtcctgcttctgacaattggcctctctctggtggccagcgtggaactgcccaattcccttgaggaactgggggacggactcgccatgggcatcatgatgctgaagctcctgacggagtttcaaccccaccagctttggaccacactgctcagcctgaccttcatcaaaacaaccctgtctcttgattacgcttggcgcacgatggccatggtcctgtccattgttagcctctttcctctgtgtctctctacaacctcccagaagaccacatggctgccggtgcttctggggagcttcggatgcaaacccctgaccatgtttctcatcacagaaaacaagatttggggcagaaagtcttggcctctgaacgagggcatcatggctattgggatcgtgtccatccttctgagctccctcctgaaaaatgacgtccccctcgccggacctctgattgcgggcgggatgcttatcgcctgttatgtgattagcggatctagcgctgatctgtccctggagaaggccgctgaagtttcttgggaggaagaggccgaacatagcggcacgtcccacaacatcctcgtggaggtccaggacgatgggaccatgaaaattaaggacgaggaacgggatgacacactgaccatccttctgaaagccacactcctggctgtgtctggagtttaccccatgagcatccctgcgaccctcttcgtgtggtatttctggcaaaagaaaaagcagcgctccggcgtcctgtgggatacgccctctccgcctgaggtggaaagagccgtccttgacgacggcatttaccggatcctgcagcgcgggctgctcggaagaagccaggtgggcgttggggtgtttcaagatggagtcttccataccatgtggcacgtgacacggggcgctgttctgatgtatcaggggaagagacttgagccctcctgggccagcgtgaaaaaggacctgatttcttacggaggcggctggcgctttcaggggtcctggaataccggagaggaagtccaggtgatcgccgtggagcctggcaaaaaccccaagaatgttcaaacaaccccggggacattcaaaacgcctgaaggagaggtcggcgctattgccctcgattttaagcccgggaccagcggatctcctatcgtgaaccgggaaggcaagattgtgggcctgtacgggaatggagtcgtgacaacctccggcacctatgttagcgcgatcgctcaggccaaaacatcccaggaggggcccctccccgagatcgaagaggaagtgttcaagaaaagaaacctgacgattatggaccttcaccctggatctggcaagacccgccggtacctgccggccatcgtcagagaggctattaaacgcaagctgcggacactcatcctggcccccaccagagtggttgcgagcgaaatggctgaggcccttaaggggatgcctattcgctatcaaacaaccgccgtgaaatccgagcatacgggccgggaaatcgtcgatctgatgtgccacgctacatttaccatgagactcctgagccccgtgcgggttcctaattacaacatgatcattatggacgaggcccatttcaccgatcccgcttctatcgccgcgcgcggatatatttccacaagagtgggcatgggggaagccgctgccatctttatgaccgctacacctccgggaagcgtcgaggccttcccccagtctaatgccgtgattcaggacgaggaacgggatatccctgagcgcagctggaactccggctacgactggatcaccgattttcccgggaagacggtgtggttcgtcccttctattaaaagcggaaatgacatcgctaactgtctgagaaagaatggcaaacgggttattcagctctccagaaagacattcgacaccgaatatcaaaagacacgcaacaacgattgggactacgtggtgaccacggatatctctgagatgggggcgaattttcgggccgacagagtcattgatccccgccggtgccttaaaccggtgatcctgaaggacggccctgaaagagttattctggctggacccatgcccgtgaccgtcgccagcgccgctcagcgccggggcagaatcgggcgcaaccagaataaagagggagatcagtacgtgtatatgggccaacctctcaacaatgacgaggatcacgcccattggacagaagcgaagatgctgcttgacaacatcaatacccccgaggggattatccctgctctgttcgaaccggagagagaaaaatccgccgccattgatggagagtaccggctccgcggcgaggctagaaagacatttgttgaactgatgcggcgcggggacctgcccgtgtggctcagctataaggtcgcctctgagggcttccagtactccgatagacggtggtgctttgacggagaaagaaacaatcaggtgcttgaggaaaacatggacgtcgagatctggaccaaagagggcgaacgcaagaaactgcggcctagatggctggatgcgcgcacatatagcgaccccctcgccctgcgggagttcaaggaatttgctgccgggagacggtccgtgtctggagatcttattctggagatcggcaaactccctcagcacctgaccctgcgcgctcaaaatgccctcgacaaccttgttatgctgcacaatagcgaacaagggggaaaggcttacagacatgccatggaggagctgcccgatacgatcgaaacactcatgctgcttgcgctgattgccgctctcaccggcggcgtgaccctgttctttctgtccgggaaaggactcggcaagacatctatcgggcttctgtgtgtgatggccagctccgctctgctctggatggccaacgtcgagccgcactggattgccgctagcatcattctggagttctttcttatggttctgctcatccctgagcccgaccggcagcgcacccctcaggataatcaactggcgtatgtggtgatcggactcctgttcatgattcttacagtcgccgctaacgagatgggcctgctggaaacgaccaagaaagacctcgggatcggatacgtggccgccgagaaccagcatcacgctacaatgctggatgttgaccttagacccgcctctgcgtggaccctgtacgccgtggctacaaccgtcattacgcctatgatgcggcacaccatcgaaaatacaaccgccaacatttccctcacagctatcgccaatcaggcggccattctgatgggcctggataagggctggcccatcagcaaaatggacatcggggtgccgctccttgctctgggatgctattctcaagtcaaccctctgaccctcacggccgctgtgctgatgcttgttgcccattacgctattatcggccccgggctgcaggccaaggcgacacgcgaggcccagaaaagaaccgctgccggaattatgaagaatcccacagtggatggcatcgtcgctattgacctcgaccctgtggtttatgatgccaagtttgaaaaacagctggggcaaatcatgctgctcatcctttgtacctcccagattctgctgatgcggaccacatgggccctctgcgagagcatcacgctggcgaccggaccgcttacaaccctgtgggagggctctcccggcaagttctggaacacaaccattgctgtgagcatggccaatatcttccgcgggtcctacctcgctggagccggcctggccttttctctgatgaaaagcctcgggggaggcagacgggggacgggagctcagggcgaaacacttggcgagaagtggaaaagacagctgaaccaactgtccaagagcgagttcaatacctataagcgctccgggattatggaagtcgaccggtctgaagccaaagagggactcaagagaggcgagaccacaaaacacgcggtgagccgcgggaccgccaagctgcggtggtttgtggaaagaaaccttgttaaacctgagggaaaggtcatcgatctgggctgtgggcgcggaggctggtcctactattgcgctggcctcaagaaagtgacagaagtgaaggggtacacgaaaggaggccccgggcatgaggaacctatccccatggccacctacggatggaatctggtcaagctgtattctggcaaagacgttttctttacacctccggagaagtgtgataccctcctttgcgacattggggagagctcccccaaccctacaatcgaagagggacggaccctgagagtgctgaaaatggtggaaccctggctccgcggcaatcagttctgtattaagatcctgaacccttacatgccctctgtcgtggagacgcttgagcagatgcagcggaagcacggcgggatgctggttagaaatccgctcagccgcaactccacccatgaaatgtattgggtgagctgcggaacaggcaatattgtctctgctgtgaacatgacctcccggatgctgctgaacagatttacaatgacccaccgcaaacctacatacgagagagatgttgacctcggggccggaacccggcacgtggcggtcgaacccgaggtggccaatctggatatcattggccaacgcatcgaaaacatcaagaatgagcataaaagcacgtggcactatgacgaggataacccctacaagacatgggcttatcatgggtcttacgaagtgaaaccttccggaagcgcctcttccatggtcaatggcgttgtgagacttctgaccaagccctgggacgtgattcctatggtcacccagatcgctatgacagacacgaccccgttcggccagcaacgggtgtttaaggagaaagttgatacaagaacaccccgggccaagcgcgggacagctcagattatggaagtgaccgccaaatggctctggggattcctgagcagaaacaagaaacctcggatctgtacacgcgaggaatttaccagaaaggtccggtccaatgcggccattggcgctgtgttcgttgacgagaaccagtggaatagcgccaaggaggctgtggaagatgagcgcttttgggaccttgtccacagagaacgggagctgcacaaacaggggaagtgcgccacgtgcgtgtacaacatgatgggaaaacgcgaaaagaaactcggcgagttcgggaaggccaagggctctagagcgatctggtatatgtggctgggagctcggttcctggagtttgaagccctcggcttcatgaatgaggatcattggtttagccgcgaaaactccttctctggggttgagggagagggcctgcacaaacttgggtacatcctgagagacattagcaagatccccggaggcaatatgtatgccgatgacaccgctgggtgggatacacggattaccgaagacgatctccaaaacgaggccaaaatcacagacattatggaacctgagcatgctctgcttgccacctccatctttaagctgacgtaccagaataaagtggtccgcgtgcagagacccgcgaagaacggcacagtcatggatgtgatctctcggagagaccagcgcggaagcggccaagttgggacctatggactcaacacattcaccaatatggaagtgcagctgattcggcagatggagtccgagggcatctttctgccgtctgaactcgagacgcctaacctggccgaaagagtccttaattggctggagaaacacgggaccgaacgcctcaagcggatggctattagcggagacgattgtgtggtgaagcccgttgacgatagattcgccacagctctgatcgcccttaacgacatgggcaaagtgcgcaaggatattcctcagtgggagccctccaaagggtggaatgactggcaacaggtccctttttgcagccatcacttccaccagctgatcatgaaggatggccgggagatcgtggttccctgtagaaaccaggacgaactcgtgggacgcgcgcgggtctctcaaggcgccgggtggtccctgagagagaccgcttgcctgggaaaaagctacgcccagatgtggcagctcatgtattttcatcgccgggatctgagacttgctgccaatgctatttgttctgccgtgccggtcgactgggtgcctacatcccggaccacatggagcatccacgcgcatcaccaatggatgaccacggaagatatgctgtccgtttggaacagagtgtggattgaggaaaatccctggatggaggacaagacacacgtctctagctgggaggaagtgccctacctcggcaagcgcgaggaccagtggtgcgggtccctgatcggacttaccgcccgggctacctgggccacaaacattcaggttgccatcaatcaggtgagacgcctgattggcaacgaaaattacctcgattatatgaccagcatgaaaagattcaagaacgagtctgaccctgagggggctctgtggtga

SEQ ID NO: 18741 - RNA, 9879 nt, synthetic construct
  misc_feature 1..9879: note = derived and/or modified CDS sequence (opt5) from DENV-1__FJ205873__SS-prME
  source 1..9879: mol_type = other RNA
agcgtgaccatgctgcttatgctgcttcccacagccctggctttccacctcacgaccagaggcggggaacctcatatgatcgtctccaagcaggaacggggaaaatctctgctttttaagacaagcgccggcattaacatgtgcaccctgatcgcgatggacctcggggaactgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaagacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaagctcctaccagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatttacggaggccctatcagccaacataactatcgccccgggtacttcacacagaccgcgggaccttggcacctgggcaaacttgagctggactttgatctctgcgaagggacaaccgtggtcgtggacgagcactgcggaaatcggggcccctccctgagaacgaccacagttaccggcaagattatccatgaatggtgttgccggagctgtacactgcctccccttcgcttcagaggggaggacggatgctggtacggcatggagatccggccggtgaaagaaaaggaggaaaacctcgtcagatctatggtgtccgctgggagcggagaggttgattccttttctctgggcattctgtgtgtgagcatcatgattgaagaggtcatgcgctcccggtggtctagaaagatgctcatgaccgggacgctggccgtgttccttctgctcatcatgggacagctgacatggaatgacctgattcgcctttgcatcatggttggcgccaacgctagcgatagaatgggcatggggaccacatatctggccctcatggcgacctttaaaatgcggcctatgttcgctgtgggactgctctttcgcaagctgacctccagagaggtccttctgctcacaattggcctgtctctggtggccagcgtggaacttcccaattccctggaggaactcggggacggactggccatgggcatcatgatgctcaaactgcttacggagttccaaccccaccagctgtggaccacactcctgagcctgacctttatcaagacaaccctttctctggattacgcttggcggacgatggccatggtcctctccattgttagcctgttccctctctgtctgtctacaacctcccagaaaaccacatggcttccggtgctgctggggagctttggatgcaagcccctcaccatgttcctgatcacagaaaacaagatttggggccgcaaatcttggcctcttaacgagggcatcatggctattgggatcgtgtccatcctgctcagctccctgctcaagaatgacgtccccctggccggacctcttattgcgggcgggatgctgatcgcctgttatgtgattagcggatctagcgctgatctgtccctcgagaaagccgctgaagtttcttgggaggaagaggccgaacatagcggcacgtcccacaacatcctggtggaggtccaggacgatgggaccatgaagattaaagacgaggaaagagatgacacacttaccatcctgctcaaggccacactgctcgctgtgtctggagtttaccccatgagcatccctgcgaccctgtttgtgtggtatttctggcagaagaaaaagcagcggtccggcgtcctttgggatacgccctctccgcctgaggtggaacgcgccgtcctggacgacggcatttacagaatcctgcagcgggggctcctgggacgcagccaggtgggcgttggggtgttccaagatggagtctttcataccatgtggcacgtgacaagaggcgctgttcttatgtatcaggggaaacggctggagccctcctgggccagcgtgaagaaagacctcatttcttacggaggcggctggagattccaggggtcctggaataccggagaggaagtccaggtgatcgccgtggagcctggcaagaaccccaaaaatgttcaaacaaccccggggacatttaagacgcctgaaggagaggtcggcgctattgccctggatttcaagcccgggaccagcggatctcctatcgtgaaccgcgaaggcaaagtggtcggcctctacgggaatggagtggttacaacctccggcacctatgtgagcgcgattgctcaggccaagacatcccaggaggggcccctgcccgagatcgaagaggaagtctttaaaaagcggaaccttacgatcatggacctgcaccctggatctggcaaaaccagacgctacctgccggccattgtgcgggaggctatcaagagaaagctccgcacactgattcttgcccccacccgggttgtggcgagcgaaatggctgaggccctgaaagggatgcctatcagatatcaaacaaccgccgtcaagtccgagcatacgggccgcgaaattgtggatctcatgtgccacgctacattcaccatgcggctgctgagccccgttagagtgcctaattacaacatgatcatcatggacgaggcccattttaccgatcccgcttctattgccgcgcggggatatatctccacacgcgtcggcatgggggaagccgctgccattttcatgaccgctacacctccgggaagcgtggaggcctttccccagtctaatgccgtgatccaggacgaagagagagatattcctgagcggagctggaactccggctacgactggatcaccgatttccccgggaaaacggtctggtttgttccttctatcaagagcggaaatgacattgctaactgtctccgcaaaaatggcaagagagtgatccagctttcccggaagacattcgacaccgaatatcagaaaacaagaaacaacgattgggactacgtggtcaccacggatatttctgagatgggggcgaatttccgcgccgaccgggtgatcgatcccagacgctgcctgaagccggttattctgaaagacggccctgaacgggtgatcctcgctggacccatgcccgtcaccgtggccagcgccgctcagagacgcggccggattgggagaaaccagaataaggagggagatcagtacgtttatatgggccaacctctgaacaatgacgaggatcacgcccattggacagaagcgaaaatgcttctggacaacatcaatacccccgaggggatcattcctgctctctttgaaccggagcgcgaaaagtccgccgccatcgatggagagtacagactgcggggcgaggctcgcaagacattcgtggaactgatgagaagaggggacctccccgtctggcttagctataaagtggcctctgagggctttcagtactccgatcgcagatggtgcttcgacggagaacggaacaatcaggtcctggaggaaaacatggacgtggagatttggaccaaggagggcgaacgcaaaaagctgcgccctcggtggctcgatgcgagaacatatagcgaccccctggcccttcgcgagtttaaagagttcgctgccgggcggagatccgtttctggagatctgatcctcgagattggcaagctgcctcagcacctgaccctccgggctcaaaatgcccttgacaacctggtgatgctgcacaatagcgaacaagggggaaaggcttaccgccatgccatggaggagctccccgatacgatcgaaacactgatgcttctggcgctcatcgccgtgctgaccggcggcgtcaccctgtttttcctctccgggaagggacttggcaagacatctattgggctgctgtgtgttatggctagctccgccctcctgtggatggctaacgtggagccgcactggatcgccgccagcattatccttgaatttttcctgatggtgctcctgattcctgagcccgacagacagcggacccctcaggataatcaactggcttatgtcgtgatcggactcctttttatgatcctgacagttgcggccaacgagatgggcctgctcgaaacgaccaaaaaggacctggggattggacatgtggctgccgagaaccagcaccacgccacaatgcttgatgtcgacctgcgccccgcttctgcctggaccctctacgcggtggccacaaccgtcatcacgcctatgatgagacataccattgaaaatacaaccgctaacatctccctgacagccattgctaatcaggccgcgatcctgatgggcctcgataaaggctggcccattagcaagatggacatcggggtgccgcttctggccctgggatgctactctcaagttaaccctctcaccctgacggctgccgtgcttatgctggtcgctcactatgccatcattggccccgggctccaggctaaagccacacgggaggcgcagaagcgcaccgccgctggaatcatgaagaatcccacagtggatggcattgttgccatcgacctggaccctgtggtctacgatgctaaattcgaaaagcagctggggcaaattatgctccttatcctgtgtacctcccagatcctgctcatgagaaccacatgggccctgtgcgagagcattacgcttgccaccggaccgctgacaaccctctgggagggctctcccggcaaattttggaacacaaccatcgcggtgagcatggctaatattttccgggggtcctatctggccggagctggcctggccttctctctcatgaaaagccttgggggaggccgcagagggacgggagcccagggcgaaacactgggcgagaaatggaagcggcagctgaaccaactctccaagagcgaatttaatacctacaaaagatccgggatcatggaggtggaccgctctgaagctaaggagggactgaaacggggcgagaccacaaagcatgccgttagcagagggaccgcgaaacttcgctggttcgtcgaacggaacctggtgaagcctgagggaaaggtgattgatctcggctgtgggagaggaggctggtcctattactgcgccggcctgaaaaaggtcacagaagttaaagggtatacgaagggaggccccgggcacgaggaacctatccccatggctacctacggatggaatctggtgaaactctactctggcaaggacgtgtttttcacacctccggagaaatgtgatacccttctgtgcgacatcggggagagctcccccaaccctacaattgaagagggacgcaccctgcgggtcctcaagatggtggaaccctggctgagaggcaatcagttttgtatcaagattcttaacccttatatgccctctgttgtggagacgctggagcagatgcagcgcaaacatggcgggatgctcgtccggaatccgctgagcagaaactccacccacgaaatgtactgggtgagctgcggaacaggcaatatcgtttctgccgtgaacatgacctcccgcatgctgctcaaccggttcacaatgacccacagaaagcctacatatgagcgcgatgtcgacctgggggctggaaccagacatgtggccgtggaacccgaggtcgcgaatcttgatattatcggccaacggattgaaaacatcaaaaatgagcacaagagcacgtggcattacgacgaggataacccctataaaacatgggcctaccacgggtcttatgaagttaagccttccggaagcgcttcttccatggtgaatggcgtggtccgcctgctcaccaagccctgggacgtgatccctatggttacccagattgccatgacagacacgaccccgtttggccagcaaagagtgttcaaagagaaggtcgatacacggacccccagagctaaacgggggacagcccagatcatggaagtgaccgctaagtggctgtggggatttcttagccgcaacaaaaagcctagaatttgtacacgggaggagttcacccgcaaggttagatccaatgccgcgatcggcgccgtgtttgtcgacgagaaccagtggaatagcgctaaagaggccgtggaagatgagcggttctgggacctggttcaccgcgaaagagagctccataagcaggggaaatgcgctacgtgcgtgtacaacatgatgggaaagcgggagaaaaagctgggcgagtttgggaaggccaaaggctctcgcgccatttggtacatgtggctgggagcgagattcctcgagttcgaagctctgggctttatgaatgaggatcactggttcagccgggaaaactccttttctggggtcgagggagagggccttcataagctggggtatatcctccgcgacatcagcaaaattcccggaggcaatatgtacgccgatgacaccgccgggtgggatacaagaatcaccgaagacgatctgcaaaacgaggctaagattacagacatcatggaacctgagcacgcccttctggctacctccattttcaaactcacgtatcagaataaggtggtccgggtgcagcgccccgccaaaaacggcacagttatggatgtgatctctagacgggaccagagaggaagcggccaagtcgggacctacggactgaacacatttaccaatatggaagtgcagctgatccgccagatggagtccgagggcattttcctcccgtctgaactggagacgcctaaccttgcggaacgggtgctgaattggctcgagaagcatgggaccgaaagactgaagcgcatggccatcagcggagacgattgtgttgtgaaacccgtcgacgatcggtttgctacagcccttattgctctgaacgacatgggcaaggtgagaaaagatatccctcagtgggagccctccaaggggtggaatgactggcaacaggttcctttctgcagccaccactttcatcagctcattatgaaagatggccgcgagatcgtggtcccctgtcggaaccaggacgaactggtgggacgggctcgcgtctctcaaggcgcggggtggtccctgcgggagaccgcctgcctcggaaagagctatgctcagatgtggcagctgatgtacttccacagacgcgatcttcggctggccgctaatgccatctgttctgctgtgccggttgactgggtgcctacatccagaaccacatggagcattcatgcccaccaccaatggatgaccacggaagatatgctctccgtctggaaccgggtgtggatcgaggaaaatccctggatggaggacaagacacatgtttctagctgggaggaagtgccctatctgggcaaaagagaggaccagtggtgcgggtcccttattggactgaccgcgcgcgccacctgggctacaaacatccaggtcgccattaatcaggtgcggagactcatcggcaacgaaaattacctggattacatgaccagcatgaagcgctttaaaaacgagtctgaccctgagggggccctgtggtga

SEQ ID NO: 18742 - RNA, 9879 nt, synthetic construct
  misc_feature 1..9879: note = derived and/or modified CDS sequence (opt5) from DENV-1__FJ390379__SS-prME
  source 1..9879: mol_type = other RNA
agcgtgaccatgctgcttatgctgcttcccaccgctctggctttccacctcacgaccagaggcggggagcctcatatgatcgtctccaagcaggaacggggaaaatctctgctttttaagacaagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaagctcctaccagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggcgcaagatgatccggccgcaacccatggagcacagatactcttggaaaagctggggaaaggccaagattatcggcgctgacattcaaaattccacatttatcatcgatgggcctgacacccccgaatgtcctgatgaccagcgcgcgtggaacatttgggaggtggaggattatggattcggcatctttaccacaaatatttggctgaaacttcgggacagctacacccagatgtgcgatcacagactcatgtctgccgctatcaaggactccaaagccgtccatgccgatatgggctattggattgaaagcgagaagaacgaaacgtggaaactggctcgcgcctctttcatcgaggttaagacatgtatctggcccaagtcccacaccctgtggagcaatggggtgctcgaatctgagatgattatcccgaaaatttacggaggccctatcagccaacataactatcggcccgggtacttcacacagaccgcgggaccttggcacctgggcaaacttgagctggactttgatctctgcgaagggacaaccgtggtcgtggacgagcactgcggaaatagaggcccctccctgcggacgaccacagttaccggcaaaattatccatgaatggtgttgccgcagctgtacactgcctccccttagattcagaggggaagacggatgctggtacggcatggagatccggccggtgaaggaaaaagaggaaaacctcgtccgctctatggtgtccgctgggagcggagaggttgattccttttctctgggcattctgtgtgtgagcatcatgattgaagaggtcatgcggtccagatggtctcgcaagatgctcatgaccgggacgctggccgtgttccttctgctcatcatgggacagctgacatggaatgacctgattagactttgcatcatggttggcgccaacgctagcgatcggatgggcatggggaccacatatctggccctcatggcgacctttaagatgcgccctatgttcgctgtgggactgctctttagacggctgacctcccgcgaggtccttctgctcacaattggcctgtctctggtggccagcgtggaacttcccaattccctggaggaactcggggacggactggccatgggcatcatgatgctcaaactgcttacggagttccaaccccaccagctgtggaccacactcctgagcctgacctttatcaagacaaccctttctctggattacgcttggagaacgatggccatggtcctctccattgttagcctgttccctctctgtctgtctacaacctcccagaaaaccacatggcttccggtgctgctggggagctttggatgcaagcccctcaccatgttcctgatcacagaaaacaaaatttggggccggaagtcttggcctcttaacgagggcatcatggctattgggatcgtgtccatcctgctcagctccctgctcaagaatgacgtccccctggccggacctcttattgcgggcgggatgctgatcgcctgttatgtgattagcggatctagcgctgatctgtccctcgagaaagccgctgaagtttcttgggaggaagaggccgaacatagcggcacgtcccacaacatcctggtggaggtccaggacgatgggaccatgaagattaaagacgaggaacgcgatgacacacttaccatcctgctcaaggccacactgctcgctatctctggagtgtaccccatgagcattcctgcgaccctgtttgtttggtatttctggcagaagaagaaacagagatccggcgtgctttgggatacgccctctccgcctgaggtcgaacgggccgtgctggacgacggcatctaccgcattctgcagagagggctcctgggacggagccaggtcggcgtgggggttttccaagatggagtgtttcataccatgtggcacgtcacaagaggcgctgtgcttatgtatcaggggaaacgcctggagccctcctgggccagcgttaagaaagacctcatctcttacggaggcggctggcggttccaggggtcctggaataccggagaggaagtgcaggtcattgccgtggagcctggcaagaaccccaaaaatgtgcaaacaaccccggggacatttaagacgcctgaaggagaggttggcgctatcgccctggatttcaaacccgggaccagcggatctcctattgtcaacagagaaggcaagatcgtgggcctctacgggaatggagtggtcacaacctccggcacctatgtgagcgcgatcgctcaggccaagacatcccaggaggggcccctgcccgagattgaagaggaagtttttaaaaagcgcaaccttacgatcatggacctgcaccctggatctggcaaaacccggagatacctgccggccattgtgcgcgaggctatcaagcggaaactcagaacactgattcttgcccccacccgcgtcgtggcgagcgaaatggctgaggccctgaaggggatgcctatccggtatcaaacaaccgccgttaagtccgagcatacgggcagagaaatcgtggatctcatgtgccacgctacattcaccatgcggctgctgagccccgtccgcgtgcctaattacaacatgattatcatggacgaggcccattttaccgatcccgcttctattgccgcgagaggatatatctccacacgggttggcatgggggaagccgctgccattttcatgaccgctacacctccgggaagcgtggaggcctttccccagtctaatgccgtcatccaggacgaagaacgcgatatccctgagagaagctggaactccggctacgactggattaccgatttccccgggaaaacggtgtggtttgtgccttctatcaagagcggaaatgacattgctaactgtctccggaaaaatggcaagagagtcatccagctttcccgcaaaacattcgacaccgaatatcaaaagacacggaacaacgattgggactacgttgtgaccacggatatttctgagatgggggcgaatttcagagccgaccgcgtgatcgatccccggagatgcctgaagccggtcattctgaaagacggccctgaacgcgtgatcctcgctggacccatgcccgttaccgtggccagcgccgctcagcggagaggccgcatcgggagaaaccagaataaggagggagatcagtacgtctatatgggccaacctctgaacaatgacgaggatcacgcccattggacagaagcgaaaatgcttctggacaacattaatacccccgaggggatcattcctgctctctttgaaccggagcgggaaaagtccgccgccatcgatggagagtaccgcctgagaggcgaggctcggaaaacattcgtggaactgatgcgcagaggggacctccccgtttggcttagctataaggtggcctctgagggctttcagtactccgatcggagatggtgcttcgacggagaacgcaacaatcaggtcctggaggaaaacatggacgtggagatttggaccaaggagggcgaacggaaaaagctgagacctcgctggctcgatgcgcggacatatagcgaccccctggcccttagagagtttaaagagttcgctgccgggcggcgctccgtctctggagatctgatcctcgagatcggcaagctgcctcagcacctgaccctcagagctcaaaatgcccttgacaacctggtgatgctgcacaatagcgaacaagggggaaaggcttaccggcatgccatggaggagctccccgatacgattgaaacactgatgcttctggcgctcatcgccgttctgaccggcggcgtgaccctgtttttcctctccgggaagggacttggcaaaacatctattgggctgctgtgtgtgatggctagctccgccctcctgtggatggctaacgtcgagccgcactggatcgccgccagcattatccttgaatttttcctgatggttctcctgatccctgagcccgaccgccagagaacccctcaggataatcaactggcttatgtggtgattggactcctttttatgatcctgacagtcgcggccaacgagatgggcctgctcgaaacgaccaagaaggacctggggattggacatgtggctgccgagaaccagcaccacgccacaatgcttgatgttgacctgcggcccgcttctgcctggaccctctacgcggtggccacaaccgtcatcacgcctatgatgcgccataccattgaaaatacaaccgctaacatctccctgacagccattgctaatcaggccgcgatcctgatgggcctcgataaaggctggcccatcagcaagatggacattggggtgccgcttctggccctgggatgctactctcaagtcaaccctctcaccctgacggctgccgtgcttatgctggttgctcactatgccatcattggccccgggctccaggctaaagccacaagagaggcgcagaagcggaccgccgctggaatcatgaaaaatcccacagtggatggcattgtcgccatcgacctggaccctgtggtttacgatgctaagttcgaaaagcagctggggcaaatcatgctccttattctgtgtacctcccagatcctgctcatgcgcaccacatgggccctgtgcgagagcattacgcttgccaccggaccgctgacaaccctctgggagggctctcccggcaaattttggaacacaaccatcgcggtgagcatggctaatattttcagagggtcctatctggccggagctggcctggccttctctctcatgaaaagccttgggggaggccggagagggacgggagcccagggcgaaacactgggcgagaaatggaagcgccagctgaaccaactctccaaaagcgaatttaatacctacaagcggtccgggatcatggaggtcgacagatctgaagctaaggagggactgaaacgcggcgagaccacaaagcatgccgtgagccgggggaccgcgaaacttagatggttcgtggaacgcaacctggttaagcctgagggaaaagtcatcgatctcggctgtgggcggggaggctggtcctattactgcgccggcctgaagaaggtgacagaagtgaaagggtatacgaagggaggccccgggcacgaggaacctgtccccatggctacctacggatggaatctggttaaactctactctggcaaggacgtgtttttcacacctccggagaaatgtgatacccttctgtgcgacattggggagagctcccccaaccctacaatcgaagagggaagaaccctgcgcgtgctcaagatggtcgaaccctggctgcggggcaatcagttttgtattaaaatccttaacccttatatgccctctgtggttgagacgctggagcagatgcagagaaagcatggcgggatgctcgtgcgcaatccgctgagccggaactccacccacgaaatgtactgggtcagctgcggaacaggcaatattgtgtctgccgttaacatgacctccagaatgctgctcaaccgcttcacaatgacccacagaaagcctacatatgagcgggatgtggacctgggggctggaacccgccatgtcgccgtggaacccgaggtggcgaatcttgatatcattggccaaagaatcgaaaacatcaaaaatgagcacaagagcacgtggcattacgacgaggataacccctataaaacatgggcctaccacgggtcttatgaagtcaagccttccggaagcgcttcttccatggttaatggcgtggtgcggctgctcaccaaaccctgggacgtcattcctatggtgacccagatcgccatgacagacacgaccccgtttggccagcaaagagttttcaaggagaaggtggatacacggacaccccgcgctaaaagagggacagcccagattatggaagtcaccgctaagtggctgtggggatttcttagccggaacaaaaagcctcgcatctgtacaagagaggagttcacccggaaagtgcgctccaatgccgcgattggcgccgtttttgtggacgagaaccagtggaatagcgctaaggaggccgtcgaagatgagagattctgggacctggtgcaccgggaacgcgagctccataagcaggggaaatgcgctacgtgcgtttacaacatgatgggaaagagagagaaaaagctgggcgagtttgggaaagccaagggctctcgggccatctggtacatgtggctgggagcgcgcttcctcgagttcgaagctctgggctttatgaatgaggatcactggttcagcagagaaaactccttttctggggtggagggagagggccttcataagctggggtatatcctccgggacattagcaaaatccccggaggcaatatgtacgccgatgacaccgccgggtgggatacacgcattaccgaagacgatctgcaaaacgaggctaagatcacagacattatggaacctgagcacgcccttctggctacctccatcttcaaactcacgtatcagaataaggtcgtgagagtccagcggcccgccaaaaacggcacagtgatggatgttatctctagacgcgaccagcggggaagcggccaagtggggacctacggactgaacacatttaccaatatggaagtccagctgattagacagatggagtccgagggcatcttcctcccgtctgaactggagacgcctaaccttgcggaacgcgtgctggactggctcgagaagcatgggaccgaacggctgaaaagaatggccattagcggagatgactgtgtggttaagcccgtggatgaccgctttgctacagcccttatcgctctgaatgatatgggcaaggtccggaaagacattcctcagtgggagccctccaaggggtggaacgattggcaacaggtgcctttctgcagccaccactttcatcagctcatcatgaaagacggcagagagatcgttgtgccctgtcgcaatcaggatgaactggtcggacgggccagagtgtctcaaggcgcggggtggtccctgcgcgagaccgcctgcctcggaaagagctatgctcagatgtggcagctgatgtacttccaccggagagaccttcggctggccgctaacgccatttgttctgctgtcccggtggattgggttcctacatccagaaccacatggagcatccatgcccaccaccaatggatgaccacggaagacatgctctccgtgtggaatcgcgtctggattgaggaaaacccctggatggaggacaaaacacatgtgtctagctgggaggaagttccctatctgggcaagcgggaggatcagtggtgcgggtcccttatcggactgaccgcgagagccacctgggctacaaatattcaggtggccatcaaccaggtccgcagactcattggcaatgaaaactacctggactacatgaccagcatgaagcggtttaaaaatgagtctgatcctgagggggccctgtggtga

SEQ ID NO: 18743 - RNA, 9879 nt, synthetic construct
  misc_feature 1..9879: note = derived and/or modified CDS sequence (opt5) from DENV-1__FJ390380__SS-prME
  source 1..9879: mol_type = other RNA
agcgtgaccatgctgctgatgctgcttcccaccgctctggctttccaccttacgaccagaggcggggagcctcatatgatcgtgtccaagcaggaacggggaaagtctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatttacggaggccctatcagccaacataactatcgccccgggtacttcacacagaccgcgggaccttggcacctgggcaaacttgagctggactttgaactctgcgaggggacaaccgtggtcgtggatgaacactgcggaaatcggggcccctccctgagaacgaccacagttaccggcaagattatccatgagtggtgttgccggagctgtacactgcctccccttcgcttcagaggggaggacggatgctggtacggcatggaaatccggccggtgaaagagaaggaagagaacctcgtcagatctatggtgtccgctgggagcggagaagttgactccttttctctgggcattctgtgtgtgagcatcatgattgaggaggtcatgcgctcccggtggtctagaaagatgctcatgaccgggacgctggtggttttctttcttctgatcatgggacagctcacatggaatgatctgattcgcctgtgcatcatggtgggcgccaacgccagcgacagaatgggcatggggaccacatatcttgctctgatggccaccttcaaaatgcggcctatgtttgcggtcggactcctgttccgcagactcacctcccgggaagtgctgcttctgacaattggcctctctctggtggctagcgtcgagctgcccaattcccttgaagaactgggggatggactcgccatgggcatcatgatgctgaagctcctgacggaatttcaaccccaccagctttggaccacactgctcagcctgaccttcatcaaaacaaccctgtctcttgactacgcctggcgcacgatggctatggttctgtccattgtgagcctctttcctctgtgtctctctacaacctcccagaagaccacatggctgccggtgcttctggggagcttcggatgcaaacccctgaccatgtttctcatcacagagaacaagatttggggcagaaagtcttggcctctgaacgagggcatcatggccattgggatcgtctccatccttctgagctccctcctgaaaaatgatgtgcccctcgctggacctctgattgccggcgggatgcttatcgcgtgttatgttattagcggatctagcgccgacctgtccctggaaaaggctgccgaggtgtcttgggaagaggaagctgagcatagcggcacgtcccacaacatcctcgtcgaggtgcaggatgacgggaccatgaaaattaaggatgaggaacgggacgatacactgaccatccttctgaaagccacactcctggccgtttctggagtgtaccccatgagcatccctgctaccttcttcgtctggtatttttggcaaaagaaaaagcagcgctccggcgtgctctgggacacgccctctccgcctgaagtcgagagagcggtgctggatgacggcatttaccggatccttcagcgcgggctgctgggaagaagccaggttggcgtgggggtcttccaagacggagtgtttcataccatgtggcacgttacacggggcgccgtgctcatgtatcaggggaagagactggagccctcctgggctagcgtcaaaaaggatcttatttcttacggaggcggctggcgcttccaggggtcctggaataccggagaagaggtccaggtgatcgccgttgaacctggcaaaaaccccaagaatgtccaaacaaccccggggacatttaaaacgcctgagggagaagtgggcgccattgctctggacttcaagcccgggaccagcggatctcctatcgtgaaccgggagggcaagattgtcggcctctacgggaatggagtggttacaacctccggcacctatgtgagcgccatcgcgcaggctaaaacatcccaggaggggcccctgcccgaaatcgaggaagaggtctttaagaaaagaaacctcacgattatggatctgcaccctggatctggcaagacccgccggtaccttccggccatcgtgagagaagccattaaacgcaagctgcggacactgatcctcgctcccaccagagttgtggccagcgagatggcggaggctctgaaggggatgcctattcgctatcaaacaaccgccgtcaaatccgaacatacgggccgggagatcgtggaccttatgtgccacgccacattcaccatgagactgctcagccccgttcgggtgcctaattacaacatgatcattatggatgaagctcattttaccgaccccgcctctatcgctgcccgcggatatatttccacaagagtcggcatgggggaggcggccgctatcttcatgaccgccacacctccgggaagcgtggaggcttttccccagtctaatgccgtgattcaggatgaggagcgggacatccctgaacgcagctggaactccggctacgattggatcaccgacttccccgggaagacggtctggttcgttccttctattaaaagcggaaatgatatcgccaactgtctgagaaagaatggcaaacgggtgattcagctgtccagaaagacatttgacaccgagtatcaaaagacacgcaacaacgactgggattacgtggtcaccacggacatctctgaaatgggggctaatttccgggcggatagagtgattgacccccgccggtgcctcaaaccggttatccttaaggatggccctgagagagtgattctggccggacccatgcccgtcaccgtggctagcgccgcccagcgccggggcagaatcgggcgcaaccagaataaagagggagaccagtacgtttatatgggccaacctctgaacaatgatgaagaccacgctcattggacagaggccaagatgctcctggataacatcaatacccccgaagggattatccctgcgctttttgagccggaaagagagaaatccgctgccattgacggagagtaccggctgcgcggcgaagccagaaagacattcgtggagctcatgcggcgcggggatctgcccgtctggctgagctataaggtggcttctgaaggctttcagtactccgacagacggtggtgcttcgatggagagagaaacaatcaggtcctcgaagagaacatggacgtggagatctggaccaaagaaggcgagcgcaagaaacttcggcctagatggctggacgcccgcacatatagcgatcccctggcgctccgggaatttaaggagttcgccgctgggagacggtccgtttctggagacctgattcttgaaatcggcaaactgcctcagcacctcaccctgcgcgcccaaaatgctctggataacctcgtgatgcttcacaatagcgagcaagggggaaaggcctacagacatgctatggaggaactgcccgacacgatcgagacactgatgctcctggcccttattgcggtgctgaccggcggcgtcaccctctttttcctgtccgggaaaggactgggcaagacatctatcgggctcctttgtgttatggccagctccgctctgctgtggatggccaacgtggaaccgcactggattgctgccagcatcattctcgagtttttcctgatggtgcttctgatccctgagcccgatcggcagcgcacccctcaggacaatcaactcgcctatgtcgtgatcggactgctgtttatgattctcacagttgctgcgaacgaaatgggccttctggagacgaccaagaaagatctggggatcggacatgtggccgctgaaaaccagcaccacgccacaatgctcgacgtcgatctgagacccgcctctgcttggaccctttacgccgtggcgacaaccgtcattacgcctatgatgcggcataccatcgagaatacaaccgccaacatttccctgacagctatcgccaatcaggctgccattctcatgggcctggacaagggctggcccatcagcaaaatggatatcggggtgccgctgctcgcgcttggatgctactctcaagttaaccctctgaccctgacggccgctgtgctcatgctggtcgcccactatgctattatcggccccgggcttcaggccaaggctacacgcgaagcccagaaaagaaccgcggccggaattatgaagaatcccacagtggacggcatcgttgctattgatctggaccctgtggtctacgacgccaagttcgagaaacagctcgggcaaatcatgctgctgatcctctgtacctcccagattcttctgatgcggaccacatgggctctgtgcgagagcatcacgctcgccaccggaccgctgacaaccctttgggaaggctctcccggcaagttctggaacacaaccattgccgtgagcatggcgaatatctttcgcgggtcctatctggctggagccggcctcgctttctctctgatgaaaagcctcgggggaggcagacgggggacgggagcccagggcgagacactcggcgaaaagtggaaaagacagcttaaccaactgtccaagagcgagtttaatacctacaagcgctccgggattatggaagtggatcggtctgaggccaaagagggactgaagagaggcgaaaccacaaaacatgctgttagccgcgggaccgccaagctccggtggttcgtcgagagaaacctggtgaaacctgaaggaaaggtgatcgaccttggctgtgggcgcggaggctggtcctattactgcgcgggcctgaagaaagtcacagaggttaaggggtatacgaaaggaggccccgggcacgaggaacctatccccatggccacctacggatggaatctcgtgaagctgtactctggcaaagatgtgtttttcacacctccggagaagtgtgacaccctgctctgcgatattggggaaagctcccccaaccctacaatcgaggaaggacggacccttagagtcctgaaaatggtggagccctggctgcgcggcaatcagttttgtattaagatcctcaacccttatatgccctctgttgtggagacgctggaacagatgcagcggaagcatggcgggatgcttgtcagaaatccgctgagccgcaactccacccacgagatgtactgggtgagctgcggaacaggcaatattgtttctgctgtgaacatgacctcccggatgctcctgaacagattcacaatgacccaccgcaaacctacatatgaaagagacgtcgatctgggggccggaacccggcatgtggctgtggagcccgaagtcgccaatctcgacatcattggccaacgcatcgagaacatcaagaatgagcacaaaagcacgtggcattacgatgaagacaacccctataagacatgggcgtaccacgggtcttatgaggttaaaccttccggaagcgcctcttccatggtgaatggcgtggtcagactgcttaccaagccctgggatgtgattcctatggttacccagatcgctatgacagacacgaccccgtttggccagcaacgggtgttcaaggaaaaagtcgacacaagaacaccccgggccaagcgcgggacagctcagattatggaggtgaccgccaaatggctgtggggatttctcagcagaaacaagaaacctcggatctgtacacgcgaagagttcaccagaaaggttcggtccaatgctgccattggcgcggtgtttgtcgatgagaaccagtggaatagcgccaaggaagctgtggaggacgaacgcttctgggatctggttcacagagagcgggaacttcataaacaggggaagtgcgccacgtgcgtgtacaacatgatgggaaaacgcgagaagaaactgggcgagttcgggaaggctaagggctctagagccatctggtacatgtggctcggagcccggtttctggagttcgaggcgctgggctttatgaatgaagaccactggttcagccgcgagaactccttttctggggtcgagggagaaggcctccataaactggggtatatccttagagatattagcaagatccccggaggcaatatgtacgctgacgataccgccgggtgggacacacggattaccgaggatgacctgcaaaacgaagccaaaatcacagatattatggagcctgaacacgctctcctggccacctccatcttcaaacttacgtatcagaataaagtggtccgcgtgcagagacccgctaagaacggcacagttatggacgtgatctctcggagagatcagcgcggaagcggccaagtcgggacctacggactgaacacatttaccaatatggaggtgcagctcattcggcagatggagtccgaaggcatcttcctgccgtctgagctggaaacgcctaacctcgccgagagagtgctgaattggcttgaaaaacatgggaccgagcgcctgaagcggatggcgattagcggagacgactgtgttgtgaagcccgtcgatgacagatttgccacagctctcatcgccctgaacgatatgggcaaagtgcgcaaggacattcctcagtgggagccctccaaagggtggaatgattggcaacaggttcctttctgcagccaccactttcatcagcttatcatgaaggacggccgggaaatcgtggtcccctgtagaaaccaggatgagctggtgggacgcgctcgggtctctcaaggcgccgggtggtccctcagagaaaccgcgtgcctgggaaaaagctatgcccagatgtggcagctgatgtacttccaccgccgggacctcagactggctgccaatgctatttgttctgccgtgccggttgattgggtgcctacatcccggaccacatggagcatccatgctcaccaccaatggatgaccacggaggacatgctttccgtctggaacagagtgtggattgaagagaatccctggatggaggataagacacatgtttctagctgggaagaggtgccctatctgggcaagcgcgaagaccagtggtgcgggtccctcatcggactgaccgcccgggcgacctgggccacaaacattcaggtcgctatcaatcaggtgagacgccttattggcaacgagaattacctggactacatgaccagcatgaaaagatttaagaacgagtctgatcctgaaggggccctctggtga

SEQ ID NO: 18744 - RNA, 9879 nt, synthetic construct
  misc_feature 1..9879: note = derived and/or modified CDS sequence (opt5) from DENV-1__FJ205874__SS-prME
  source 1..9879: mol_type = other RNA
agcgtgaccatgctgctcatgctgcttcccacagtcctggccttccacctcacgaccagaggcggggagcctcatatgatcgttggaaagcaggaacggggcaaatccctgctttttaagacatctgctggggtgaacatgtgcaccctgattgccatggacctcggagagctgtgtgaagatacaatgacctacaaatgcccgcgcatcacagaggcggaacccgacgatgtggactgttggtgcaatgctaccgatacgtgggtcacctatggcacatgtagccaaaccggggagcacagacgggacaagcgctccgtggccctggcccctcatgttggactcggcctggagacaagaaccgaaacgtggatgtctagcgagggcgcttggaaacagattcagaaggtggaaacatgggcccttcggcaccccgggttcaccgtcatcgcttttttcctggcccatgcgattggaacatccatcacccagaagggcatcatttttatcctcctgatgcttgtgaccccttctatggccatgcgctgcgttgggattggaaacagagatttcgtggagggcctgagcggggctacatgggtcgacgtggtgctcgagcacggatcctgtgtcacgaccatggccaaaaataagcccacactggatatcgaactgctcaaaaccgaggttacaaaccctgctgtgctgcggaagctttgcattgaagccaaaatcagcaataccacgacagactctcgctgtccgacccaaggcgaggcgaccctggtggaagagcaggatgccaactttgtctgcagacggacattcgtggaccgcggctgggggaatggatgtggcctctttgggaagggatccctgcttacctgcgctaagttcaaatgcgttacaaagctggagggcaaaattgtgcagtacgaaaacctcaagtatagcgtcatcgtgacggttcacaccggggatcagcatcaagtgggaaatgagacaaccgaacacggcacaatcgccaccattacgccccaggctcctacctctgagatccagctgacagactacggcgccctgaccctcgactgttcccccagaacagggctggattttaacgaaatggtccttctgaccatgaaagagaagagctggctcgtgcataaacagtggttcctggaccttcctctgccctggacgtctggagcctccacaagccaagagacctggaatcggcaggatctcctggtcacatttaagaccgctcacgcgaagaaacaggaagtggttgtgctgggctcccaagagggggccatgcacaccgctctcacaggagccacggaaattcagacctctggcacaaccacaatcttcgccgggcatctgaagtgccgccttaaaatggacaagctgaccctcaaaggcatgagctatgtcatgtgtacgggatccttcaagctggagaaggaagtggctgagacacagcacggcaccgttctggtgcaggtcaaatacgaggggaccgatgccccgtgcaagattcctcttagcacacaagacgaaaaaggagtgacccagaacggcagactcatcacagcgaatcccatcgtgacggataaggagaaacctgttaacattgaaaccgagcccccctttggggagtcttatatcattgtcggagctggcgaaaaggccctgaagctgtcctggttcaaaaaggggagctctatcggcaaaatgtttgaggccacagctcggggagccagacgcatggctattctcggcgacaccgcctgggatttcgggagcatcggaggcgtgtttacatccgtggggaagctggtccatcaggtgttcggaaccgcgtacggcgttcttttttctggggtgagctggacgatgaaaatcggcattggaatcctgctcacctggctgggcctgaattcccggagcgcctctctttccatgacatgtattgctgtcgggatggtgaccctctacctgggagttatggtgcaggccgacagcggctgcgtcatcaactggaaggggagagaactgaagtgtggatctggcattttcgtgacaaacgaggttcacacctggacagaacaatataaatttcaggctgattcccctaagcgcctcagcgccgcgatcgggaaagcctgggaggagggcgtgtgcggagtccggtccgctaccagactggaaaatattatgtggaagcagatctctaacgagcttaatcatatcctgctcgaaaacgacatgaaattcacggtggtggtcggcgacgccaatgggattctggctcagggaaagaaaatgatccgcccgcaacccatggagcacaagtacagctggaagtcctggggcaaagccaagattatcggggccgatattcagaacacaacctttatcatcgacggacctgatacccccgaatgtcctgacgatcagcgggcttggaatatttgggaggttgaggactatggcttcggcatctttacaaccaacatttggctgaaacttagagattcttacacgcagatgtgcgaccaccgcctcatgagcgcggccatcaaggattccaaagctgtgcatgccgacatggggtattggattgaaagcgagaagaatgaaacatggcggctggccagagcttctttcatcgaggtgaagacctgtatctggcccaaatcccacacactgtggagcaacggagtcctcgaatctgagatgattatcccgaagatttacggcgggcctatctcccaacataattatcgccccggatacttcacccagacagccggcccttggcacctggggaaacttgagctggattttgacctctgcgaaggaaccacggtggttgtggatgagcactgcggcaaccggggccccagcctgagaaccacaaccgtcacagggaagattatccatgaatggtgttgccggtcttgtaccctgcctccccttcgcttcagaggagaggacggctgctggtacgggatggagatccggccggtgaaagaaaaggaggaaaatctcgttagaagcatggtgtccgcgggaagcggcgaggtcgactctttttccctggggattctgtgtctcagcatcatgattgaagaggtgatgcgctcccggtggtctagaaagatgctgatgacgggaacacttgctgttttcctgctcctgatcatgggccagctgacctggaacgatcttattcgcctgtgcatcatggtgggcgccaatgccagcgacagaatggggatgggaacaacctatctcgctctgatggccacctttaaaatgcggcctatgttcgcggtcggcctcctgtttcgcagacttacatcccgggaggtgctgctcctgacgattgggctgtctcttgtggctagcgtcgaactgcccaactccctcgaggaactgggagatggcctcgccatggggatcatgatgctgaagcttctgaccgagttccaaccccaccagctctggacaaccctgctgtctcttacatttatcaaaaccacgctgagcctcgactacgcctggaagacaatggctatggttctgtccattgtgagcctcttccctctgtgtctttctaccacctcccagaaaacaacctggctgccggtgctgctcggaagctttggctgcaagcccctgacaatgttccttatcacggaaaacaagatttggggccgcaaatcttggcctctgaatgaggggatcatggccattggaatcgtctccatcctcctgagctctctcctgaagaacgatgtgccccttgctggccctctgattgccgggggaatgctgatcgcgtgttatgttatttccggcagctccgccgacctcagcctggagaaagctgccgaagtgtcttgggaggaagaggctgaacatagcgggacctcccacaatatccttgtcgaggtgcaggatgacggaacaatgaagattaaagatgaggaaagagacgataccctgacaatcctcctgaaggccaccctcctggccgtttctggcgtgtaccccatgagcatccctgctacgctttttgtctggtatttctggcaaaaaaagaagcagcggtccggcgtgctgtgggacaccccctctccgcctgaggtcgaacgcgcggtgctggatgacgggatttacagaatcctccagcggggactgcttggccgcagccaggttggggtgggagtcttccaagacggcgtgtttcatacaatgtggcacgttaccagaggggccgtgctgatgtatcagggaaaacggctcgagccctcctgggcttctgtcaagaaagatctgattagctacggcggcgggtggagattccagggatcctggaacacaggcgaggaagtgcaggtgatcgccgttgagcctgggaagaatcccaaaaacgtccaaaccacaccgggaacgtttaagacccctgaaggcgaggtgggggccgtggctctcgacttcaagcccggaacaagcggctctcctattgtcaatcgcgaaggcaaaatcgtggggctgtacggaaacggcgttgtgaccacctccgggacatatgtcagcgccattgcgcaggctaaggcctctcaggagggaccccttcccgagatcgaagatgaggtgtttaaaaagcggaatctgacgatcatggacctgcaccctggctccgggaaaaccagacgctacctcccggccattgttcgggaagctatcaagagaaagctgcgcacacttattctggcccccacccgggtggtcgcgagcgagatggctgaagccctcaaaggcatgcctatcagatatcaaacaaccgccgtgaagtccgagcatacgggacgcgagattgttgatctgatgtgccacgctacattcaccatgcggctgctctctcccgtgagagtccctaactacaatatgatcatcatggacgaagcccattttaccgatcccgctagcattgccgcgcggggctatatctccacacgcgtggggatgggagaggccgctgccattttcatgaccgctacacctccgggcagcgtggaagcctttccccagtctaacgccgtcatccaggacgaggaaagagatattcctgagcggtcctggagctctgggtacgactggatcaccgatttccccggaaaaacggtttggtttgtgcctagcatcaagtccggcaatgacattgctaactgtcttcgcaaaaatgggaagagagtgatccagctgtctcggaagacattcgacaccgagtatcaaaaaacaaagaacaacgattgggactacgtcgtgaccacggatattagcgaaatgggcgcgaatttcagagccgaccgcgttatcgatccccggagatgcctgaaaccggtgattctcaaggacggacctgagcgcgtcatcctggctggccccatgcccgtgaccgttgcctccgccgctcagcggagagggcgcattggacggaaccagaataaagaaggcgatcagtacgtgtatatggggcaacctcttaacaatgacgaggatcacgcccattggacagaggcgaagatgctgctcgacaacatcaatacccccgaaggaatcattcctgctctgtttgagccggaaagagagaagtctgccgccatcgatggcgaataccgcctgagaggggaggctcggaaaacattcgtcgagctcatgaagcgcggcgaccttcccgtgtggctgagctataaagtcgcctccgaaggatttcagtacagcgatagacggtggtgcttcgacggcgagcgcaacaatcaggtgctggaagagaacatggacgttgaaatttggaccaaggagggggagagaaaaaagctccggcctagatggctggatgcgcgcacatattctgacccccttgccctgcgggaatttaaagagttcgctgccggaagacgctccgtgagcggcgatctcatcctggaaattgggaagctgcctcagcacctcacccttcgggctcaaaatgccctggacaacctggtgatgctccacaattccgagcagggaggcaaggcttacagacatgccatggaagagctgcccgatacgatcgagacacttatgctgctcgcgctgatcgccgtcctgaccggcggggttatgctctttttcctttctggaaaaggcctggggaagaccagcattggactgctctgtgtgatggcttcctctgccctgctttggatggctagcgtggaaccgcactggatcgccgcctccattatcctggagtttttcctcatggtcctgctgattcctgaacccgaccggcagcgcacacctcaggataaccaactcgcttatgtggttatcggccttctgtttatgatcctgaccgtggcggccaatgagatggggctcctggagacaacgaaaaaggaccttggaattggccatgtcgctgccgaaaaccaccaccatgtgaccatgctggatgtcgacctcagacccgccagcgcttggacactgtacgccgtggcgaccacagttatcacccctatgatgcggcacacgattgagaacaccacagccaatatctctctgaccgctattgccaaccaggctgccatcctcatgggccttgataaagggtggcccatttccaagatggacatcggagtgccgctgctggcgctcggctgctacagccaggtcaatcctctgacacttaccgccgctgtgctgatgctcgttgcccattatgctatcattgggcccggactgcaagccaaggctacgcgcgaagcccagaaaagaacagcggccggcatcatgaagaaccccaccgtggatgggattgtcgctatcgacctggaccctgtggtgtacgatgccaaattcgagaagcagctcggacagattatgcttctgatcctgtgtacatctcaaatcctcctgatgcggaccacctgggctctttgcgaatccattacactggccacgggcccgctcaccacactgtgggagggcagccccgggaaattttggaataccacaatcgccgtttctatggcgaacattttccgcggaagctatctggctggcgccgggctcgctttctcccttatgaagtctctgggaggcgggagacggggaaccggcgcccagggcgagacgctgggggaaaagtggaaacgccagctcaatcagctgagcaagtccgagtttaacacatacaaaagaagcggaatcatggaagtcgaccggtccgaggccaaggaaggccttaaaagaggggagaccaccaagcacgctgtgtctcgcggaacagccaagctgcggtggttcgtggagagaaatctcgtcaaacctgaaggcaaggttattgatctggggtgtggacgcggcggctggagctattactgcgcggggctgaaaaaggtgaccgaggtgaaaggatatacaaagggcgggcccggacatgaagagcctatccccatggccacgtacggctggaacctcgtcaaacttcactccgggaaggacgtgtttttcacccctccggaaaagtgtgatacactgctgtgcgacatcggagagtctagccccaatcctaccattgaggaaggccggacactcagagttctgaaaatggtggagccctggcttcgcggcaaccaattttgtatcaagattctgaatccttacatgccctccgtcgtggaaaccctcgagcagatgcagcggagacacgggggaatgctggttcgcaacccgctgtctcggaatagcacgcatgagatgtattgggtgtcctgcggcaccgggaacatcgtcagcgctgtgaatatgacatctagaatgctcctgaaccgcttcaccatggcccaccggaaacctacatacgaaagagatgtggaccttggagctggcacccgccatgtcgccgttgagcccgaagtggcgaacctggggattatcggacagagaattgagaatatcaagaacgaacacaaatccacatggcactatgatgaggacaatccctacaagacctgggcctatcatggcagctacgaggtgaagccttctggctccgctagctctatggtcaacggggtggttcggctcctgacgaaaccctgggatgtgatccctatggtcacacaaattgccatgaccgacaccacaccgtttggacagcagcgcgtgttcaaggaaaaagttgacacgagaaccccccgggctaagagaggcacagcccaaatcatggaggtgaccgctaaatggctttgggattttctgtcccggaataagaagcctcgcatttgtacaagagaagagttcatccggaaagtccgcagcaacgccgcgattggggccgtgtttgttgacgaaaatcagtggaactccgctaaggaggccgtggaggatgaaagattctgggacctcgtccaccgggagcgcgaactgcataaacagggaaagtgcgctacctgcgtgtataatatgatgggcaaaagagagaagaagctgggggaatttggcaaagccaagggaagccgggccatctggtacatgtggctcggcgcgcgcttcctggagttcgaggctcttgggtttatgaacgaagatcactggttctctagagagaatagcctgtccggagtcgaaggcgaggggctccataaactgggatacatccttcgggacatttctaagatccccggcgggaacatgtatgccgatgacacagccggctgggatacccgcattacggaggacgatctgcagaatgaagctaaaatcaccgacattatggagcctgaacacgccctcctggctacaagcatctttaagctgacctaccaaaacaaagtggttagagtgcagcggcccgccaagaatggaacagtcatggatgtgatctcccgcagagaccagcggggctctgggcaggtgggaacctatggcctcaacacgttcacaaacatggaggttcaactgattagacagatggaaagcgaggggatctttcttccgtccgagctggaaaccacaaatctcgcggagcgcgtgctggactggcttgaaaagcacggagtcgagcggctgaaaagaatggccatttctggcgatgactgtgtggttaagcctatcgatgaccgcttcgctaccgccctcattgctctgaacgatatggggaaagtgcggaaggacatcccccagtgggaacctagcaaaggctggaatgattggcagcaagtccccttttgctcccatcacttccatcagctgatcatgaaggacggaagagagattgtggtcccttgtcgcaaccaggatgagctcgtgggccgggccagagttagccagggggcgggatggtctctgcgcgaaacggcctgccttggcaagtcctacgctcaaatgtggcagctgatgtattttcaccggagagacctccgcctggccgctaatgccatctgtagcgctgtgcccgtcgattgggtgccgacctctcggacaacctggtccattcacgcccatcaccagtggatgacaaccgaggacatgcttagcgtttggaacagagtgtggatcgaagagaatccttggatggaagacaaaacacatgtctcctcttgggaggaggtgccctacctggggaagcgggaagatcaatggtgcggaagcctcattggcctgaccgcgagagccacgtgggctacaaacatccaggtggccattaatcaggttcgccggctgatcgggaacgagaattatctcgactacatgacctccatgaaaagattcaagaacgaaagcgatcccgagggcgccctgtggtga

SEQ ID NO: 18745 - RNA, 9879 nt, synthetic construct
  misc_feature 1..9879: note = derived and/or modified CDS sequence (opt5) from DENV-1__FJ205875__SS-prME
  source 1..9879: mol_type = other RNA
agcgtgaccatgctgctcatgctgcttcccacagctctggctttccacctcacgaccagaggcggggagcctcatatgatcgtctccaagcaggaacggggaaagtctctgctttttaagacaagcgccggcattaacatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttattgccctgtttctcgcgcatgccatcgggacatctatcacccagaagggaattatcttcattctgcttatgctggtgacccctagcatggctatgcgctgcgtcggcatcgggaacagagattttgtggagggactctccggcgccacatgggttgacgtggtcctggagcacgggagctgtgtgacgaccatggctaaagataagcccacactggacattgaactcctgaaaaccgaggtgacaaatcctgccatccttcggaagctgtgcattgaagcgaaaatctctaacaccacgacagattcccgctgtccgacccaaggagaggccaccctcgtcgaagaacaggacgctaatttcgtttgcagacggacatttgtggatcgcggctggggcaacgggtgtggactgttcggcaaggggagccttctgacctgcgccaagtttaaatgcgtgacaaagctcgagggaaaaatcgtccagtacgaaaatctgaagtattctgtgattgttacggtgcacaccggcgaccagcatcaagtcgggaacgagacaaccgaacacggaacaatcgctaccattacgccccaggcccctacctccgagatccagctgacagactacggcgccctcaccctggattgtagccccagaacaggccttgacttcaatgaaatggtgctgctcaccatgaaagagaagtcttggctggttcataaacagtggtttcttgatctgcctctcccctggacgtccggggctagcacatcccaagagacctggaaccggcaggacctgctggtgacattcaagaccgcgcacgccaagaaacaggaagtcgtggtcctcggatctcaagagggcgctatgcacaccgccctgacaggggccacggaaattcagaccagcggaacaaccacaatctttgctggccatcttaagtgccgcctgaaaatggataagctcaccctgaaagggatgtcctatgtgatgtgtacgggcagcttcaagctggagaaggaagttgccgagacacagcacggaaccgtgcttgtccaggtgaaatacgagggcaccgacgcgccgtgcaagatccctttctctacacaagatgaaaaaggggttacccagaatggaagactcattacagctaaccccatcgtgacggacaaggagaaacctgtcaatattgaaaccgagccgccctttggcgagtcctatatcgtggtgggggccggagaaaaggccctgaagctgagctggttcaaaaagggctctagcattgggaaaatgtttgaggctacagcccggggcgctagacgcatggccatcctcggagataccgcgtgggacttcggctccatcgggggagtttttacatctgtcggcaagctggtgcatcaggtgttcgggaccgcctacggagtcctttttagcggcgtgtcctggacgatgaaaattgggatcggcattctgctcacctggctgggactgaacagccggtctacatcccttagcatgacctgtatcgctgttggcatggtgacactctacctgggggtcatggtgcaggccgattctggatgcgttattaattggaagggcagagaactgaagtgtgggtccggaatcttcgtgaccaacgaggtccacacatggaccgaacaatataaatttcaggctgacagccctaagcgcctctccgccgcgattggcaaagcctgggaggagggggtgtgcggcatccggtctgctacgagactggaaaacatcatgtggaagcagattagcaatgagcttaaccatatcctgctcgaaaatgacatgaaattcacagttgtggtcggagatgccaacggcattctggctcaggggaagaaaatgatccgcccgcaacccatggagcacaagtactcctggaagtcttggggaaaagccaagattatcggcgccgacatccagaataccacctttattatcgatgggcctgacacacccgaatgtcctgatgaccagcgggcttggaacatttgggaggtggaggattatggattcggcatctttaccacgaatatttggctgaaacttagagacagctacacacagatgtgcgatcaccgcctcatgtccgcggccatcaaggacagcaaagctgtgcatgccgatatgggctattggatcgaatctgagaagaacgaaacctggaagctggcccgggcttccttcattgaggtcaaaacatgtatctggcccaagagccacaccctgtggtctaatggggttctcgaatccgagatgattatcccgaaaatttacggaggccctatcagccaacataactatagacccgggtacttcacacagaccgccggaccttggcacctgggcaaacttgagctggactttgatctctgcgaagggacgaccgtggtggtcgacgagcactgcggaaatcgcggcccctctctgcggacaaccacagtgaccggcaaaatcattcatgaatggtgttgcagaagctgtacgctgcctccccttcggttccgcggggaggacggatgctggtacggcatggagatcagaccggttaaggaaaaggaggaaaacctcgtgcggtccatggtcagcgcggggtctggagaggtggattcctttagcctgggcattctgtgtgtttccatcatgattgaagaggtgatgagatctcgctggagcaaaaagatgctcatgacagggaccctggctgtcttccttctgctcatcatgggacagctgacatggaatgacctgattcggctttgcatcatggtgggcgccaacgcctccgatagaatgggcatggggaccacctatctggctctcatggccacatttaaaatgcgccctatgttcgcggttggactgctctttagacggctgacgtctcgcgaggtgcttctgctcaccatcggcctgagcctggtcgcttccgtggaacttcccaattctctggaggaactcggggacggactggccatgggcattatgatgctcaagctgcttacagagttccaaccccaccagctgtggaccacactcctgagcctgacctttatcaaaacgacactttccctggattacgcctggagaaccatggctatggtgctcagcattgtctctctgttccctctctgtctgtccaccacaagccagaagaccacatggcttccggttctgctggggtcttttggatgcaagcccctcacgatgttcctgatcaccgaaaacaaaatttggggccggaagtcctggcctcttaacgagggcatcatggccatcgggattgtgagcatcctgctctcttccctgctcaaaaatgacgtgcccctggctggacctcttattgccggcgggatgctgatcgcgtgttatgtcattagcggatccagcgccgatctgtctctcgagaaggctgccgaagtgagctgggaggaagaggctgaacattccggcacatctcacaacatcctggttgaggtgcaggacgatgggaccatgaaaatcaaggacgaggaacgcgatgacacacttaccattctgctcaaagccacgctgctcgccgtcagcggagtgtaccccatgtccatccctgctaccctgtttgtttggtatttctggcaaaagaagaaacagagatctggcgtgctttgggatacacccagcccgcctgaggtcgaacgggcggtgctggacgacggcatttaccgcatcctgcagagagggctcctgggacggtcccaggtcggcgtgggggttttccaagatggagtgtttcataccatgtggcacgtcacacgcggcgccgtgcttatgtatcaggggaagagactggagccctcttgggctagcgttaaaaaggacctcatttcctacggaggcggctggcggttccaggggagctggtctaccggagaggaagtgcaggtcatcgccgtggagcctggcaaaaatcccaagaacgtgcaaacaacgccggggacctttaagacacctgaaggagaggttggcgccattgctctggatttcaaacccgggacctccggaagccctatcgtcaatagagaaggcaagatcgtgggcctctacgggaacggagtggtcaccacatctggcacgtatgtgtccgccattgcgcaggctaaaaccagccaggaggggcccctgcccgagatcgaagacgaggtttttaagaaacgcaatcttacaattatggatctgcaccctggatccggcaagacccggagatacctgccggccatcgtgcgcgaagccattaagcggaaactcagaacactgatccttgctcccacccgcgtcgtggcctctgagatggcggaagctctgaaggggatgcctatccggtatcaaacgacagccgttaaaagcgagcataccggcagagagattgtggacctcatgtgccacgccaccttcacaatgcgcctgctgtcccccgtccgggtgcctaactacaatatgatcattatggatgaagctcattttaccgaccccgccagcatcgctgccagaggatatatttctacacgggttggcatgggggaggcggccgctatcttcatgaccgccacgcctccgggatccgtggaggcttttccccagagcaacgccgtcatccaggatgaggaacgcgacattcctgagagatcttggaatagcggctacgattggatcacagacttccccgggaagaccgtgtggtttgtgccttccattaaatctggaaacgacatcgccaattgtctccggaagaacggcaagcgcgtcattcagcttagcagaaaaacattcgataccgagtatcaaaagacgaaaaataacgactgggattacgttgtgaccacagacatctccgaaatgggggctaacttccgggcggatagagtgattgacccccgccggtgcctgaagccggtcatcctgaaagatggccctgagagagtgatcctcgccggacccatgcccgttaccgtggcttctgccgcccagcgccggggcagaattgggcgcaatcagaacaaggaaggagaccagtacgtctatatgggccaacctctgaataacgatgaggaccacgctcattggacagaggccaagatgcttctggataatatcaacacccccgaagggattatccctgcgctctttgagccggaacgggagaaaagcgctgccattgacggagaatacagactgcgcggcgaggccagaaagacattcgtggagctgatgcggcgcggggatctccccgtttggctttcctataaagtggctagcgaaggctttcagtactctgacagacggtggtgcttcgacggagagcgcaataaccaggtcctggaagagaatatggatgtggaaatctggaccaaggagggcgagcgcaagaagctgcggcctagatggctcgacgcccgcacgtattccgatcccctggcgcttcgggaatttaaagagttcgccgctgggagacgcagcgtctccggagacctgatcctcgaaattggcaagctgcctcagcacctgacactccgggcccaaaacgctcttgataatctggtgatgctgcacaactctgagcaagggggaaaggcctacagacatgctatggaagaactccccgacaccatcgagaccctgatgcttctggccctcattgcggttctgacaggcggcgtgaccctgtttttcctcagcgggaaaggacttggcaagacatccatcgggctgctgtgtgtgatggcctctagcgctctcctgtggatggccaatgtcgaaccgcactggattgctgcctccatcatccttgagtttttcctgatggttctcctgattcctgaacccgatcggcagcgcacgcctcaggacaaccaactggcctatgtggtgatcggactcctttttatgattctgaccgtcgctgcgaatgagatgggcctgctcgagacaaccaaaaaggatctggggatcggacatgtggccgctgaaaaccaccaccatgccacaatgcttgacgttgatctgagacccgccagcgcttggaccctctacgccgtggcgacgaccgtcattacacctatgatgcggcacaccatcgagaacacaaccgccaatatttctctgacggctatcgccaaccaggctgccatcctgatgggcctcgacaaaggctggcccatttccaagatggatatcggggtgccgcttctggcgctgggatgctacagccaggtcaatcctctcacactgaccgccgctgtgcttatgctggttgcccattatgctattatcggccccgggctccaagccaaggctacacgcgaagcccagaaaagaaccgcggccggaattatgaagaaccccaccgtggacggcatcgtcgctatcgacctggatcctgtggtttacgacgccaaattcgagaagcagctggggcagattatgctccttatcctgtgtacatctcaaattctgctcatgcggacgacctgggctctgtgcgaatccatcacacttgccaccggaccgctgacaaccctctgggagggcagccccggcaaattttggaatacgacaattgccgtgtctatggcgaacatcttccgcgggagctatctggctggagccggcctggctttctccctcatgaagtctcttgggggaggcagacgggggaccggagcccagggcgagaccctgggcgaaaagtggaaacgccagctgaatcagctcagcaagtccgagtttaacacatacaaaagaagcgggatcatggaagtcgatcggtccgaggccaaggaaggactgaaaagaggcgagaccacaaagcacgctgtgtctcgcgggacggccaaacttcggtggctggtggagagaaatctcgttaaacctgaaggaaaggtcattgacctgggctgtgggcgcggaggctggagctattactgcgcgggcctgaaaaaggtgaccgaggtgaaagggtatacaaagggaggccccgggcatgaggaacctatccccatggccacctacggatggaacctcgtcaaactttactccggcaaggatgttttctttacacctccggaaaagtgtgacaccctgctgtgcgatattggggagtctagccccaatcctacgatcgaggaaggacggaccctcagagtgctgaaaatggtggagccctggcttcgcggcaaccaattctgtattaagatcctgaatccttatatgccctccgtcgtggaaacactcgagcagatgcagcggaaacacggcgggatgctggttagaaacccgctgtctcgcaatagcacccacgagatgtactgggtgtcctgcggaacaggcaacattgtcagcgctgtgaatatgacctctcggatgctcctgaacagatttacaatggttcatcgcaagcctacctatgaacgggacgtggatcttggggccggaacgagacacgtcgctgtggagcccgaagtggccaacctggacatcatcggccagcgcattgagaatatcaaaaacgaacataagtccacatggcactacgatgaggacaatccctataagacctgggcgtaccacgggagctatgaggtcaaaccttctggatccgccagctctatggttaacggcgtggtgagactcctgaccaagccctgggacgtcattcctatggtgacacaaatcgctatgacggataccacaccgttcggccagcagcgggtttttaaagaaaaggtggacacccgcacacccagagccaaacgggggaccgctcaaattatggaggtcacagccaagtggctttggggattcctgtccagaaataagaaacctcggatctgtacccgcgaagagtttacgagaaaggtgcggagcaacgctgccatcggcgcggttttcgtggatgaaaatcagtggaactccgccaaagaggctgtcgaggacgaacgcttttgggatctcgtgcatagagagcgggaactgcacaagcaggggaaatgcgctacctgcgtttacaatatgatgggaaagcgcgagaagaaactgggcgagttcgggaaggccaaaggcagcagagccatttggtacatgtggctcggagcccggtttctggagttcgaggcgcttggcttcatgaacgaagaccattggttttctcgcgagaatagcttctccggggtggaaggagatggcctgcacaagctcgggtatatcctgagagacatttctaaaatccccggaggcaacatgtacgctgatgacacagccgggtgggatacccggattacagaggacgatcttcagaatgaggccaagatcaccgacatcatggaacctgagcatgctctgctcgccacgagcatttttaaactgacatatcaaaacaaggtcgtgcgcgtccagagacccgctaagaatggcaccgtgatggacgttatctcccggcgcgatcagagaggatctggccaggtggggacatacggactgaacaccttcacgaacatggaagcccaactcattcggcagatggagagcgaaggcatctttctgccgtccgagcttgagacccctaatctggcggaaagagtcctcgactggctggagaaacacgggacagaacgccttaagcggatggccatttctggagatgactgtgtggtgaaacccgttgatgacagattcgctaccgccctgacagctctcaacgatatgggcaaggtgcgcaaagacatccctcagtgggagcccagcaaggggtggaatgattggcagcaagtccctttttgctcccaccatttccaccagctgatcatgaaggacggccgggaaattgtggttccctgtagaaaccaggatgagctggtgggacgcgcccgggtcagccagggcgcggggtggtctctcagagagaccgcctgcctgggaaaatcctatgctcaaatgtggcagcttatgtactttcatcgccgggacctgagactcgccgctaatgccatctgtagcgctgtgccggtcgactgggtgcctacatctcgcaccacgtggtccattcacgcccaccatcagtggatgacaaccgaagatatgctgagcgtttggaaccgggtgtggatcgaggaaaatccctggatggaggacaagacccacgtctcctcttgggaagaggtgccctatcttggcaaaagagaggatcaatggtgcgggagcctgattggactcacagcgcgggccacctgggctacaaacatccaggttgccattaatcaggtgagacgcctgatcggcaacgaaaattacctggactacatgacgtccatgaagcggttcaaaaacgagagcgatcctgaaggggccctctggtga

SEQ ID NO: 18746 - RNA, 9879 nt, synthetic construct
  misc_feature 1..9879: note = derived and/or modified CDS sequence (opt5) from DENV-1__FJ410173__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcattaacatgtgcaccctgatcgcgatggacctcggggagctgtgtgaagatacaatgacctacaaatgcccgcgcattacagaggctgaacccgacgatgttgactgttggtgcaatgccaccgatacgtgggtgacctatggaacatgttcccaaaccggcgagcacagacgggacaagcgctctgtggccctggctcctcatgtcgggctcggactggagacaagaaccgaaacgtggatgagctccgagggcgcctggaaacagatccagaaggtggaaacatgggctcttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccaaggagaggccacactcgttgaagagcaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattaccccccaggctcctacaaccgagatccagctgacagactacggcgccctcaccctggattgtagccccagaacgggccttgacttcaatgaaatggttctgctcacaatgaaagagaagtcttggctggtgcataaacagtggtttcttgatctgcctctcccctggacctccggggccagcacatcccaagagacctggaaccggcaggacctgctggtcaccttcaagacagctcacgcgaagaaacaggaagtggtcgtgctcggatctcaagagggcgccatgcacacggctctgaccggggccacagaaattcagaccagcggaacaaccacgatctttgccggccatcttaagtgccgcctgaaaatggataagctcacactgaaagggatgtcctatgttatgtgtaccggcagcttcaagctggagaaggaagtggctgagacccagcacggaacagtccttgtgcaggttaaatacgagggcaccgacgccccgtgcaagattcctttctctgcgcaagatgaaaaaggggtgacacagaatggaagactcatcacggctaaccccatcgtcaccgacaaggagaaacctgtgaatattgaaacagagcccccctttggcgagtcctatatcgtggttggggccggagaaaaggccctgaagctgagctggttcaaaaagggctctagcattgggaaaatgtttgaggctaccgcccggggcgctagacgcatggccatcctcggagatacagcgtgggacttcggctccattgggggagtctttacctctgtgggcaagctggtgcatcaggtcttcggggccgcttacggagtgctttttagcggcgtttcctggacgatgaaaatcgggatcggcattctgctcacctggctgggactgaacagccggtctacatcccttagcatgacctgtatcgccgtgggcatggtcacactctacctgggggtgatggttcaggctgattctggatgcgtgattaattggaagggcagagaactgaagtgtgggtccggaatcttcgtcaccaacgaggtgcacacatggaccgaacaatataaatttcaggccgacagccctaagcgcctctccgcggccattggcaaagcttgggaggagggggtttgcggcatccggtctgccacgagactggaaaacattatgtggaagcagatcagcaatgagcttaaccatatcctgctcgaaaatgacatgaaattcacagtggtcgtgggagatgctaacggcattctggcccaggggaagaaaatgatccgcccgcaacccatggagcaccggtactcctggaagtcttggggaaaggccaaaattatcggcgctgacattcagaatagcacctttatcatcgatgggcctgacacccccgaatgtcctgatgaccagagagcgtggaacatttgggaggtggaggattatggattcggcatctttacaaccaatatttggctgaagcttcgcgactcctacacgcagatgtgcgatcaccggctcatgagcgccgctatcaaagactctaaggccgtccatgccgatatgggctattggattgaatccgagaaaaacgaaacatggaagctggctagagccagcttcatcgaggttaagacctgtatctggcccaaatctcacacactgtggtccaatggggtgctcgaaagcgagatgattatcccgaagatttacggaggccctatctctcaacataactatcgccccgggtacttcacccagacagcgggaccttggcacctgggcaaacttgagctggactttgatctctgcgaagggaccacggtggtcgtggacgagcactgcggaaatcggggccccagcctgagaaccacaaccgttacaggcaagattatccatgaatggtgttgccggtcctgtaccctgcctccccttcgcttcagaggggaggacggatgctggtacggcatggagatccggccggtgaaagaaaaggaggaaaacctcgtcagaagcatggtgtctgctgggtccggagaggttgatagcttttccctgggcattctgtgtgtgtctatcatgattgaagaggtcatgcgcagccggtggtccagaaagatgctcatgacggggacactggccgtgttccttctgctcatcatgggacagctgacctggaatgacctgattcgcctttgcatcatggttggcgccaacgcttctgatagaatgggcatggggacaacctatctggccctcatggcgacctttaaaatgcggcctatgttcgctgtgggactgctctttcgcagactgacaagccgggaggtccttctgctcacgattggcctgtccctggtggcctctgtggaacttcccaatagcctggaggaactcggggacggactggccatgggcatcatgatgctcaagctgcttaccgagttccaaccccaccagctgtggacaaccctcctgtccctgacatttatcaaaaccacgcttagcctggattacgcttggcgcacaatggccatggtcctctctattgtttccctgttccctctctgtctgagcaccacctctcagaagacaacctggcttccggtgctgctggggtcctttggatgcaaacccctcacaatgttcctgatcacggaaaacaagatttggggcagaaagagctggcctcttaacgagggcatcatggctattgggatcgtgtctatcctgctctccagcctgctcaaaaatgacgtccccctggccggacctcttattgcgggcgggatgctgatcgcctgttatgtgatttccggaagctctgctgatctgagcctcgagaaggccgctgaagtttcctgggaggaagaggccgaacattctggcaccagccacaacatcctggtggaggtccaggacgatgggacaatgaaaattaaggacgaggaacgggatgacacccttacaatcctgctcaaagccaccctgctcgctgtgtccggagtttaccccatgtctatccctgcgacgtttttcgtgtggtatttctggcaaaagaaaaagcagcgcagcggcgtcctgtgggataccccctccccgcctgaggtggaaagagccgtccttgacgacggcatttaccggatcctgcagcgcgggctgctcggaagatctcaggtgggcgttggggtgtttcaagatggagtcttccatacaatgtggcacgtgacccggggcgctgttctgatgtatcaggggaagagacttgagcccagctgggcctccgtgaaaaaggacctgattagctacggaggcggctggcgctttcaggggtcttggaatacaggagaggaagtccaggtgatcgccgtggagcctggcaaaaaccccaagaatgttcaaaccacaccggggacgttcaaaacccctgaaggagaggtcggcgctattgccctcgattttaagcccgggacatccggaagccctatcgtgaaccgggaaggcaagattgtgggcctgtacgggaatggagtcgtgaccacctctggcacatatgtttccgcgatcgctcaggccaaaacgagccaggaggggcccctccccgagatcgaagaggaagtgttcaagaaaagaaacctgaccattatggaccttcaccctggatccggcaagacacgccggtacctgccggccatcgtcagagaggctattaaacgcaagctgcggaccctcatcctggcccccacaagagtggttgcgtctgaaatggctgaggcccttaaggggatgcctattcgctatcaaaccacggccgtgaaaagcgagcatacaggccgggaaatcgtcgatctgatgtgccacgctacctttaccatgagactcctgtcccccgtgcgggttcctaattacaacatgatcattatggacgaggcccatttcacagatcccgctagcatcgccgcgcgcggatatatttctaccagagtgggcatgggggaagccgctgccatctttatgacagctacccctccgggatccgtcgaggccttcccccagagcaatgccgtgattcaggacgaagagcgggatatccctgagcgctcttggaacagcggctacgactggatcacggattttcccgggaagacagtgtggttcgtcccttccattaaatctggaaatgacatcgctaactgtctgagaaagaatggcaaacgggttattcagctcagcagaaagaccttcgacacagaatatcaaaagacccgcaacaacgattgggactacgtggtgacgaccgatatctccgagatgggggcgaattttcgggccgacagagtcattgatccccgccggtgccttaaaccggtgatcctgaaggacggccctgaaagagttattctggctggacccatgcccgtgacagtcgcctctgccgctcagcgccggggcagaatcgggcgcaaccagaataaagagggagatcagtacgtgtatatgggccaacctctcaacaatgacgaggatcacgcccattggaccgaagcgaagatgctgcttgacaacatcaatacacccgaggggattatccctgctctgttcgaaccggagagagaaaaaagcgccgccattgatggagagtaccggctccgcggcgaggctagaaagacctttgttgaactgatgcggcgcggggacctgcccgtgtggctctcctataaggtcgccagcgagggcttccagtactctgatagacggtggtgctttgacggagaaagaaacaatcaggtgcttgaggaaaacatggacgtcgagatctggacaaaagagggcgaacgcaagaaactgcggcctagatggctggatgcgcgcacctattccgaccccctcgccctgcgggagttcaaggaatttgctgccgggagacggagcgtgtccggagatcttattctggagatcggcaaactccctcagcacctgacgctgcgcgctcaaaatgccctcgacaaccttgttatgctgcacaattctgaacaggggggaaaggcttacagacatgccatggaggagctgcccgatacaatcgaaaccctcatgctgcttgcgctgattgccgtgctcaccggcggcgtgacactgttctttctgagcgggaaaggactcggcaagacctccatcgggcttctgtgtgtcatggcttctagcgccctgctctggatggctaacgttgagccgcactggattgccgcctccatcattctggaattctttcttatggtgctgctcatccctgagcccgaccggcagcgcacacctcaggataatcaactggcttatgtggtcatcggactgctcttcatgattcttacggtggcggccaacgagatgggcctgctggaaaccacaaagaaagacctcgggatcggacatgttgctgccgagaaccagcaccacgccaccatgctggatgtggaccttagacccgctagcgcctggacactgtacgcggtcgccaccacggtgattacccctatgatgcggcatacaatcgaaaataccacagctaacatttctctcaccgccatcgctaatcaggccgcgattctgatgggcctggataagggctggcccatctccaaaatggacatcggggtcccgctccttgccctgggatgctacagccaagtgaaccctctgacgctcacagctgccgttctgatgcttgtggctcactatgccattatcggccccgggctgcaggctaaggccacccgcgaggcgcagaaaagaacagccgctggaattatgaagaatcccaccgtcgatggcatcgtggccattgacctcgaccctgttgtgtacgatgctaagtttgaaaaacagctggggcaaatcatgctgctcatcctttgtacctctcagattctgctgatgcggacaacgtgggccctctgcgagtccatcaccctggccacaggaccgcttaccacactgtgggagggcagccccggcaagttctggaacaccacgattgcggtctctatggctaatatcttccgcgggagctatctcgccggagctggcctggccttttccctgatgaaatctctcgggggaggcagacgggggacaggagcccagggcgaaacccttggcgagaagtggaaaagacagctgaaccaactgagcaagtccgaattcaatacctacaagcgcagcgggattatggaggtggaccggtccgaagctaaagagggactcaagagaggcgagacaaccaaacatgccgtgtctcgcgggacagcgaagctgcggtggtttgttgaaagaaaccttgtcaaacctgagggaaaggtgatcgatctgggctgtgggcgcggaggctggagctattactgcgccggcctcaagaaagtgacggaagtcaaggggtataccaaaggaggccccgggcacgaggaacctatccccatggctacatacggatggaatctggttaagctgtactccggcaaagacgtgttctttacccctccggagaagtgtgatacactcctttgcgacattggggagtctagccccaaccctaccatcgaagagggacggacgctgagagtgctgaaaatggtcgaaccctggctccgcggcaatcagttctgtattaagatcctgaacccttatatgccctccgtggttgagacccttgagcagatgcagcggaagcatggcgggatgctggtgagaaatccgctctctcgcaacagcacacacgaaatgtactgggtctcctgcggaaccggcaatattgtgagcgccgttaacatgacatctcggatgctgctgaacagatttaccatgacacaccgcaaacctacctatgagagagatgtggacctcggggctggaacgcggcatgtcgccgtggaacccgaggtggcgaatctggatatcattggccaacgcatcgaaaacatcaagaatgagcacaaatccacatggcattacgacgaggataacccctataagacctgggcctaccacgggagctatgaagtcaaaccttctggatccgctagctctatggttaatggcgtggtgagacttctgaccaagccctgggacgtcattcctatggtgacacagatcgccatgacggacaccacaccgttcggccagcaacgggtttttaaggagaaagtggataccagaacaccccgggctaagcgcgggaccgcccagattatggaagtcacagctaaatggctctggggattcctgtccagaaacaagaaacctcggatctgtacccgcgaggaatttacgagaaaggtgcggagcaatgccgcgattggcgccgttttcgtggacgagaaccagtggaattccgctaaggaggccgtcgaagatgagcgcttttgggaccttgtgcacagagaacgggagctgcataaacaggggaagtgcgctacctgcgtttacaacatgatgggaaaacgcgaaaagaaactcggcgagttcgggaaggccaagggcagcagagccatctggtacatgtggctgggagcgcggttcctggagtttgaagctctcggcttcatgaatgaggatcactggttttctcgcgaaaacagcttctccggggtggagggagagggcctgcataaacttgggtatatcctgagagacatttctaagatccccggaggcaatatgtacgccgatgacacagccgggtgggatacccggattacagaagacgatctccaaaacgaggctaaaatcaccgacattatggaacctgagcacgccctgcttgctacgagcatctttaagctgacatatcagaataaagtcgtgcgcgtccagagacccgccaagaacggcaccgtgatggatgttatctcccggagagaccagcgcggatctggccaagtggggacatacggactcaacaccttcacgaatatggaagtccagctgattcggcagatggagagcgagggcatctttctgccgtccgaactcgagacccctaacctggcggaaagagtgcttaattggctggagaaacatgggacagaacgcctcaagcggatggccatttctggagacgattgtgtggttaagcccgtggacgatagattcgctaccgccctgatcgctcttaacgacatgggcaaagtccgcaaggatattcctcagtgggagcccagcaaagggtggaatgactggcaacaggtgcctttttgctcccaccacttccatcagctgatcatgaaggatggccgggagatcgttgtgccctgtagaaaccaggacgaactcgtcggacgcgcccgggtgagccaaggcgcggggtggtctctgagagagacagcctgcctgggaaaatcctatgctcagatgtggcagctcatgtactttcaccgccgggatctgagacttgccgctaatgccatttgtagcgctgtcccggtggactgggttcctacctctcggacaacctggtccatccatgcccaccaccaatggatgacgacagaagatatgctgagcgtgtggaacagagtctggattgaggaaaatccctggatggaggacaagacccatgtgtcctcttgggaggaagttccctatctcggcaagcgcgaggaccagtggtgcgggagcctgatcggacttaccgcgcgggccacatgggctaccaacattcaggtggccatcaatcaggtcagacgcctgattggcaacgaaaattacctcgattacatgacatccatgaaaagattcaagaacgagagcgaccctgagggggccctgtggtga

SEQ ID NO: 18747 - RNA, 9879 nt, synthetic construct
  misc_feature 1..9879: note = derived and/or modified CDS sequence (opt5) from DENV-1__FJ410174__SS-prME
  source 1..9879: mol_type = other RNA
agcgtgaccatgctgcttatgctgcttcccacagctctggctttccacctcacgacccggggcggggaacctcatatgatcgtctccaagcaggaacggggaaaatctctgctttttaagacaagcgccggcattaacatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatcgctaaagataagcccaccctggacattgaactcctgaaaacagaggtgaccaatcctgccgtccttcggaagctgtgcatcgaagcgaaaatttctaacacgacaaccgattcccgctgtccgacccaaggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaatcgtgcagtacgaaaatctgaagtattccgttatcgtgaccgtccacacaggcgaccagcatcaagtggggaacgagaccacagaacacggaaccattgccacgatcacaccccaggctcctacaagcgagattcagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaatccagacatccggaaccacaaccatttttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagatccctttctccgcgcaagatgaaaaaggggtgacccagaatggaagactcatcacagctaaccccattgtcacggacaaggagaaacctgtgaatatcgaaaccgagccgccctttggcgagagctatattgtggttggggccggagaaaaggccctgaagctgtcttggttcaaaaagggcagctccatcgggaaaatgtttgaggctacagcccggggcgctagacgcatggccattctcggagataccgcgtgggacttcggctctatcgggggagtctttacaagcgtgggcaagctggtgcatcaggtcttcggggccgcttacggagtgctcttttccggcgttagctggaccatgaaaatcgggattggcatcctgctcacgtggctgggactgaactctcggtccaccagcctttctatgacatgtattgccgtgggcatggtcaccctctacctgggggtgatggttcaggctgattccggatgcgtgatcaattggaagggcagagaactgaagtgtgggagcggaattttcgtcacaaacgaggtgcacacctggacagaacaatataaatttcaggccgactcccctaagcgcctctctgcggccatcggcaaggcttgggaggagggggtttgcggcattcggagcgccaccagactggaaaacatcatgtggaagcagatctccaatgagcttaaccatattctgctcgaaaatgacatgaaattcacggtggtcgtgggagatgctaacggcatcctggcccaggggaagaaaatgattcgcccgcaacccatggagcaccggtactcttggaaaagctggggaaaggccaaaatcattggcgctgacatccagaatacaacctttatcattgatgggcctgacacccccgaatgtcctgatgaccagagagcgtggaacatctgggaggtggaggattatggattcggcatttttacaaccaatatctggctgaaacttcgcgactcctacacgcagatgtgcgatcaccggctcatgagcgccgctattaaagactctaaggccgtccatgccgatatgggctattggatcgaatccgagaaaaacgaaacatggaagctggctagagccagcttcatcgaggttaagacctgtatttggcccaaatctcacacactgtggtccaatggggtgctcgaaagcgagatgatcattccgaagatctacggaggccctatttctcaacataactatcgccccgggtacttcacccagacagcgggaccttggcacctgggcaaacttgagctggactttgatctctgcgaagggaccacggtggtcgtggacgagcactgcggaaatcggggccccagcctgagaaccacaaccgttacaggcaagatcatccatgaatggtgttgccggtcctgtaccctgcctccccttcgcttcagaggggaggacggatgctggtacggcatggagattcggccggtgaaagaaaaggaggaaaacctcgtcagaagcatggtgtctgctgggtccggagaggttgatagcttttccctgggcatcctgtgtgtgtctattatgatcgaagaggtcatgcgcagccggtggtccagaaagatgctcatgacggggacactggccgtgttccttctgctcattatgggacagctgacctggaatgacctgatccgcctttgcattatggttggcgccaacgcttctgatagaatgggcatggggatcacatatctggccctcatggcgacctttaaaatgcggcctatgttcgctgtgggactgctctttcgcagactgaccagccgggaggtccttctgctcacaatcggcctgtccctggtggcctctgtggaacttcccaatagcctggaggaactcggggacggactggccatgggcattatgatgctcaagctgcttacggagttccaaccccaccagctgtggaccacactcctgtccctgacctttatcaaaacaacccttagcctggattacgcttggcgcacgatggccatggtcctctctattgtttccctgttccctctctgtctgagcacaacctctcagaagaccacatggcttccggtgctgctggggtcctttggatgcaaacccctcaccatgttcctgatcacagaaaacaagatttggggcagaaagagctggcctcttaacgagggcatcatggctatcgggattgtgtctatcctgctctccagcctgctcaaaaatgacgtccccctggccggacctcttattgcgggcgggatgctgatcgcctgttatgtgatttccggaagctctgctgatctgagcctcgagaaggccgctgaagtttcctgggaggaagaggccgaacattctggcacgagccacaacatcctggtggaggtccaggacgatgggaccatgaaaatcaaggacgaggaacgggatgacacacttaccattctgctcaaagccacactgctcgctgtgtccggagtttaccccatgtctatccctgcgaccctgtttgtgtggtatttctggcaaaagaaaaagcagcgcagcggcgtcctttgggatacgccctccccgcctgaggtggaaagagccgtcctggacgacggcatttaccggatcctgcagcgcgggctcctgggaagatctcaggtgggcgttggggtgttccaagatggagtctttcataccatgtggcacgtgacacggggcgctgttcttatgtatcaggggaagagactggagcccagctgggcctccgtgaaaaaggacctcattagctacggaggcggctggcgcttccaggggtcttggaataccggagaggaagtccaggtgatcgccgtggagcctggcaaaaaccccaagaatgttcaaacaaccccggggacatttaaaacgcctgaaggagaggtcggcgctattgccctggatttcaagcccgggacctccggaagccctatcgtgaaccgggaaggcaagatcgtgggcctctacgggaatggagtcgtgacaacctctggcacctatgtttccgcgattgctcaggccaaaacaagccaggaggggcccctgcccgagatcgaagaggaagtgtttaagaaaagaaaccttacgattatggacctgcaccctggatccggcaagacccgccggtacctgccggccatcgtcagagaggctattaaacgcaagctccggacactgatccttgcccccaccagagtggttgcgtctgaaatggctgaggccctgaaggggatgcctatccgctatcaaacaaccgccgtgaaaagcgagcatacgggccgggaaattgtcgatctcatgtgccacgctacattcaccatgagactgctgtcccccgtgcgggttcctaattacaacatgatcattatggacgaggcccattttaccgatcccgctagcatcgccgcgcgcggatatatttctacaagagtgggcatgggggaagccgctgccatcttcatgaccgctacacctccgggatccgtcgaggcctttccccagagcaatgccgtgatccaggacgaagaacgggatattcctgagcgctcttggaacagcggctacgactggatcaccgatttccccgggaagacggtgtggtttgtcccttccattaaatctggaaatgacatcgctaactgtctcagaaagaatggcaaacgggttattcagcttagcagaaagacattcgacaccgaatatcaaaagaccaagaataacgattgggactacgtggtgaccacggatatctccgagatgggggcgaatttccgcgccgaccgggtcattgatcccagacgctgcctgaagccggtgatcctgaaagacggccctgaacgggttatcctcgctggacccatgcccgtgaccgtcgcctctgccgctcagagacgcggccggattgggagaaaccagaataaggagggagatcagtacgtgtatatgggccaacctctgaacaatgacgaggatcacgcccattggacagaagcgaaaatgcttctggacaacatcaatacccccgaggggattatccctgctctctttgaaccggagcgcgaaaagagcgccgccattgatggagagtacagactgcggggcgaggctcgcaagacattcgttgaactgatgagaagaggggacctccccgtgtggctttcctataaagtcgccagcgagggctttcagtactctgatcgcagatggtgcttcgacggagaacggaacaatcaggtgctggaggaaaacatggacgtcgagatctggaccaaggagggcgaacgcaagaaactgcgccctcggtggctcgatgcgagaacatattccgaccccctggcccttcgcgagtttaaagagttcgctgccgggcggagaagcgtgtccggagatctgatcctcgagattggcaagctgcctcagcacctgaccctccgggctcaaaatgcccttgacaacctggttatgctgcacaattctgaacaagggggaaaggcttaccgccatgccatggaggagctccccgatacgatcgaaacactgatgcttctggcgctcattgccgtgctgaccggcggcgtgaccctgtttttcctcagcgggaagggacttggcaagacatccatcgggctgctgtgtgtcatggcttctagcgccctcctgtggatggctaacgttgagccgcactggattgccgcctccatcatccttgaatttttcctgatggtgctcctgattcctgagcccgacagacagcggacccctcaggataatcaactggcttatgtggtcatcggactcctttttatgattctgacagtggcggccaacgagatgggcctgctcgaaacgaccaaaaaggacctggggatcggacatgttgctgccgagaaccagcaccacgccacaatgcttgatgtggacctgcgccccgctagcgcctggaccctctacgcggtcgccacaaccgtgattacgcctatgatgagacataccatcgaaaatacaaccgctaacatttctctgacagccatcgctaatcaggccgcgatcctgatgggcctcgataaaggctggcccatttccaagatggacatcggggtcccgcttctggccctgggatgctacagccaagtgaaccctctcaccctgacggctgccgttcttatgctggtggctcactatgccattatcggccccgggctccaggctaaagccacacgggaggcgcagaagcgcaccgccgctggaattatgaagaatcccacagtcgatggcatcgtggccatcgacctggaccctgttgtgtacgatgctaaattcgaaaagcagctggggcaaattatgctccttatcctgtgtacctctcagattctgctcatgagaaccacatgggccctgtgcgagtccatcacgcttgccaccggaccgctgacaaccctctgggagggcagccccggcaaattttggaacacaaccattgcggtctctatggctaatatcttccgggggagctatctggccggagctgccctggccttctccctcatgaagtctcttggcgggggacgcagaggcacgggggctcagggagaaacactgggcgagaaatggaagcggcagctgaaccaactcagcaagtccgaatttaatacctacaaaagaagcggcatcatggaggtggaccgctccgaagccaaggaggggctgaaacggggagagaccacaaagcatgcggtgtctagaggcaccgccaaacttcgctggttcgttgaacggaacctggtcaagcctgaggggaaggtgattgatctcggatgtggcagagggggatggagctattactgcgctggcctgaaaaaggtgacagaagtcaaaggctatacgaaagggggacccggccacgaggaacctatccccatggccacctacgggtggaatctggttaaactctactccggaaaggacgtgtttttcacacctccggagaaatgtgatacccttctgtgcgacattggcgagtctagccccaaccctacaatcgaagaggggcgcaccctgcgggtgctcaagatggtcgaaccctggctgagaggaaatcagttttgtattaagatccttaacccttatatgccctccgtggttgagacgctggagcagatgcagcgcaaacatggcggcatgctcgtgcggaatccgctgtctagaaacagcacccacgaaatgtactgggtctcctgcgggacaggaaatattgtgagcgctgttaacatgacctctcgcatgctgctcaaccggttcacaatgacccacagaaagcctacatatgagcgcgatgtggacctgggcgccgggaccagacatgtcgcggtggaacccgaggtggccaatcttgatatcatcggacaacggattgaaaacatcaaaaatgagcacaagtccacgtggcattacgacgaggataacccctataaaacatgggcttaccacggcagctatgaagtcaagccttctgggtccgccagctctatggttaatggagtggtgcgcctgctcaccaagccctgggacgtcattcctatggtgacccagatcgctatgacagacacgaccccgtttggccagcaaagagttttcaaagagaaggtggatacacggacccccagagccaaacggggcacagctcagattatggaagtcaccgccaagtggctgtgggggtttctttcccgcaacaaaaagcctagaatctgtacacgggaggagttcacccgcaaggtgagaagcaatgcggccatcggagctgtttttgtggacgagaaccagtggaactccgccaaagaggctgtcgaagatgagcggttctgggacctggtgcaccgcgaaagagagctccataagcagggcaaatgcgccacgtgcgtttacaacatgatggggaagcgggagaaaaagctgggagagtttggcaaggccaaagggagccgcgcgatttggtacatgtggctgggcgctagattcctcgagttcgaagccctgggatttatgaatgaggatcactggttctctcgggaaaacagcttttccggcgtggagggggagggacttcataagctgggctatatcctccgcgacatttctaaaatccccgggggaaatatgtacgccgatgacaccgctggctgggatacaagaattaccgaagacgatctgcaaaacgaggccaagatcacagacatcatggaagctgagcacgcccttctggcgaccagcattttcaaactcacgtatcagaataaggtcgtgcgggtccagcgccctgccaaaaacgggacagtgatggatgttatctccagacgggaccagagaggctctggacaagtgggcacctacgggctgaacacatttaccaatatggaagtccagctgattcgccagatggagagcgagggaatcttcctcccctccgaactggagacgccgaaccttgctgaacgggtgctggactggctcgagaagcatggcaccgaaagactgaagcgcatggccatttctggggatgactgtgtggttaaacctgtggatgaccggtttgctacagcccttatcgcgctgaatgatatgggaaaggtcagaaaagacatcccccagtgggagcctagcaagggctggaacgattggcaacaggtgcccttctgctcccaccactttcatcagctcattatgaaagacgggcgcgagatcgttgtgccttgtcggaatcaggatgaactggtcggcagagcccgcgtgagccaaggagctggctggtctctgcgggagaccgcctgcctcgggaagtcctatgctcagatgtggcagctgatgtacttccacagacgcgaccttcggctggccgctaacgccatttgtagcgcggtccccgtggattgggttccgacatctagaaccacatggtccatccatgcccaccaccaatggatgaccacggaagacatgctcagcgtgtggaatcgggtctggattgaggaaaacccttggatggaggacaagacacatgtgtcctcttgggaggaagttccctatctgggaaaaagagaggatcagtggtgcggcagccttatcgggctgaccgctcgcgccacctgggccacaaatattcaggtggctatcaaccaggtccggagactcatcggaaatgaaaactacctggactacatgacctccatgaagcgctttaaaaatgagagcgatcccgagggcgccctgtggtga

SEQ ID NO: 18748 - RNA, 9879 nt, synthetic construct
  misc_feature 1..9879: note = derived and/or modified CDS sequence (opt5) from DENV-1__FJ410175__SS-prME
  source 1..9879: mol_type = other RNA
agcgtgaccatgctgcttatgctgcttcccacagctctggctttccacctcacgacccggggcggggaacctcatatgatcgtctccaagcaggaacggggaaaatctctgctttttaagacaagcgccggcattaatatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccaaggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaaaattatcggcgctgacattcagaatacaacctttatcatcgatgggcctgacacccccgaatgtcctgatgaccagagagcgtggaacatttgggaggtggaggattatggattcggcatctttacaaccaatatttggctgaaacttcgcgactcctacacgcagatgtgcgatcaccggctcatgagcgccgctatcaaagactctaaggccgtccatgccgatatgggctattggattgaatccgagaaaaacgaaacatggaagctggctagagccagcttcatcgaggttaagacctgtatctggcccaaatctcacacactgtggtccaatggggtgctcgaaagcgagatgattatcccgaagatttacggaggccctatctctcaacataactatcgccccgggtacttcacccagacagcgggaccttggcacctgggcaaacttgagctggactttgatctctgcgaagggaccacggtggtcgtggacgagcactgcggaaatcggggccccagcctgagaaccacaaccgttacaggcaagattatccatgaatggtgttgccggtcctgtaccctgcctccccttcgcttcagaggggaggacggatgctggtacggcatggagatccggccggtgaaagaaaaggaggaaaacctcgtcagaagcatggtgtctgctgggtccggagaggttgatagcttttccctgggcattctgtgtgtgtctatcatgattgaagaggtcatgcgcagccggtggtccagaaagatgctcatgacggggacactggccgtgttccttctgctcatcatgggacagctgacctggaatgacctgattcgcctttgcatcatggttggcgccaacgcttctgatagaatgggcatggggacaacctatctggccctcatggcgacctttaaaatgcggcctatgttcgctgtgggactgctctttcgcagactgacaagccgggaggtccttctgctcacgattggcctgtccctggtggcctctgtggaacttcccaatagcctggaggaactcggggacggactggccatgggcatcatgatgctcaagctgcttaccgagttccaaccccaccagctgtggacaaccctcctgtccctgacatttatcaaaaccacgcttagcctggattacgcttggcgcacaatggccatggtcctctctattgtttccctgttccctctctgtctgagcaccacctctcagaagacaacctggcttccggtgctgctggggtcctttggatgcaaacccctcacaatgttcctgatcacggaaaacaagatttggggcagaaagagctggcctcttaacgagggcatcatggctattgggatcgtgtctatcctgctctccagcctgctcaaaaatgacgtccccctggccggacctcttattgcgggcgggatgctgatcgcctgttatgtgatttccggaagctctgctgatctgagcctcgagaaggccgctgaagtttcctgggaggaagaggccgaacattctggcaccagccacaacatcctggtggaggtccaggacgatgggacaatgaaaattaaggacgaggaacgggatgacacccttacaatcctgctcaaagccaccctgctcgctgtgtccggagtttaccccatgtctatccctgcgacgctgtttgtgtggtatttctggcaaaagaaaaagcagcgcagcggcgtcctttgggataccccctccccgcctgaggtggaaagagccgtcctggacgacggcatttaccggatcctgcagcgcgggctcctgggaagatctcaggtgggcgttggggtgttccaagatggagtctttcatacaatgtggcacgtgacccggggcgctgttcttatgtatcaggggaagagactggagcccagctgggcctccgtgaaaaaggacctcattagctacggaggcggctggcgcttccaggggtcttggaatacaggagaggaagtccaggtgatcgccgtggagcctggcaaaaaccccaagaatgttcaaaccacaccggggacgtttaaaacccctgaaggagaggtcggcgctattgccctggatttcaagcccgggacatccggaagccctatcgtgaaccgggaaggcaagattgtgggcctctacgggaatggagtcgtgaccacctctggcacatatgtttccgcgatcgctcaggccaaaacgagccaggaggggcccctgcccgagatcgaagaggaagtgtttaagaaaagaaaccttaccattatggacctgcaccctggatccggcaagacacgccggtacctgccggccatcgtcagagaggctattaaacgcaagctccggaccctgatccttgcccccacaagagtggttgcgtctgaaatggctgaggccctgaaggggatgcctattcgctatcaaaccacggccgtgaaaagcgagcatacaggccgggaaatcgtcgatctcatgtgccacgctaccttcaccatgagactgctgtcccccgtgcgggttcctaattacaacatgatcattatggacgaggcccattttacagatcccgctagcatcgccgcgcgcggatatatttctaccagagtgggcatgggggaagccgctgccatcttcatgacagctacccctccgggatccgtcgaggcctttccccagagcaatgccgtgattcaggacgaagaacgggatatccctgagcgctcttggaacagcggctacgactggatcacggatttccccgggaagacagtgtggtttgtcccttccattaaatctggaaatgacatcgctaactgtctcagaaagaatggcaaacgggttattcagcttagcagaaagaccttcgacacagaatatcaaaagaccaaaaacaacgattgggactacgtggtgacgaccgatatctccgagatgggggcgaatttccgcgccgaccgggtcattgatcccagacgctgcctgaagccggtgatcctgaaagacggccctgaacgggttattctcgctggacccatgcccgtgacagtcgcctctgccgctcagagacgcggccggatcgggagaaaccagaataaggagggagatcagtacgtgtatatgggccaacctctgaacaatgacgaggatcacgcccattggaccgaagcgaaaatgcttctggacaacatcaatacacccgaggggattatccctgctctctttgaaccggagcgcgaaaagagcgccgccattgatggagagtacagactgcggggcgaggctcgcaagaccttcgttgaactgatgagaagaggggacctccccgtgtggctttcctataaagtcgccagcgagggctttcagtactctgatcgcagatggtgcttcgacggagaacggaacaatcaggtgctggaggaaaacatggacgtcgagatctggacaaaggagggcgaacgcaagaaactgcgccctcggtggctcgatgcgagaacctattccgaccccctggcccttcgcgagtttaaagagttcgctgccgggcggagaagcgtgtccggagatctgattctcgagatcggcaagctgcctcagcacctgacgctccgggctcaaaatgcccttgacaacctggttatgctgcacaattctgaacaagggggaaaggcttaccgccatgccatggaggagctccccgatacaatcgaaaccctgatgcttctggcgctcattgccgtgctgaccggcggcgtgacactgtttttcctcagcgggaagggacttggcaagacctccatcgggctgctgtgtgtcatggcttctagcgccctcctgtggatggctaacgttgagccgcactggattgccgcctccatcattcttgaatttttcctgatggtgctcctgatccctgagcccgacagacagcggacacctcaggataatcaactggcttatgtggtcatcggactcctttttatgattctgacggtggcggccaacgagatgggcctgctcgaaaccaccaaaaaggacctggggatcggacatgttgctgccgagaaccagcaccacgccaccatgcttgatgtggacctgcgccccgctagcgcctggacactctacgcggtcgccaccacggtgattacccctatgatgagacatacaatcgaaaataccacagctaacatttctctgaccgccatcgctaatcaggccgcgattctgatgggcctcgataaaggctggcccatctccaagatggacatcggggtcccgcttctggccctgggatgctacagccaagtgaaccctctcacgctgacagctgccgttcttatgctggtggctcactatgccattatcggccccgggctccaggctaaagccacccgggaggcgcagaagcgcacagccgctggaattatgaagaatcccaccgtcgatggcatcgtggccattgacctggaccctgttgtgtacgatgctaaattcgaaaagcagctggggcaaatcatgctccttatcctgtgtacctctcagattctgctcatgagaacaacgtgggccctgtgcgagtccatcacccttgccacaggaccgctgaccacactctgggagggcagccccggcaaattttggaacaccacgattgcggtctctatggctaatatcttccgggggagctatctggccggagctggcctggccttctccctcatgaagtctcttgggggaggccgcagagggacaggagcccagggcgaaaccctgggcgagaaatggaagcggcagctgaaccaactcagcaagtccgaatttaatacctacaaaagaagcgggattatggaggtggaccgctccgaagctaaggagggactgaaacggggcgagacaaccaagcatgccgtgtctagagggacagcgaaacttcgctggttcgttgaacggaacctggtcaagcctgagggaaaggtgatcgatctcggctgtgggagaggaggctggagctattactgcgccggcctgaaaaaggtgacggaagtcaaagggtataccaagggaggccccgggcacgaggaacctatccccatggctacatacggatggaatctggttaaactctactccggcaaggacgtgtttttcacccctccggagaaatgtgatacacttctgtgcgacattggggagtctagccccaaccctaccatcgaagagggacgcacgctgcgggtgctcaagatggtcgaaccctggctgagaggcaatcagttttgtattaagatccttaacccttatatgccctccgtggttgagaccctggagcagatgcagcgcaaacatggcgggatgctcgtgcggaatccgctgtctagaaacagcacacacgaaatgtactgggtctcctgcggaaccggcaatattgtgagcgccgttaacatgacatctcgcatgctgctcaaccggttcaccatgacacacagaaagcctacctatgagcgcgatgtggacctgggggctggaacgagacatgtcgccgtggaacccgaggtggcgaatcttgatatcattggccaacggatcgaaaacatcaaaaatgagcacaagtccacatggcattacgacgaggataacccctataaaacctgggcctaccacgggagctatgaagtcaagccttctggatccgctagctctatggttaatggcgtggtgcgcctgctcaccaagccctgggacgtcattcctatggtgacacagatcgccatgacggacaccacaccgtttggccagcaaagagttttcaaagagaaggtggatacccggacacccagagctaaacgggggaccgcccagattatggaagtcacagctaagtggctgtggggatttctttcccgcaacaaaaagcctagaatctgtacccgggaggagttcacgcgcaaggtgagaagcaatgccgcgattggcgccgtttttgtggacgagaaccagtggaactccgctaaagaggccgtcgaagatgagcggttctgggacctggtgcaccgcgaaagagagctccataagcaggggaaatgcgctacctgcgtttacaacatgatgggaaagcgggagaaaaagctgggcgagtttgggaaggccaaaggcagccgcgccatctggtacatgtggctgggagcgagattcctcgagttcgaagctctgggctttatgaatgaggatcactggttctctcgggaaaacagcttttccggggtggagggagagggccttcataagctggggtatatcctccgcgacatttctaaaatccccggaggcaatatgtacgccgatgacacagccgggtgggataccagaattacagaagacgatctgcaaaacgaggctcggatcaccgacattatggaacctgagcacgcccttctggctacgagcatcttcaagctcacatatcagaataaagtcgtgcgcgtccagagacccgccaagaacggcaccgtgatggatgttatctcccggagagaccagcgcggatctggccaagtggggacatacggactgaacacctttacgaatatggaagtccagctgattcggcagatggagagcgagggcatcttcctcccgtccgaactggagacccctaaccttgcggaaagagtgctggactggctcgagaaacatgggacagaacgcctgaagcggatggccatttctggagatgactgtgtggttaagcccgtggatgacagatttgctaccgcccttatcgctctgaatgatatgggcaaagtccgcaaggacattcctcagtgggagcccagcaaagggtggaacgattggcaacaggtgcctttctgctcccaccactttcatcagctcatcatgaaggacggccgggagatcgttgtgccctgtagaaatcaggatgaactggtcggacgcgcccgggtgagccaaggcgcggggtggtctctgagagagacagcctgcctcggaaaatcctatgctcagatgtggcagctgatgtacttccaccgccgggaccttagactggccgctaacgccatttgtagcgctgtcccggtggattgggttcctacctctcggacaacctggtccatccatgcccaccaccaatggatgacgacagaagacatgctcagcgtgtggaatagagtctggattgaggaaaacccctggatggaggacaagacccatgtgtcctcttgggaggaagttccctatctgggcaagcgcgaggatcagtggtgcgggagccttatcggactgaccgcgcgggccacatgggctaccaatattcaggtggccatcaaccaggtcagacgcctcattggcaatgaaaactacctggactacatgacatccatgaaaagatttaagaatgagagcgatcctgagggggccctgtggtga

SEQ ID NO: 18749 - RNA, 9879 nt, synthetic construct
  misc_feature 1..9879: note = derived and/or modified CDS sequence (opt5) from DENV-1__FJ562105__SS-prME
  source 1..9879: mol_type = other RNA
agcgtgaccatgctgctcatgctgcttcccacagtcctggccttccacctcacgaccagaggcggggagcctcatatgatcgttggaaagcaggaacggggcaaatccctgctttttaagacatctgctggggtgaacatgtgcaccctgattgccatggacctcggagagctgtgtgaagatacaatgacctacaaatgcccgcgcatcacagaggcggaacccgacgatgtggactgttggtgcaatgctaccgatacgtgggtcacctatggcacatgtagccaaaccggggagcacagacgggacaagcgctccgtggccctggcccctcatgttggactcggcctggagacaagaaccgaaacgtggatgtctagcgagggcgcttggaaacagattcagaaggtggaaacatgggcccttcggcaccccgggttcaccgtcatcgcttttttcctggcccatgcgattggaacatccatcacccagaagggcatcatttttatcctcctgatgcttgtgaccccttctatggccatgcgctgcgttgggattggaaacagagatttcgtggagggcctgagcggggctacatgggtcgacgtggtgctcgagcacggatcctgtgtcacgaccatggccaaaaataagcccacactggatatcgaactgctcaaaaccgaggttacaaaccctgctgtgctgcggaagctttgcattgaagccaaaatcagcaataccacgacagactctcgctgtccgacccaaggcgaggcgaccctggtggaagagcaggatgccaactttgtctgcagacggacattcgtggaccgcggctgggggaatggatgtggcctctttgggaagggatccctgcttacctgcgctaagttcaaatgcgttacaaagctggagggcaaaattgtgcagtacgaaaacctcaagtatagcgtcatcgtgacggttcacaccggggatcagcatcaagtgggaaatgagacaaccgaacacggcacaatcgccaccattacgccccaggctcctacctctgagatccagctgacagactacggcgccctgaccctcgactgttcccccagaacagggctggattttaacgaaatggtccttctgaccatgaaagagaagagctggctcgtgcataaacagtggttcctggaccttcctctgccctggacgtctggagcctccacaagccaagagacctggaatcggcaggatctcctggtcacatttaagaccgctcacgcgaagaaacaggaagtggttgtgctgggctcccaagagggggccatgcacaccgctctcacaggagccacggaaattcagacctctggcacaaccacaatcttcgccgggcatctgaagtgccgccttaaaatggacaagctgaccctcaaaggcatgagctatgtcatgtgtacgggatccttcaagctggagaaggaagtggctgagacacagcacggcaccgttctggtgcaggtcaaatacgaggggaccgatgccccgtgcaagattcctcttagcacacaagacgaaaaaggagtgacccagaacggcagactcatcacagcgaatcccatcgtgacggataaggagaaacctgttaacattgaaaccgagcccccctttggggagtcttatatcattgtcggagctggcgaaaaggccctgaagctgtcctggttcaaaaaggggagctctatcggcaaaatgtttgaggccacagctcggggagccagacgcatggctattctcggcgacaccgcctgggatttcgggagcatcggaggcgtgtttacatccgtggggaagctggtccatcaggtgttcggaaccgcgtacggcgttcttttttctggggtgagctggacgatgaaaatcggcattggaatcctgctcacctggctgggcctgaattcccggagcgcctctctttccatgacatgtattgctgtcgggatggtgaccctctacctgggagttatggtgcaggccgacagcggctgcgtcatcaactggaaggggagagaactgaagtgtggatctggcattttcgtgacaaacgaggttcacacctggacagaacaatataaatttcaggctgattcccctaagcgcctcagcgccgcgatcgggaaagcctgggaggagggcgtgtgcggagtccggtccgctaccagactggaaaatattatgtggaagcagatctctaacgagcttaatcatatcctgctcgaaaacgacatgaaattcacggtggtggtcggcgacgccaatgggattctggctcagggaaagaaaatgatccgcccgcaacccatggagcacaagtacagctggaagtcctggggcaaagccaagattatcggggccgatattcagaacacaacctttatcatcgacggacctgatacccccgaatgtcctgacgatcagcgggcttggaatatttgggaggttgaggactatggcttcggcatctttacaaccaacatttggctgaaacttagagattcttacacgcagatgtgcgaccaccgcctcatgagcgcggccatcaaggattccaaagctgtgcatgccgacatggggtattggattgaaagcgagaagaatgaaacatggaagctggcccgggcttctttcatcgaggtgaaaacctgtatctggcccaagtcccacacactgtggagcaacggagtcctcgaatctgagatgattatcccgaaaatttacggcgggcctatctcccaacataattatagacccggatacttcacccagacagccggcccttggcacctggggaagcttgagctggattttgacctctgcgaaggaaccacggtggttgtggatgagcactgcggcaaccgcggccccagcctgcggaccacaaccgtcacagggaaaattatccatgaatggtgttgcagatcttgtaccctgcctccccttcggttccgcggagaggacggctgctggtacgggatggagatcagaccggtgaaggaaaaggaggaaaatctcgttcggagcatggtgtccgcgggaagcggcgaggtcgactctttttccctggggattctgtgtctcagcatcatgattgaagaggtgatgagatcccgctggtctcggaaaatgctgatgacgggaacacttgctgttttcctgctcctgatcatgggccagctgacctggaacgatcttattagactgtgcatcatggtgggcgccaatgccagcgaccgcatggggatgggaacaacctatctcgctctgatggccacctttaagatgagacctatgttcgcggtcggcctcctgtttcggcgccttacatccagagaggtgctgctcctgacgattgggctgtctcttgtggctagcgtcgaactgcccaactccctcgaggaactgggagatggcctcgccatggggatcatgatgctgaaacttctgaccgagttccaaccccaccagctctggacaaccctgctgtctcttacatttatcaagaccacgctgagcctcgactacgcctggaaaacaatggctatggttctgtccattgtgagcctcttccctctgtgtctttctaccacctcccagaagacaacctggctgccggtgctgctcggaagctttggctgcaagcccctgacaatgttccttatcacggaaaacaaaatttggggccggaagtcttggcctctgaatgaggggatcatggccattggaatcgtctccatcctcctgagctctctcctgaaaaacgatgtgccccttgctggccctctgattgccgggggaatgctgatcgcgtgttatgttatttccggcagctccgccgacctcagcctggagaaggctgccgaagtgtcttgggaggaagaggctgaacatagcgggacctcccacaatatccttgtcgaggtgcaggatgacggaacaatgaaaattaaggatgaggaacgcgacgataccctgacaatcctcctgaaagccaccctcctggccgtttctggcgtgtaccccatgagcatccctgctacgctttttgtctggtatttctggcaaaagaagaaacagagatccggcgtgctgtgggacaccccctctccgcctgaggtcgaacgggcggtgctggatgacgggatttaccgcatcctccagagaggactgcttggccggagccaggttggggtgggagtcttccaagacggcgtgtttcatacaatgtggcacgttacccgcggggccgtgctgatgtatcagggaaagagactcgagccctcctgggcttctgtcaaaaaggatctgattagctacggcggcgggtggcggttccagggatcctggaacacaggcgaggaagtgcaggtgatcgccgttgagcctgggaaaaatcccaagaacgtccaaaccacaccgggaacgtttaagacccctgaaggcgaggtgggggccgtggctctcgacttcaaacccggaacaagcggctctcctattgtcaatagagaaggcaagatcgtggggctgtacggaaacggcgttgtgaccacctccgggacatatgtcagcgccattgcgcaggctaaagcctctcaggagggaccccttcccgagatcgaagatgaggtgtttaagaaacgcaatctgacgatcatggacctgcaccctggctccgggaagacccggagatacctcccggccattgttcgcgaagctatcaagcggaaactgagaacacttattctggcccccacccgcgtggtcgcgagcgagatggctgaagccctcaagggcatgcctatccggtatcaaacaaccgccgtgaaatccgagcatacgggaagagagattgttgatctgatgtgccacgctacattcaccatgcgcctgctctctcccgtgcgggtccctaactacaatatgatcatcatggacgaagcccattttaccgatcccgctagcattgccgcgagaggctatatctccacacgggtggggatgggagaggccgctgccattttcatgaccgctacacctccgggcagcgtggaagcctttccccagtctaacgccgtcatccaggacgaggaacgcgatattcctgagagatcctggaatagcgggtacgactggatcaccgatttccccggaaagacggtttggtttgtgccttctatcaaaagcggcaacgacattgctaattgtcttcggaagaacgggaagcgcgtgatccagctgtccagaaaaacattcgacaccgagtatcaaaagacaaaaaacaatgattgggactacgtcgtgaccacggatatttctgaaatgggcgcgaacttccgggccgacagagttatcgatccccgccggtgcctgaagccggtgattctcaaagacggacctgagagagtcatcctggctggccccatgcccgtgaccgttgccagcgccgctcagcgccgggggagaattggacgcaatcagaacaaggaaggcgatcagtacgtgtatatggggcaacctcttaataacgacgaggatcacgcccattggacagaggcgaagatgctgctcgacaatatcaacacccccgaaggaatcattcctgctctgtttgagccggaacgggagaaatccgccgccatcgatggcgaatacagactgcgcggggaggctagaaagacattcgtcgagctcatgcggcgcggcgaccttcccgtgtggctgtcttataaagtcgccagcgaaggatttcagtactccgatagacggtggtgcttcgacggcgagcgcaataaccaggtgctggaagagaatatggacgttgaaatttggaccaaggagggggagagaaaaaagctccggcctagatggctggatgcgcgcacatatagcgacccccttgccctgcgggaatttaaagagttcgctgccggaagacgctctgtgtccggcgatctcatcctggaaattgggaagctgcctcagcacctcacccttcgggctcaaaacgccctggacaatctggtgatgctccacaacagcgagcagggaggcaaggcttacagacatgccatggaagagctgcccgatacgatcgagacacttatgctgctcgcgctgatcgccgtcctgaccggcggggttatgctctttttcctttccggaaaaggcctggggaagacctctattggactgctctgtgtgatggctagctccgccctgctttggatggcttctgtggaaccgcactggatcgccgccagcattatcctggagtttttcctcatggtcctgctgattcctgaacccgaccggcagcgcacacctcaggataatcaactcgcttatgtggttatcggccttctgtttatgatcctgaccgtggcggccaacgagatggggctcctggagacaacgaaaaaggaccttggaattggccatgtcgctgccgaaaaccaccaccatgtgaccatgctggatgtcgacctcagacccgcctccgcttggacactgtacgccgtggcgaccacagttatcacccctatgatgcggcacacgattgagaataccacagccaacatcagcctgaccgctattgccaatcaggctgccatcctcatgggccttgataaagggtggcccatttctaagatggacatcggagtgccgctgctggcgctcggctgctactcccaggtcaaccctctgacacttaccgccgctgtgctgatgctcgttgcccattatgctatcattgggcccggactgcaagccaaggctacgcgcgaagcccagaaaagaacagcggccggcatcatgaagaatcccaccgtggatgggattgtcgctatcgacctggaccctgtggtgtacgatgccaaattcgagaagcagctcggacagattatgcttctgatcctgtgtacaagccaaatcctcctgatgcggaccacctgggctctttgcgaatctattacactggccacgggcccgctcaccacactgtgggagggctcccccgggaaattttggaacaccacaatcgccgttagcatggcgaatattttccgcggatcttatctggctggcgccgggctcgctttcagccttatgaagtccctgggaggcgggagacggggaaccggcgcccagggcgagacgctgggggaaaagtggaaacgccagctcaaccagctgtctaagagcgagtttaatacatacaaaagatccggaatcatggaagtcgaccggagcgaggccaaggaaggccttaaaagaggggagaccaccaagcacgctgtgtcccgcggaacagccaagctgcggtggttcgtggagagaaacctcgtcaaacctgaaggcaaggttattgatctggggtgtggacgcggcggctggtcttattactgcgcggggctgaaaaaggtgaccgaggtgaaaggatatacaaagggcgggcccggacatgaagagcctatccccatggccacgtacggctggaatctcgtcaaacttcacagcgggaaggacgtgtttttcacccctccggaaaagtgtgatacactgctgtgcgacatcggagagtcctctcccaaccctaccattgaggaaggccggacactcagagttctgaaaatggtggagccctggcttggcgggaatcaattttgtatcaagattctgaacccttacatgcccagcgtcgtggaaaccctcgagcagatgcagcgcaaacacggaggcatgctggttcggaatccgctgtccagaaactctacgcatgagatgtattgggtgagctgcgggaccggaaatatcgtctccgctgtgaacatgacaagccgcatgctcctgaaccggttcaccatggcccacagaaagcctacatacgaacgcgatgtggaccttggcgctgggacccggcatgtcgccgttgagcccgaagtggcgaatctgggaattatcggccagagaattgagaacatcaaaaatgaacacaagtctacatggcactatgatgaggacaacccctacaagacctgggcctatcatggctcctacgaggtgaaacctagcgggtctgcttccagcatggtcaatggagtggttcgcctcctgacgaagccctgggatgtgatccctatggtcacacaaattgccatgaccgacaccacaccgtttggccagcagagagtgttcaaagaaaaggttgacacgcggaccccccgcgctaaaagagggacagcccaaatcatggaggtgaccgctaagtggctttgggattttctgtctcggaacaagaaacctagaatttgtacacgggaagagttcatccgcaaggtcagatccaatgccgcgattggagccgtgtttgttgacgaaaaccagtggaatagcgctaaagaggccgtggaggatgaacggttctgggacctcgtccaccgcgagagagaactgcataagcagggcaaatgcgctacctgcgtgtataacatgatggggaagcgggagaagaaactgggcgaatttggaaaggccaaaggctcccgcgccatctggtacatgtggctcggggcgagattcctggagttcgaggctcttggatttatgaatgaagatcactggttcagccgggagaactctctgagcggcgtcgaaggggagggactccataagctgggctacatccttcgcgacatttccaaaatccccgggggcaatatgtatgccgatgacacagccggatgggataccagaattacggaggacgatctgcagaacgaagctaagatcaccgacattatggagcctgaacacgccctcctggctacatctatctttaaactgacctaccaaaataaggtggttcgggtgcagcgccccgccaagaacggcacagtcatggatgtgatcagcagacgggaccagcgcgggtccggacaggtgggcacctatgggctcaacacgttcacaaatatggaggttcaactgattagacagatggaatctgagggaatctttcttccgagcgagctggaaaccacaaacctcgcggagcgggtgctggactggcttgaaaaacacggcgtcgagagactgaagcgcatggccatttccggggatgactgtgtggttaaacctatcgatgaccggttcgctaccgccctcattgctctgaatgatatgggcaaggtgagaaaagacatcccccagtgggaaccttctaagggatggaacgattggcagcaagtccccttttgcagccatcacttccatcagctgatcatgaaggacggccgcgagattgtggtcccttgtcggaatcaggatgagctcgtggggagagcccgcgtttcccagggagcgggctggagcctgcgggaaacggcctgccttgggaaatcttacgctcaaatgtggcagctgatgtattttcacagacgcgacctccggctggccgctaacgccatctgttccgctgtgcccgtcgattgggtgccgaccagcagaacaacctggtctattcacgcccatcaccagtggatgacaaccgaggacatgctttccgtttggaatcgcgtgtggatcgaagagaacccttggatggaagacaagacacatgtcagctcctgggaggaggtgccctacctgggaaaacgggaagatcaatggtgcggctctctcattgggctgaccgcgagagccacgtgggctacaaatatccaggtggccattaaccaggttcggagactgatcggcaatgagaactatctcgactacatgaccagcatgaagcgcttcaaaaatgaatccgatcccgagggagccctgtggtga

SEQ ID NO: 18750 - RNA, 9879 nt, synthetic construct
  misc_feature 1..9879: note = derived and/or modified CDS sequence (opt5) from DENV-1__FJ562106__SS-prME
  source 1..9879: mol_type = other RNA
agcgtgacaatgctgctcatgctgcttcccacggcgctggctttccacctcacgaccagaggcggggagcctcatatgatcgtctccaagcaggaacggggaaaatctctgctttttaagacaagcgctggcgttaacatgtgcaccctgattgcgatggacctcggggagctgtgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggatgtcctatgtgatgtgtacgggcagcttcaagctggagaaggaagtcgccgagacacagcacggaaccgtgcttgttcaggtgaaatacgagggcaccgatgcgccgtgcaagattcctttctctacacaagacgaaaaaggggtcacccagaacggaagactcatcacagctaatcccatcgtgacggataaggagaaacctgtgaacattgaaaccgagccgccctttggcgagtcctatatcatggttggggccggagaaaaggccctgaagctgagctggttcaaaaagggctctagcattgggaaaatgtttgaggctacagcccggggcgctagacgcatggccatcctcggagacaccgcgtgggatttcggctccattgggggagtctttacatctgtgggcaagctggtgcatcaggtcttcgggaccgcctacggagtgctttttagcggcgtttcctggacgatgaaaatcgggatcggcattctgctcacctggctgggactgaatagccggtctgcttcccttagcatgacatgtatcgccgtgggcatggtcaccctctacctgggggtgatggttcaggctgactctggatgcgtgattaactggaagggcagagaactgaagtgtgggtccggaatcttcgtcacaaacgaggtgcacacctggacagaacaatataaatttcaggccgatagccctaagcgcctctccgcggccattggcaaggcttgggaggagggggtttgcggcatccggtctgccaccagactggaaaatattatgtggaagcagatcagcaacgagcttaatcatatcctgctcgaaaacgacatgaaattcacggtggtcgtgggagacgctaatggcattctggcccaggggaagaaaatgatccgcccgcaacccatggagcacaagtactcctggaagtcttggggaaaagccaagattatcggcgctgatattcagaacacaacctttatcatcgacgggcctgatacccccgaatgtcctgacgatcagcgggcgtggaatatttgggaggtggaggactatggattcggcatctttacaaccaacatttggctgaaacttagagatagctacacgcagatgtgcgaccaccgcctcatgtccgccgctatcaagaatagcaaagccgtccatgccgatatgggctattggattgaatctgagaagaacgaaacatggaagctggctcgggcctccttcatcgaggttaaaacctgtatctggcccaagagccacacactgtggtctaatggggtgctcgaatccgagatgattatcccgaaaatttacggaggccctatcagccaacataactatagacccgggtacttcacccagacagcgggaccttggcacctgggcaaacttgagctggactttgggctctgcgaaggaaccacggtggtcgtggatgagcactgcggcaatcgcggcccctctctgcggaccacaaccgttacagggaaaattatccatgaatggtgttgcagaagctgtaccctgcctccccttcggttccgcggagaggacggctgctggtacgggatggagatcagaccggtgaaggaaaaggaggaaaacctcgtccggtccatggtgagcgctggatctggcgaggttgattcctttagcctggggattctgtgtgtgtccatcatgattgaagaggtcatgagatctcgctggagccggaaaatgctcatgacgggaacactggccgtgttccttctgctcatcatgggccagctgacctggaatgacctgattagactttgcatcatggttggcgccaacgcttccgaccgcatggggatgggaacaacctatctggccctcatggcgacctttaagatgagacctatgttcgctgtgggcctgctctttcggcgcctgacatctagagaggtccttctgctcacgattgggctgagcctggtggcctccgtggaacttcccaactctctggaggaactcggagatggcctggccatggggatcatgatgctcaaactgcttaccgagttccaaccccaccagctgtggacaaccctcctgagcctgacatttatcaagaccacgttctcccttgactacgcttggaaaacaatggccatggtcctgagcattgtttctctctttcctctgtgtctctccaccaccagccagaagacaacctggctgccggtgcttctgggatctttcggctgcaagcccctgacaatgtttctcatcacggaaaataaaatttggggccggaagtcctggcctctgaacgaggggatcatggctattggaatcgtgagcatccttctgtcttccctcctgaaaaatgatgtccccctcgccggccctctgattgccggcgggatgcttatcgcctgttatgtgattagcgggtccagcgctgacctgtctctggagaaggccgctgaagttagctgggaggaagaggccgaacattccgggacctctcacaacatcctcgtggaggtccaggatgacggaacaatgaaaattaaggatgaggaacgcgacgataccctgacaatccttctgaaagccaccctcctggctgtgagcggcgtttaccccatgtccatccctgcgacactgttcgtgtggtatttctggcaaaagaagaaacagagatctggcgtcctgtgggacacccccagcccgcctgaggtggaacgggccgtccttgatgacgggatttaccgcatcctgcagagaggactgctcggccggtcccaggtgggggttggagtgtttcaagatggcgtcttccatacaatgtggcacgtgacccgcggggctgttctgatgtatcagggaaagagacttgagccctcttgggccagcgtgaaaaaggacctgatttcctacggcggcgggtggcggtttcagggaagctggaatacaggcgaggaagtccaggtgatcgccgtggagcctgggaaaaaccccaagaatgttcaaaccacaccgggaacgttcaagacccctgaaggcgaggtcggggctattgccctcgactttaaacccggaacatctggctcccctatcgtgaacagagaaggcaagattgtggggctgtacggaaatggcgtcgtgaccaccagcgggacatatgtttctgcgatcgctcaggccaaagcctcccaggagggacccctccccgagatcgaagatgaggtgttcaagaaacgcaacctgacgattatggaccttcaccctggcagcgggaagacccggagatacctgccggctatcgtccgcgaagccattaagcggaaactgagaacactcatcctggcgcccacccgcgtggttgcttccgagatggccgaagcccttaagggcatgcctattcggtatcaaacaaccgctgtgaaatctgagcatacgggaagagagatcgtcgatctgatgtgccacgccacatttaccatgcgcctcctgagccccgtgcgggttcctaattacaacatgatcattatggacgaagctcatttcaccgatcccgcctccatcgcggccagaggctatattagcacacgggtggggatgggagaggctgccgctatctttatgaccgccacacctccgggctctgtcgaagccttcccccagtccaatgctgtgattcaggacgaggaacgcgatatccctgagagaagctggaactctgggtacgactggatcaccgattttcccggaaagacggtgtggttcgtccctagcattaaatccggcaatgacatcgcgaactgtctgcggaagaacgggaagcgcgttattcagctctctagaaaaacattcgataccgagtatcaaaagaccaaaaataacgactgggactacgtggtgaccacggatatcagcgaaatgggcgccaattttcgggctgacagagtcattgatccccgccggtgccttaagccggtgatcctgaaagacggacctgagagagttattctggccggccccatgcccgtgaccgtcgcctccgctgcccagcgccgggggagaatcggacgcaaccagaataaggaaggcgatcagtacgtgtatatggggcaacctctcaacaatgacgaggatcacgcgcattggacagaggctaagatgctgcttgacaacatcaatacccccgaaggaattatccctgccctgttcgagccggaacgggagaaatctgccgctattgatggcgaatacagactccgcggggaggccagaaagacatttgttgagctgatgcggcgcggcgacctgcccgtgtggctcagctataaagtcgcgtccgaaggattccagtacagcgatagacggtggtgctttgacggcgagcgcaacaatcaggtgcttgaagagaacatggatgtcgaaatctggaccaaggagggggagcgcaaaaagctgcggcctagatggctggacgcccgcacatattctgaccccctcgctctgcgggagttcaaagagtttgccgctggaagacgctccgtgagcggcgatcttattctggaaatcgggaagctccctcagcacctgaccctgcgggcccaaaatgctctcgacaaccttgttatgctgcacaattccgagcagggaggcaaggcctacagacatgcgatggaagaactgcccgatacgatcgagacactcatgctgcttgccctgattgctgtgctcaccggcggggtgaccctgttctttctgtctggaaaaggcctcgggaagacaagcatcggacttctgtgtgtcatggcctcctctgctctgctctggatggccagcgttgaaccgcactggattgccgcttccatcattctggagttctttcttatggtgctgctcatccctgaacccgaccggcagcgcacccctcaggataaccaactggcgtatgtggtcatcggcctcctcttcatgattcttacagtggccgctaacgagatggggctgctggagacgaccaaaaaggacctcggaatcggccatgttgccgccgaaaatcaccaccatgctacaatgctggatgtggaccttagacccgccagcgcgtggaccctgtacgccgtcgctacaaccgtgattacgcctatgatgcggcacaccatcgagaacacaaccgccaatatttctctcacagctatcgccaaccaggcggccattctgatgggcctggataaagggtggcccatctccaagatggacatcggagtcccgctccttgctctgggctgctacagccaggtgaatcctctgaccctcacggccgctgttctgatgcttgtggcccattatgctattatcgggcccggactgcaagccaaggcgacacgcgaagcccagaaaagaaccgctgccggcattatgaagaaccccacagtcgatgggatcgtggctattgacctcgatcctgttgtgtacgacgccaaatttgagaagcagctgggacagatcatgctgctcatcctttgtacctctcaaattctgctgatgcggaccacatgggccctctgcgaatccatcacgctggcgaccggcccgcttacaaccctgtgggagggcagccccgggaaattctggaatacaaccattgctgtctctatggccaacatcttccgcggaagctatctcgctggcgccgggctggccttttccctgatgaagtctctcggaggcgggagacggggaacgggcgctcagggcgagacacttggggaaaagtggaaacgccagctgaatcagctgagcaagtccgagttcaacacctacaaaagaagcggaattatggaagtggaccggtccgaggccaaggaaggcctcaaaagaggggagaccacaaagcacgcggtgtctcgcggaaccgccaagctgcggtggtttgttgagagaaatcttgtcaaacctgaaggcaaggtgatcgatctggggtgtggacgcggcggctggagctattactgcgctgggctcaaaaaggtgacagaggtcaaaggatatacgaagggcgggcccggacatgaggaacctatccccatggccacctacggctggaacctggttaaactgcactccgggaaggacgtgttctttacacctccggaaaagtgtgataccctcctttgcgacattggagagtctagccccaatcctacaatcgaggaaggccggaccctgagagtgctgaaaatggtcgagccctggctccgcggcaaccaattctgtattaagatcctgaatccttacatgccctccgtggttgaaacgcttgagcagatgcagcggaaacacgggggaatgctggtgagaaacccgctctctcgcaatagcacccatgagatgtattgggtctcctgcggcacagggaacattgtgagcgctgttaacatgacctctcggatgctgctgaatagatttacaatggcccaccgcaagcctacctacgaacgggatgtggacctcggagcgggcacaagacatgtcgccgtggagcccgaagtggctaacctggatatcattgggcagcgcatcgagaatatcaaaaacgaacacaagtccacctggcactatgacgaggataatccctacaagacgtgggcctatcatggaagctacgaggtcaaaccttctggctccgctagctctatggttaacggcgtggtgagacttctgacaaagccctgggacgtcattcctatggtgacccaaatcgccatgaccgatacaacgccgttcgggcagcagcgggtttttaaagaaaaggtggacacccgcacacccagagctaaacggggaaccgcccaaattatggaggtcacagcgaagtggctctggggcttcctgtccagaaataagaaacctcggatctgtacccgcgaagagtttacaagaaaggtgcggagcaacgccgctattggggccgttttcgtggacgaaaatcagtggaactccgctaaagaggccgtcgaggatgaacgcttttgggaccttgtgcacagagagcgggaactgcataagcagggaaaatgcgcgacctgcgtttataatatgatgggcaagcgcgagaagaaactcggggagttcggcaaggccaaaggaagcagagctatctggtacatgtggctgggcgcccggttcctggagtttgaggccctcgggttcatgaacgaagatcactggttttctcgcgagaatagcctgtccggagtggaaggcgaggggcttcataagctgggatacatcctcagagacatttctaaaatccccggcgggaacatgtatgctgatgacacggccggctgggatacccggattacagaggacgatctgcagaatgaagctaagatcaccgacattatggagcctgaacacgcccttctggcgacaagcatcttcaaactcacctaccaaaacaaggtcgtgcgcgtccagagacccgccaagaacggaacggtgatggatgttatctcccggcgcgaccagagaggctctggacaggtgggaacatatggcctgaatacctttacaaacatggaggtccaactgattcggcagatggaaagcgaggggatcttcctcccgtgtgagctggaaacccctaatcttgctgagagagtgctggattggctcgaaaaacacggagccgagcgcctgaagcggatggctatttccggcgacgactgcgtggttaaacccatcgatgacagatttgccacggcgcttattgccctgaacgatatggggaaggtgcgcaaagacatccctcagtgggaaccctctaagggctggaatgattggcagcaagtccctttctgtagccatcactttcatcagctcatcatgaaggacggacgggagattgtggttccctgcagaaaccaggatgagctggtgggccgcgctcgggtctcccagggggccggatggagcctgagagaaaccgcttgtctcggcaaatcttacgcccaaatgtggcagctgatgtatttccaccgccgggaccttagactggctgccaatgcgatctgctccgccgtgccggtcgattgggtgcctacaagccgcaccacatggtctattcacgctcatcaccagtggatgaccacagaggacatgctctccgtttggaaccgggtgtggatcgaagagaatccctggatggaagataagacccatgtcagctcctgggaggaggtgccctacctggggaaaagagaagaccaatggtgtggatctcttattggcctgacgacacgggccacctgggccaccaacatccaggttgctattaatcaggtgagacgcctcatcgggaacgagaattatctggactacatgacaagcatgaagcggtttaaaaacgaatccgatcctgagggcgccctgtggtga

SEQ ID NO: 18751 - RNA, 9879 nt, synthetic construct
  misc_feature 1..9879: note = derived and/or modified CDS sequence (opt5) from DENV-1__FJ410179__SS-prME
  source 1..9879: mol_type = other RNA
agcgtgaccatgctgcttatgctgcttcccaccgctctggctttccacctcacgaccagaggcggggagcctcatatgatcgtctccaagcaggaacggggaaagtctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatgtacggaggccctattagccaacataactatcgccccgggtacttcacacagaccgcgggaccttggcacctgggcaaacttgagctggactttgatctctgcgaagggacaaccgtggtcgtggacgagcactgcggaaatcggggcccctccctgagaacgaccacagttaccggcaagatcattcatgaatggtgttgccggagctgtacactgcctccccttcgcttcagaggggaggacggatgctggtacggcatggagatccggccggtgaaagaaaaggaggaaaacctcgtcagatctatggtgtccgctgggagcggagaggttgattccttttctctgggcatcctgtgtgtgagcattatgatcgaagaggtcatgcgctcccggtggtctagaaagatgctcatgaccgggacgctggccgtgttccttctgctcattatgggacagctgacatggaatgacctgatccgcctttgcattatggttggcgccaacgctagcgatagaatgggcatggggaccacatatctggccctcatggcgacctttaaaatgcggcctatgttcgctgtgggactgctctttcgcagactgacctcccgggaggtccttctgctcacaatcggcctgtctctggtggccagcgtggaacttcccaattccctggaggaactcggggacggactggccatgggcattatgatgctcaagctgcttacggagttccaaccccaccagctgtggaccacactcctgagcctgacctttatcaaaacaaccctttctctggattacgcttggcgcacgatggccatggtcctctccatcgttagcctgttccctctctgtctgtctacaacctcccagaagaccacatggcttccggtgctgctggggagctttggatgcaaacccctcaccatgttcctgattacagaaaacaagatctggggcagaaagtcttggcctcttaacgagggcattatggctatcgggattgtgtccatcctgctcagctccctgctcaaaaatgacgtccccctggccggacctcttatcgcgggcgggatgctgattgcctgttatgtgatcagcggatctagcgctgatctgtccctcgagaaggccgctgaagtttcttgggaggaagaggccgaacatagcggcacgtcccacaacattctggtggaggtccaggacgatgggaccatgaaaatcaaggacgaggaacgggatgacacacttaccattctgctcaaagccacactgctcgctatctctggagtgtaccccatgagcatccctgcgaccctgtttgtttggtatttctggcaaaagaaaaagcagcgctccggcgtgctttgggatacgccctctccgcctgaggtcgaaagagccgtgctggacgacggcatttaccggatcctgcagcgcgggctcctgggaagaagccaggtcggcgtgggggttttccaagatggagtgtttcataccatgtggcacgtcacacggggcgctgtgcttatgtatcaggggaagagactggagccctcctgggccagcgttaaaaaggacctcatttcttacggaggcggctggcgcttccaggggtcctggaataccggagaggaagtgcaggtcatcgccgtggagcctggcaaaaaccccaagaatgtgcaaacaaccccggggacatttaaaacgcctgaaggagaggttggcgctattgccctggatttcaagcccgggaccagcggatctcctatcgtcaaccgggaaggcaagattgtgggcctctacgggaatggagtggtcacaacctccggcacctatgtgagcgcgatcgctcaggccaaaacatcccaggaggggcccctgcccgagatcgaagaggaagtttttaagaaaagaaaccttacgattatggacctgcaccctggatctggcaagacccgccggtacctgccggccatcgtgagagaggctattaaacgcaagctccggacactgatccttgcccccaccagagtcgtggcgagcgaaatggctgaggccctgaaggggatgcctattcgctatcaaacaaccgccgttaaatccgagcatacgggccgggaaatcgtggatctcatgtgccacgctacattcaccatgagactgctgagccccgtccgggtgcctaattacaacatgatcattatggacgaggcccattttaccgatcccgcttctatcgccgcgcgcggatatatttccacaagagttggcatgggggaagccgctgccatcttcatgaccgctacacctccgggaagcgtggaggcctttccccagtctaatgccgtcattcaggacgaagaacgggatatccctgagcgcagctggaactccggctacgactggatcaccgatttccccgggaagacggtgtggtttgtgccttctattaaaagcggaaatgacatcgctaactgtctcagaaagaatggcaaacgggtcattcagctttccagaaagacattcgacaccgaatatcaaaagacacgcaacaacgattgggactacgttgtgaccacggatatctctgagatgggggcgaatttccgggccgacagagtgattgatccccgccggtgcctgaaaccggtcatcctgaaggacggccctgaaagagtgattctcgctggacccatgcccgttaccgtggccagcgccgctcagcgccggggcagaatcgggcgcaaccagaataaagagggagatcagtacgtctatatgggccaacctctgaacaatgacgaggatcacgcccattggacagaagcgaagatgcttctggacaacatcaatacccccgaggggattatccctgctctctttgaaccggagagagaaaaatccgccgccattgatggagagtaccggctgcgcggcgaggctagaaagacattcgtggaactgatgcggcgcggggacctccccgtttggcttagctataaggtggcctctgagggctttcagtactccgatagacggtggtgcttcgacggagaaagaaacaatcaggtcctggaggaaaacatggacgtggagatctggaccaaagagggcgaacgcaagaaactgcggcctagatggctcgatgcgcgcacatatagcgaccccctggcccttcgggagtttaaggagttcgctgccgggagacggtccgtctctggagatctgattctcgagatcggcaaactgcctcagcacctgaccctccgcgctcaaaatgcccttgacaacctggtgatgctgcacaatagcgaacaagggggaaaggcttacagacatgccatggaggagctccccgatacgatcgaaacactgatgcttctggcgctcattgccgttctgaccggcggcgtgaccctgtttttcctctccgggaaaggacttggcaagacatctatcgggctgctgtgtgtgatggctagctccgccctcctgtggatggctaacgtcgagccgcactggattgccgccagcatcattcttgaatttttcctgatggttctcctgatccctgagcccgaccggcagcgcacccctcaggataatcaactggcttatgtggtgatcggactcctttttatgattctgacagtcgcggccaacgagatgggcctgctcgaaacgaccaagaaagacctggggatcggacatgtggctgccgagaaccagcaccacgccacaatgcttgatgttgacctgagacccgcttctgcctggaccctctacgcggtggccacaaccgtcattacgcctatgatgcggcataccatcgaaaatacaaccgctaacatttccctgacagccatcgctaatcaggccgcgattctgatgggcctcgataagggctggcccatcagcaaaatggacatcggggtgccgcttctggccctgggatgctactctcaagtcaaccctctcaccctgacggctgccgtgcttatgctggttgctcactatgccattatcggccccgggctccaggctaaggccacacgcgaggcgcagaaaagaaccgccgctggaattatgaagaatcccacagtggatggcatcgtcgccattgacctggaccctgtggtttacgatgctaagttcgaaaaacagctggggcaaatcatgctccttatcctgtgtacctcccagattctgctcatgcggaccacatgggccctgtgcgagagcatcacgcttgccaccggaccgctgacaaccctctgggagggctctcccggcaagttttggaacacaaccattgcggtgagcatggctaatatcttccgcgggtcctatctggccggagctggcctggccttctctctcatgaaaagccttgggggaggcagacgggggacgggagcccagggcgaaacactgggcgagaagtggaaaagacagctgaaccaactctccaagagcgaatttaatacctacaagcgctccgggattatggaggtcgaccggtctgaagctaaagagggactgaagagaggcgagaccacaaaacatgccgtgagccgcgggaccgcgaaacttcggtggttcgtggaaagaaacctggttaaacctgagggaaaggtcatcgatctcggctgtgggcgcggaggctggtcctattactgcgccggcctgaagaaagtgacagaagtgaaggggtatacgaaaggaggccccgggcacgaggaacctatccccatggctacctacggatggaatctggtcaagctctactctggcaaagacgtgtttttcacacctccggagaagtgtgatacccttctgtgcgacattggggagagctcccccaaccctacaatcgaagagggacggaccctgagagttctcaaaatggtggaaccctggctgcgcggcaatcagttttgtattaagatccttaacccttatatgccctctgtcgtggagacgctggagcagatgcagcggaagcatggcgggatgctcgttagaaatccgctgagccgcaactccacccacgaaatgtactgggtgagctgcggaacaggcaatattgtctctgccgtgaacatgacctcccggatgctgctcaacagattcacaatgacccaccgcaaacctacatatgagagagatgttgacctgggggctggaacccggcatgtggccgtcgaacccgaggtggcgaatcttgatatcattggccaacgcatcgaaaacatcaagaatgagcacaaaagcacgtggcattacgacgaggataacccctataagacatgggcctaccacgggtcttatgaagtgaaaccttccggaagcgcttcttccatggtcaatggcgttgtgagactgctcaccaagccctgggacgtgattcctatggtcacccagatcgccatgacagacacgaccccgtttggccagcaacgggtgttcaaggagaaagttgatacaagaacaccccgggctaagcgcgggacagcccagattatggaagtgaccgctaaatggctgtggggatttcttagcagaaacaagaaacctcggatctgtacacgcgaggagttcaccagaaaggtccggtccaatgccgcgattggcgccgtgtttgttgacgagaaccagtggaatagcgctaaggaggccgtggaagatgagcgcttctgggacctggtccacagagaacgggagctccataaacaggggaagtgcgctacgtgcgtgtacaacatgatgggaaaacgcgaaaagaaactgggcgagtttgggaaggccaagggctctagagccatctggtacatgtggctgggagcgcggttcctcgagttcgaagctctgggctttatgaatgaggatcactggttcagccgcgaaaactccttttctggggttgagggagagggccttcataaactggggtatatcctcagagacattagcaagatccccggaggcaatatgtacgccgatgacaccgccgggtgggatacacggattaccgaagacgatctgcaaaacgaggctaaaatcacagacattatggaacctgagcacgcccttctggctacctccatcttcaagctcacgtatcagaataaagtggtccgcgtgcagagacccgccaagaacggcacagtcatggatgtgatctctcggagagaccagcgcggaagcggccaagttgggacctacggactgaacacatttaccaatatggaagtgcagctgattcggcagatggagtccgagggcatcttcctcccgtctgaactggagacgcctaaccttgcggaaagagtcctggactggctcgagaaacatgggaccgaacgcctgaagcggatggccattagcggagatgactgtgtggtgaagcccgttgatgacagatttgctacagcccttatcgctctgaatgatatgggcaaagtgcgcaaggacattcctcagtgggagccctccaaagggtggaacgattggcaacaggtccctttctgcagccaccactttcatcagctcatcatgaaggacggccgggagatcgtggttccctgtagaaatcaggatgaactggtgggacgcgcccgggtctctcaaggcgcggggtggtccctgagagagaccgcctgcctcggaaaaagctatgctcagatgtggcagctgatgtacttccaccgccgggaccttagactggccgctaacgccatttgttctgctgtgccggtcgattgggtgcctacatcccggaccacatggagcatccatgcccaccaccaatggatgaccacggaagacatgctctccgtttggaatagagtgtggattgaggaaaacccctggatggaggacaagacacatgtctctagctgggaggaagtgccctatctgggcaagcgcgaggatcagtggtgcgggtcccttatcggactgaccgcgcgggccacctgggctacaaatattcaggttgccatcaaccaggtgagacgcctcattggcaatgaaaactacctggactacatgaccagcatgaaaagatttaagaatgagtctgatcctgagggggccctgtggtga

SEQ ID NO: 18752 - RNA, 9879 nt, synthetic construct
  misc_feature 1..9879: note = derived and/or modified CDS sequence (opt5) from DENV-1__FJ410181__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcattaatatgtgcaccctgatcgccatggacctcggggagctgtgtgaagatacaatgacctacaaatgccccagaattacagaggcggaacccgacgatgtggactgttggtgcaatgctaccgatacgtgggtgacctatggaacatgttcccagaccggcgagcacagacgggacaagcgctctgtcgccctggcccctcatgtggggctcggactggagacaagaaccgaaacgtggatgagctccgagggcgcttggaaacagatccagaaggttgaaacatgggcccttcggcaccccggcttcaccgtgacagctctgtttctcgcccatgcgattgggacctctatcacccagaagggaatcattttcatcctgcttatgctggtcacacctagcatggccatgcgctgcgtgggcattgggaacagagattttgttgagggactctccggcgctacgtgggtggacgtcgtgctggagcacgggagctgtgtgaccacaatggccaaagataagcccaccctggacatcgaactcctgaaaacagaggtcaccaatcctgctgttcttcggaagctgtgcattgaagccaaaatctctaacacgacaaccgattcccgctgtccgacccaaggagaggcgacactcgtggaggaacaggacagcaatttcgtgtgcagacggacctttgtcgatcgcggctggggcaacgggtgtggactgttcggcaaggggtctcttctgacatgcgccaagtttaaatgcgtgacgaagctcgagggaaaaattgttcagtacgaaaatctgaagtattccgtgatcgtcaccgtgcacacaggcgaccagcatcaagttgggaacgagaccacagaacacggaaccatcgctacgattacaccccaggcccctacaagcgagatccagctgaccgactacggcgctctcacactggattgttctcccagaaccggccttgacttcaatgaaatggtgctgctcacgatgaaagagaagtcctggctggtccataaacagtggtttcttgatctgcctctcccctggacaagcggggcctccacctctcaagagacatggaaccggcaggacctgctggtgaccttcaagaccgcccacgctaagaaacaggaagtcgtggttctcggaagccaagagggcgcgatgcacacagccctgacgggggctaccgaaattcagacatccggaaccacaaccatctttgccggccatcttaagtgccgcctgaaaatggataagctcacgctgaaagggatgagctatgtgatgtgtacaggctctttcaagctggagaaggaagtcgccgagacccagcacggaaccgtgcttgttcaggtgaaatacgagggcacagacgctccgtgcaagattcctttctccgcccaagatgaaaaaggggtcacccagaatggaagactcatcacagcgaaccccatcgtgacggacaaggagaaacctgtgaatattgaaaccgagccgccctttggcgagagctatatcgttattggggctggagaaaaggccctgaagctgtcttggttcaaaaagggcagctccatcgggaaaatgtttgaggccacagctcggggcgccagacgcatggctattctcggagataccgcctgggacttcggctctatcgggggagtctttacaagcgtgggcaagctggtgcatcaggtcttcggggcggcctacggagtgctcttttccggcgttagctggaccatgaaaatcgggattggcatcctgctcacgtggctgggactgaactctcggtccaccagcctttctatgacatgtattgctgtgggcatggtcaccctctacctgggggtgatggttcaggccgattccggatgcgtgatcaattggaagggcagagaactgaagtgtgggagcggaattttcgtcacaaacgaggtgcacacctggacagaacaatataaatttcaggctgactcccctaagcgcctctctgccgcgatcggcaaagcctgggaggagggggtttgcggcattcggagcgctaccagactggaaaacatcatgtggaagcagatctccaatgagcttaaccatattctgctcgaaaatgacatgaaattcacggtggtcgtgggagatgccaacggcatcctggctcaggggaagaaaatgattcgcccgcaacccatggagcaccggtactcttggaaaagctggggaaaggccaagatcattggcgccgacatccagaatacaacctttatcattgatgggcctgacacccccgaatgtcctgatgaccagagagcttggaacatctgggaggtggaggattatggattcggcatttttacaaccaatatctggctgaaacttcgcgactcctacacgcagatgtgcgatcaccggctcatgagcgcggccattaaagactctaaggctgtccatgccgatatgggctattggatcgaatccgagaaaaacgaaacatggaagctggccagagctagcttcatcgaggttaagacctgtatttggcccaaatctcacacactgtggtccaatggggtgctcgaaagcgagatgatcattccgaagatctacggaggccctatttctcaacataactatcgccccgggtacttcacccagacagccggaccttggcacctgggcaaacttgagctggactttgatctctgcgaagggaccacggtggtcgtggacgagcactgcggaaatcggggccccagcctgagaaccacaaccgttacaggcaagatcatccatgaatggtgttgccggtcctgtaccctgcctccccttcgcttcagaggggaggacggatgctggtacggcatggagattcggccggtgaaagaaaaggaggaaaacctcgtcagaagcatggtgtctgcggggtccggagaggttgatagcttttccctgggcatcctgtgtgtgtctattatgatcgaagaggtcatgcgcagccggtggtccagaaagatgctcatgacggggacactggctgtgttccttctgctcattatgggacagctgacctggaatgacctgatccgcctttgcattatggttggcgccaacgcctctgatagaatgggcatggggacaacctatctggctctcatggccacctttaaaatgcggcctatgttcgcggtgggactgctctttcgcagactgacaagccgggaggtccttctgctcacgatcggcctgtccctggtggcttctgtggaacttcccaatagcctggaggaactcggggacggactggccatgggcatcatgatgctcaagctgcttaccgagttccaaccccaccagctgtggacaaccctcctgtccctgacatttattaaaaccacgcttagcctggattacgcctggcgcacaatggctatggtcctctctatcgtttccctgttccctctctgtctgagcaccacctctcagaagacaacctggcttccggtgctgctggggtcctttggatgcaaacccctcacaatgttcctgattacggaaaacaagatctggggcagaaagagctggcctcttaacgagggcattatggccatcgggatcgtgtctattctgctctccagcctgctcaaaaatgacgtccccctggctggacctcttatcgccggcgggatgctgattgcgtgttatgtgatctccggaagctctgccgatctgagcctcgagaaggctgccgaagtttcctgggaggaagaggctgaacattctggcaccagccacaacattctggtggaggtccaggacgatgggacaatgaaaatcaaggacgaggaacgggatgacacccttacaatcctgctcaaagccaccctgctcgccgtgtccggagtttaccccatgtctattcctgctacgctgtttgtgtggtatttctggcaaaagaaaaagcagcgcagcggcgtcctttgggataccccctccccgcctgaggtggaaagagcggtcctggacgacggcatctaccggattctgcagcgcgggctcctgggaagatctcaggtgggcgttggggtgttccaagatggagtctttcatacaatgtggcacgtgacccggggcgccgttcttatgtatcaggggaagagactggagcccagctgggcttccgtgaaaaaggacctcatcagctacggaggcggctggcgcttccaggggtcttggaatacaggagaggaagtccaggtgattgccgtggagcctggcaaaaaccccaagaatgttcaaaccacaccggggacgtttaaaacccctgaaggagaggtcggcgccatcgctctggatttcaagcccgggacatccggaagccctattgtgaaccgggaaggcaagatcgtgggcctctacgggaatggagtcgtgaccacctctggcacatatgtttccgccatcgcgcaggctaaaacgagccaggaggggcccctgcccgagattgaagacgaggtgtttaagaaaagaaaccttaccatcatggatctgcaccctggatccggcaagacacgccggtacctgccggccattgtcagagaagccatcaaacgcaagctccggaccctgattcttgctcccacaagagtggttgcctctgagatggcggaagctctgaaggggatgcctatccgctatcaaaccacggccgtgaaaagcgagcatacaggccgggagatcgtcgacctcatgtgccacgccaccttcaccatgagactgctgtcccccgtgcgggttcctaattacaacatgattatcatggatgaagctcattttacagaccccgccagcattgctgcccgcggatatatctctaccagagtgggcatgggggaggcggccgctattttcatgacagccacccctccgggatccgtcgaggcttttccccagagcaatgccgtgatccaggatgaggaacgggacatccctgagcgctcttggaacagcggctacgattggattacggacttccccgggaagacagtgtggtttgtcccttccatcaaatctggaaatgacattgccaactgtctcagaaagaatggcaaacgggttatccagcttagcagaaagaccttcgatacagagtatcaaaagaccaaaaacaacgactgggattacgtggtgacgaccgacatttccgaaatgggggctaatttccgcgcggatcgggtcatcgaccccagacgctgcctgaagccggtgattctgaaagatggccctgagcgggttatcctcgccggacccatgcccgtgacagtcgcttctgccgcccagagacgcggccggatcgggagaaaccagaataaggaaggagaccagtacgtgtatatgggccaacctctgaacaatgatgaggaccacgctcattggaccgaggccaaaatgcttctggataacattaatacacccgaagggatcattcctgcgctctttgagccggaacgcgaaaagagcgctgccatcgacggagaatacagactgcggggcgaggcccgcaagaccttcgttgagctgatgagaagaggggatctccccgtgtggctttcctataaagtcgctagcgaaggctttcagtactctgaccgcagatggtgcttcgacggagagcggaacaatcaggtgctggaagagaacatggatgtcgaaatttggacaaaggagggcgagcgcaagaagctgcgccctcggtggctcgacgccagaacctattccgatcccctggcgcttcgcgaatttaaagagttcgccgctgggcggagaagcgtgtccggagacctgatcctcgaaatcggcaagctgcctcagcacctgacgctccgggcccaaaatgctcttgataacctggttatgctgcacaattctgagcaagggggaaaagcctaccgccatgctatggaagaacttcccgacacaattgagaccctgatgcttctggccctcatcgcggtgctgaccggcggcgtgacactgtttttcctcagcgggaagggacttggcaagacctccattgggctgctgtgtgtcatggcctctagcgctctcctgtggatggccaacgttgaaccgcactggatcgctgcctccattatccttgagtttttcctgatggtgctcctgatccctgaacccgatagacagcggacacctcaggacaatcaactggcctatgtggtcattggactcctttttatgatcctgacggtggctgcgaacgagatgggcctgctcgagaccaccaaaaaggatctggggattggacatgttgccgctgaaaaccagcaccacgccaccatgcttgacgtggatctgcgccccgccagcgcttggacactctacgccgtcgcgaccacggtgatcacccctatgatgagacatacaattgagaataccacagccaacatctctctgaccgctattgccaatcaggctgccatcctgatgggcctcgacaaaggctggcccatctccaagatggatattggggtcccgcttctggcgctgggatgctacagccaagtgaaccctctcacgctgacagccgctgttcttatgctggtggcccactatgctatcattggccccgggctccaggccaaagctacccgggaagcccagaagcgcacagcggccggaatcatgaagaatcccaccgtcgacggcattgtggctatcgacctggatcctgttgtgtacgacgccaaattcgagaagcagctggggcaaatcatgctccttattctgtgtacctctcagatcctgctcatgagaacaacgtgggctctgtgcgaatccattacccttgccacaggaccgctgaccacactctgggagggcagccccggcaaattttggaacaccacgatcgccgtctctatggcgaatattttccgggggagctatctggctggagccggcctggctttctccctcatgaagtctcttgggggaggccgcagagggacaggagcccagggcgagaccctgggcgaaaaatggaagcggcagctgaaccaactcagcaagtccgagtttaatacctacaaaagaagcgggatcatggaagtggatcgctccgaggccaaggaaggactgaaacggggcgagacaaccaagcatgctgtgtctagagggacagccaaacttcgctggttcgttgagcggaacctggtcaagcctgaaggaaaggtgatcgacctcggctgtgggagaggaggctggagctattactgcgcgggcctgaaaaaggtgacggaggtcaaagggtataccaagggaggccccgggcacgaggagcctattcccatggccacatacggatggaatctggttaaactctactccggcaaggatgtgtttttcacccctccggaaaaatgtgacacacttctgtgcgatatcggggagtctagccccaaccctaccattgaggaaggacgcacgctgcgggtgctcaagatggtcgagccctggctgagaggcaatcagttttgtatcaagattcttaacccttatatgccctccgtggttgaaaccctggagcagatgcagcgcaaacatggcgggatgctcgtgcggaatccgctgtctagaaacagcacacacgagatgtactgggtctcctgcggaaccggcaatatcgtgagcgctgttaacatgacatctcgcatgctgctcaaccggttcaccatggcccacagaaagcctacatatgaacgcgacgtggatctgggggctggaaccagacatgtcgccgtggagcccgaagtggcgaatcttgacattatcggccaacggatcgagaacattaaaaatgaacacaagtccacgtggcattacgatgaggacaacccctataaaacatgggcctaccacgggagctatgaggtcaagccttctggatccgctagctctatggttaatggcgtggtgcgcctgctcaccaagccctgggacgtcatccctatggtgacccagattgccatgacagatacgaccccgtttggccagcaaagagttttcaaagaaaaggtggacacacggacccccagagctaaacgggggacagcccagatcatggaggtcaccgctaagtggctgtggggatttctttcccgcaacaaaaagcctagaatttgtacacgggaagagttcacccgcaaggtgagaagcaatgccgcgatcggcgccgtttttgtggatgaaaaccagtggaactccgctaaagaggccgtcgaggacgaacggttctgggatctggtgtaccgcgagagagaactccacaagcaggggaaatgcgctacgtgcgtttacaacatgatgggaaagcgggagaaaaagctgggcgaatttgggaaggccaaaggcagccgcgccatctggtatatgtggctgggagcgagattcctcgagttcgaggctctgggctttatgaatgaagaccattggttctctcgggagaacagcttttccggggtggaaggagagggccttcacaagctggggtacattctccgcgatatctctaaaattcccggaggcaatatgtatgccgacgataccgccgggtgggacacaagaatcaccgaggatgacctgcaaaacgaagctaagattacagatatcatggagcctgaacatgcccttctggctaccagcatcttcaaactcacgtaccagaataaggtcgtgcgggtccagcgccccgccaaaaacggcacagtgatggacgttatttccagacgggaccagagaggatctggccaagtggggacctatggactgaacacatttaccaatatggaggtccagctgatccgccagatggaaagcgagggcattttcctcccgtccgagctggaaacgcctaaccttgcggagcgggtgctggattggctcgaaaagcacgggaccgagagactgaagcgcatggccatctctggagacgattgtgtggttaaacccgtggacgatcggtttgctacagcccttattgctctgaatgacatgggcaaggtcagaaaagatatccctcagtgggaacccagcaaggggtggaacgactggcaacaggtgcctttctgctcccatcactttcaccagctcatcatgaaagatggccgcgagattgttgtgccctgtcggaatcaggacgagctggtcggacgggcccgcgtgagccaaggcgcggggtggtctctgcgggaaaccgcctgcctcggaaagtcctacgctcagatgtggcagctgatgtatttccatagacgcgatcttcggctggccgctaacgccatctgtagcgctgtcccggtggactgggttcctacatctagaaccacatggtccattcacgcccatcaccaatggatgaccacggaggacatgctcagcgtgtggaatcgggtctggatcgaagagaacccctggatggaagataagacacacgtgtcctcttgggaggaggttccctacctgggcaaaagagaagaccagtggtgcgggagccttattggactgaccgcgcgcgccacctgggctacaaatatccaggtggccattaaccaggtccggagactcatcggcaatgagaactacctggattatatgacctccatgaagcgctttaaaaatgaaagcgaccctgagggggccctgtggtga

SEQ ID NO: 18753 - RNA, 9879 nt, synthetic construct
  misc_feature 1..9879: note = derived and/or modified CDS sequence (opt5) from DENV-1__FJ547086__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagaaggttgaaacatgggctcttcggcaccccggcttcaccgtgatcgcctttttcctggcgcatgccattgggacatctatcacccagaagggaatcatttttatcctcctgatgcttgtcacccctagcatggctatgcgctgcgtgggcattgggaacagagatttcgttgagggactgtccggcgccacatgggtggacgtcgtgctcgagcacgggagctgtgtgacgaccatggctaaaaataagcccacactggatatcgaactgctcaaaaccgaggtcacaaaccctgccgttctgcggaagctttgcattgaagcgaaaatctctaataccacgacagactcccgctgtccgacccaaggagaggccaccctggtggaagagcaggatgctaactttgtgtgcagacggacattcgtcgaccgcggctggggcaatgggtgtggactctttggcaaggggagcctgcttacctgcgccaagttcaaatgcgtgacaaagctggagggaaaaattgttcagtacgaaaacctcaagtattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagccccagaacaggcctggattttaacgaaatggtgcttctgaccatgaaagagaagtcttggctcgtccataaacagtggttcctggaccttcctctgccctggacgtccggggctagcacatcccaagagacctggaatcggcaggatctcctggtgacatttaagaccgcgcacgccaagaaacaggaagtcgtggttctgggatctcaagagggcgctatgcacaccgccctcacaggggccacggaaattcagaccagcggaacaaccacaatcttcgctggccatctgaagtgccgccttaaaatggacaagctgaccctcaaagggatgtcctatgtgatgtgtacgggcagcttcaagctggagaaggaagtcgccgagacacagcacggaaccgtgctggttcaggtgaaatacgagggcaccgatgcgccgtgcaagattcctttttctacacaagacgaaaaaggggtcacccagaacggaagacttatcacagctaatcccatcgtgacggataaggagaaacctgtgaacattgaaaccgagccccccttcggcgagtcctatatcatggttggggccggagaaaaggccctcaagctgagctggtttaaaaagggctctagcattgggaaaatgttcgaggctacagcccggggcgctagacgcatggccatcctgggagacaccgcgtgggattttggctccattgggggagtcttcacatctgtgggcaagctcgtgcatcaggtctttgggaccgcctacggagtgctgttcagcggcgtttcctggacgatgaaaatcgggatcggcattcttctgacctggctcggactgaatagccggtctgcttccctgagcatgacatgtatcgccgtgggcatggtcaccctttacctcggggtgatggttcaggctgactctggatgcgccattaactggaagggcagagaactgaagtgtgggtccggaatctttgtgacaaacgaggtccacacctggacagaacaatataaattccaggcggatagccctaagcgcctgtccgccgctattggcaaagcctgggaggagggggtgtgcggcatccggtctgctaccagactcgaaaatattatgtggaagcagatcagcaacgagctgaatcatatccttctggaaaacgacatgaaatttacggttgtggtcggagacgccaatggcattctcgcccaggggaagaaaatgatccgcccgcaacccatggagcacaagtactcctggaagtcttggggaaaagctaagattatcggcgcggatattcagaacacaaccttcatcatcgacgggcctgatacccccgaatgtcctgacgatcagcgggcctggaatatttgggaggtggaggactatggatttggcatcttcacaaccaacatttggctgaaactgagagatagctacacgcagatgtgcgaccaccgccttatgtccgctgccatcaaggatagcaaagccgtgcatgctgacatgggctattggattgaatctgagaagaatgaaacatggaagctcgcccgggcgtccttcatcgaggtcaaaacctgtatctggcccaagagccacacactgtggtctaacggggttctggaatccgagatgattatcccgaaaatttacggaggccctatcagccaacataattatagacccgggtactttacccagacagctggaccttggcacctcggcaagctggagcttgatttcgacctgtgcgaagggaccacggtggtggtcgatgagcactgcggaaaccgcggcccctctctccggaccacaaccgtgacaggcaaaattatccatgaatggtgttgcagaagctgtaccctgcctcccctgcggtttcgcggggaggacggatgctggtacggcatggagatcagaccggttaaggaaaaggaggaaaatcttgtgcggtccatggtcagcgccgggtctggagaggtggactccttcagcctcggcattctgtgtgtttccatcatgattgaagaggtgatgagatctcgctggagccggaaaatgctgatgacggggacactcgccgtctttctgcttctgatcatgggacagctcacctggaacgatctgattagactgtgcatcatggtgggcgctaatgcctccgaccgcatgggcatggggacaacctatcttgcgctgatggctaccttcaagatgagacctatgtttgccgttggactcctgttccggcgcctcacatctagagaggtgctgcttctgacgattggcctcagcctggtcgcctccgtggaactgcccaactctcttgaggaactgggggatggactcgctatgggcatcatgatgctgaaactcctgaccgagtttcaaccccaccagctttggacaaccctgctcagcctgacattcatcaagaccacgctgtcccttgactacgcctggaaaacaatggctatggtgctgagcattgtctctctctttcctctgtgtctctccaccaccagccagaagacaacctggctgccggttcttctggggtctttcggatgcaagcccctgacaatgtttctcatcacggaaaacaaaatttggggccggaagtcctggcctctgaatgagggcatcatggccattgggatcgtgagcatccttctgtcttccctcctgaaaaacgatgtgcccctcgcgggacctctgattgccggcgggatgcttatcgcttgttatgtcattagcggatccagcgccgacctgtctctggagaaggctgccgaagtgagctgggaggaagaggccgaacattccggcacctctcacaatatcctcgttgaggtgcaggatgacgggacaatgaaaattaaggatgaggaacgcgacgataccctgacaatccttctgaaagctaccctcctggcggtcagcggagtgtaccccatgtccatccctgccacgctcttcgtttggtatttctggcaaaagaagaaacagagatctggcgtgctgtgggacacccccagcccgcctgaggtcgaacgggctgtgcttgatgacggcatttaccgcatcctgcagagagggctgctcggacggtcccaggtcggcgtgggggtttttcaagacggagtgttccatacaatgtggcacgtcacccgcggcgccgtgctgatgtatcaggggaagagacttgagccctcttgggccagcgttaaaaaggatctgatttcctacggaggcggctggcggtttcaggggagctggaacacaggagaggaagtgcaggtcatcgctgtggagcctggcaaaaatcccaagaacgtgcaaaccacaccggggacgttcaagacccctgaaggagaggttggcgccattgcgctcgactttaaacccgggacatctggatcccctatcgtcaatagagaaggcaagattgtgggcctgtacgggaacggagtggtcaccaccagcggcacatatgtgtctgctatcgcccaggccaaagcttcccagcaagggcccctccccgagatcgaggatgaagttttcaagaaacgcaatctgacgattatggaccttcaccctggaagcggcaagacccggagatacctgccggccatcgtgcgcgaggcgattaagcggaaactgagaacactcatcctggctcccacccgcgtcgtggcctccgaaatggccgaggctcttaaggggatgcctattcggtatcagacaaccgccgttaaatctgaacatacgggcagagagatcgtggatctgatgtgccacgctacatttaccatgcgcctcctgagccccgtccgggtgcctaactacaatatgatcattatggacgaggcccatttcaccgatcccgcgtccatcgccgctagaggatatattagcacacgggttggcatgggggaagccgctgccatctttatgaccgccacacctccgggatctgtggaggctttcccccagtccaacgcggtcattcaggacgaagagcgcgatatccctgaaagaagctggaattctggctacgactggatcaccgattttcccgggaagacggtgtggttcgtgcctagcattaaatccggaaacgacatcgccaattgtctgcggaagaacggcaagcgcgtcattcaactctctagaaaaacattcgacaccgagtatcagaagacaaaaaacaatgattgggactacgttgtgaccacggatatcagcgagatgggggctaactttcgggccgacagagtgattgatccccgccggtgccttaagccggtcatcctgaaagacggccctgaaagagtgattctggccggacccatgcccgttaccgtggcttccgccgcgcagcgccggggcagaatcgggcgcaatcagaacaaggagggagatcaatacgtctatatgggccagcctctcaataacgacgaagatcacgctcattggacagaggccaagatgctgcttgacaatatcaacacccccgaggggattatccctgccctgttcgaaccggagcgggaaaaatctgctgccattgatggagagtacagactccgcggcgaagcgagaaagacatttgtggagctgatgcggcgcggggacctgcccgtttggctcagctataaagtggcctccgagggcttccagtacagcgatagacggtggtgctttgacggagaacgcaataaccaggtccttgaggaaaatatggacgtggagatctggaccaaggaaggcgagagaaaaaagctgcggcctagatggctggatgctcgcacatattctgaccccctcgccctgcgggagttcaaagaatttgctgccgggagacgctccgtcagcggagatcttattctggagatcggcaagctccctcaacacctgaccctgcgggctcagaacgccctcgacaatcttgtgatgctgcacaactccgaacaggggggaaaggcgtacagacatgccatggaggaactgcccgatacgatcgagacactcatgctgcttgctctgattgccgttctcaccggcggcgtgaccctgttctttctgtctgggaaaggactcggcaagacaagcatcgggcttctgtgtgtgatggcttcctctgccctgctctggatggccagcgtcgagccgcactggattgctgcgtccatcattctggaattctttcttatggttctgctcatccctgagcccgaccggcagcgcacccctcaagataatcagctggcctatgtggtgatcggactgctcttcatgattcttacagtcgctgccaacgaaatgggcctgctggagacgaccaaaaaggacctcgggatcggacatgtggccgctgagaaccaccaccatgccacaatgctggatgttgaccttagacccgcgagcgcctggaccctgtacgctgtggccacaaccgtcattacgcctatgatgcggcacaccatcgaaaatacaaccgctaacatttctctcacagccatcgcgaatcaggccgctattctgatgggcctggataaaggctggcccatctccaagatggacatcggggtgccgctccttgccctgggatgctacagccaagtcaaccctctgaccctcacggctgccgtgctgatgcttgttgctcattatgccattatcggccccgggctgcaggcgaaggccacacgcgaggctcagaaaagaaccgccgctggaattatgaagaatcccacagtggatggcatcgtcgccattgacctcgaccctgtggtttacgatgccaaatttgaaaagcagctggggcaaatcatgctgctcatcctttgtacctctcagattctgctgatgcggaccacatgggcgctctgcgagtccatcacgctggctaccggaccgcttacaaccctgtgggaaggcagccccggcaaattctggaacacaaccattgccgtgtctatggctaatatcttccgcgggagctatctcgccggagccggcctggctttttccctgatgaagtctctcgggggaggcagacgggggacgggagcccagggcgagacacttggcgagaagtggaaacgccagctgaaccaactgagcaagtccgaattcaatacctacaaaagaagcgggattatggaggtcgaccggtccgaagcgaaggagggactcaaaagaggcgaaaccacaaagcacgccgtgtctcgcgggaccgctaagctgcggtggtttgtggagagaaaccttgttaaacctgagggaaaggtcatcgatctgggctgtgggcgcggaggctggagctattactgcgccggcctcaaaaaggtgacagaagtgaaagggtatacgaagggaggccccgggcatgaggaacctatccccatggctacctacggatggaatctggtcaaactgcactccggcaaggacgttttctttacacctccggagaagtgtgataccctcctttgcgacattggggaatctagccccaaccctacaatcgaggagggacggaccctgagagtgctgaaaatggtggaaccctggctccgcggcaatcagttctgtattaagatcctgaacccttacatgccctccgtcgtggagacgcttgaacagatgcagcggaaacacggcgggatgctggttagaaatccgctctctcgcaacagcacccatgagatgtattgggtgtcctgcggaacaggcaatattgtcagcgccgtgaacatgacctctcggatgctgctgaacagatttacaatggcgcaccgcaagcctacctacgagcgggatgttgacctcggggccggaacaagacatgtggctgtcgaacccgaggtggccaatctggatatcattggccaacgcatcgaaaacatcaaaaatgagcacaagtccacctggcactatgacgaagataacccctacaagacgtgggcttatcatgggagctacgaggtgaaaccttctggatccgccagctctatggtcaatggcgttgtgagacttctgacaaagccctgggacgtgattcctatggtcacccagatcgctatgaccgacacaacgccgttcggccagcaacgggtgtttaaagagaaggttgatacccgcacacccagagccaaacgggggaccgcgcagattatggaagtgacagccaagtggctctggggattcctgtccagaaacaagaaacctcggatctgtacccgcgaggaatttacaagaaaggtccggagcaatgctgccattggcgctgtgttcgttgacgagaaccagtggaattccgccaaagaagccgtggaggatgagcgcttttgggaccttgtccacagagaacgggagctgcataagcaggggaaatgcgcgacctgcgtgtataacatgatgggaaagcgcgaaaagaaactcggcgagttcgggaaggctaaaggcagcagagccatctggtacatgtggctgggagcccggttcctggaatttgaggctctcggcttcatgaatgaggatcactggttttctcgcgaaaacagcctgtccggggttgagggagaaggccttcataagctggggtacatcctcagagacatttctaaaatccccggaggcaatatgtatgccgatgacacggctgggtgggatacccggattacagaggacgatctgcaaaacgaggccaagatcaccgacattatggaacctgagcacgcgcttctggccacaagcatcttcaaactcacctaccagaataaggtggtccgcgtgcagagacccgctaagaacggcacggtcatggatgtgatctcccggcgcgaccagagaggatctggccaagttgggacatatggactgaacacctttacaaatatggaagtgcagctgattcggcagatggagagcgaaggcatcttcctcccgtgtgagctggagacccctaaccttgccgaaagagtcctggactggctcgagaaacacggggctgaacgcctgaagcggatggccatttccggagatgactgcgtggtgaaacccatcgatgacagatttgcgacggcccttattgctctgaatgatatgggcaaggttcgcaaagacatccctcagtgggagccctctaaggggtggaacgattggcaacaggtgcctttctgtagccatcactttcatcagctcatcatgaaggacggccgggaaattgtcgtgccctgcagaaatcaggatgagctggttggacgcgcccgggtgtcccaaggcgctgggtggagcctgagagagaccgcctgtctcggaaaatcttacgctcagatgtggcagctgatgtatttccaccgccgggaccttagactggccgcgaacgccatctgctccgctgtcccggtggattgggtccctacaagccgcaccacatggtctattcacgcccatcaccaatggatgaccacagaagacatgctctccgtgtggaatcgggtttggatcgaggaaaacccctggatggaggacaagacccatgtgagctcctgggaagaggtcccctacctgggcaaaagagaggatcagtggtgtgggtctcttattggactgacggcccgggctacatgggccaccaatatccaggtggcgattaaccaggttagacgcctcatcggcaatgaaaactatctggactacatgaccagcatgaagcggtttaaaaatgagtccaaccctgaaggggctctgtggtga

SEQ ID NO: 18754 - RNA, 9879 nt, synthetic construct
  misc_feature 1..9879: note = derived and/or modified CDS sequence (opt5) from DENV-1__FJ410183__SS-prME
  source 1..9879: mol_type = other RNA
agcgtgaccatgctgctcatgctgcttcccaccgccctggctttccacctcacgaccagaggcggggagcctcatatgatcgtctccaagcaggaacggggaaagtctctgctttttaagacaagcgccggcattaacatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagcctttttcctggcgcatgccattgggacctctatcacccagaagggaatcatttttatcctcctgatgcttgtgacacctagcatggctatgcgctgcgtcggcattgggaacagagatttcgtggagggactgtccggcgccacgtgggttgacgtggtcctcgagcacgggagctgtgtgaccacaatggctaaagataagcccaccctggacatcgaactgctcaaaacagaggtgaccaatcctgccgtcctgcggaaactttgcattgaagcgaaaatctctaacacgacaaccgattcccgctgtccgacccaaggagaggccacactggttgaggaacaggacagcaattttgtgtgcagacggaccttcgtggatcgcggctggggcaacgggtgtggactctttggcaaggggtctctgcttacatgcgctaagttcaaatgcgtcacgaagctggagggaaaaattgtgcagtacgaaaatctcaagtattccgttatcgtgaccgtccacacaggcgaccagcatcaagtggggaacgagaccacagaacacggaaccatcgccacgattacaccccaggctcctacaagcgagatccagctgaccgactacggcgccctgacactcgattgttctcccagaaccggcctggactttaatgaaatggttcttctgacgatgaaagagaagtcctggctcgtgcataaacagtggttcctggatcttcctctgccctggacaagcggggcctccacctctcaagagacatggaaccggcaggacctcctggtcacctttaagaccgctcacgcgaagaaacaggaagtggtcgtgctgggaagccaagagggcgccatgcacacagctctcacgggggccaccgaaattcagacatccggaaccacaaccatcttcgccggccatctgaagtgccgccttaaaatggataagctgacgctcaaagggatgagctatgttatgtgtacaggctctttcaagctggagaaggaagtggctgagacccagcacggaaccgtcctggtgcaggttaaatacgagggcacagacgccccgtgcaagattcctttttccgcgcaagatgaaaaaggggtgacccagaatggaagacttatcacagctaaccccatcgtcacggacaaggagaaacctgtgaatattgaaaccgagccgcccttcggcgagagctatatcgtggttggggccggagaaaaggccctcaagctgtcttggtttaaaaagggcagctccattgggaaaatgttcgaggctacagcccggggcgctagacgcatggccatcctgggagataccgcgtgggactttggctctattgggggagtcttcacaagcgtgggcaagctcgtgcatcaggtctttggggccgcttacggagtgctgttctccggcgttagctggaccatgaaaatcgggatcggcattcttctgacgtggctcggactgaactctcggtccaccagcctgtctatgacatgtatcgccgtgggcatggtcaccctttacctcggggtgatggttcaggctgattccggatgcgtgattaattggaagggcagagaactgaagtgtgggagcggaatctttgtcacaaacgaggtgcacacctggacagaacaatataaattccaggccgactcccctaagcgcctgtctgcggccattggcaaggcttgggaggagggggtttgcggcatccggagcgccaccagactcgaaaacattatgtggaagcagatctccaatgagctgaaccatatccttctggaaaatgacatgaaatttacggtggtcgtgggagatgctaacggcattctcgcccaggggaagaaaatgatccgcccgcaacccatggagcaccggtactcttggaaaagctggggaaaggccaaaattatcggcgctgacattcagaatacaaccttcatcatcgatgggcctgacacccccgaatgtcctgatgaccagagagcgtggaacatttgggaggtggaggattatggatttggcatcttcacaaccaatatttggctgaagctgcgcgactcctacacgcagatgtgcgatcaccggcttatgagcgccgctatcaaagactctaaggccgtccatgccgatatgggctattggattgaatccgagaaaaacgaaacatggaagctcgctagagccagcttcatcgaggttaagacctgtatctggcccaaatctcacacactgtggtccaatggggtgctggaaagcgagatgattatcccgaagatgtacggaggccctacctctcaacataactatcgccccgggtactttacacagaccgcgggaccttggcacctcggcaaactggagcttgacttcgatctgtgcgaagggacgaccgtggtcgtggacgagcactgcggaaatcggggccccagcctcagaacaaccacagttaccggcaagattatccatgaatggtgttgccggtcctgtacgctgcctcccctgcgctttagaggggaggacggatgctggtacggcatggagattcggccggtgaaagaaaaggaggaaaaccttgtcagaagcatggtgtctgctgggtccggagagatggatagcttctccctcggcatcctgtgtgtttctatcatgattgaagaggtgatgcgcagccggtggtccagaaagatgctgatgacagggaccctcgccgtctttctgcttctgatcatgggacagctcacatggaatgacctgattcgcctgtgcatcatggtgggcgccaacgcttctgatagaatgggcatggggaccacctatcttgccctgatggcgacattcaaaatgcggcctatgtttgctgttggactcctgttccgcagactcacgagccgggaggtgctgcttctgaccattggcctctccctggtcgcctctgtggaactgcccaatagccttgaggaactgggggacggactcgccatgggcatcatgatgctgaagctcctgacagagtttcaaccccaccagctttggaccacactgctctccctgaccttcattaaaacgacactgagccttgattacgcttggcgcaccatggccatggtgctgtctatcgtctccctctttcctctgtgtctcagcaccacatctcagaagaccacatggctgccggttcttctggggtccttcggatgcaaacccctgacgatgtttctcatcaccgaaaacaagatttggggcagaaagagctggcctctgaacgagggcatcatggctattgggatcgtgtctattcttctgtccagcctcctgaaaaatgacgtgcccctcgccggacctctgatcgcgggcgggatgcttatcgcctgttatgtcatttccggaagctctgctgatctgagcctggagaaggccgctgaagtgtcctgggaggaagaggccgaacattctggcacaagccacaacatcctcgttgaggtgcaggacgatgggaccatgaaaattaaggacgaggaacgggatgacacactgaccatccttctgaaagccacgctcctggctgtctccggagtgtaccccatgtctattcctgcgaccctcttcgtttggtatttctggcaaaagaaaaagcagcgcagcggcgtgctgtgggatacaccctccccgcctgaggtcgaaagagccgtgcttgacgacggcatctaccggatcctgcagcgcgggctgctcggaagatctcaggtcggcgtgggggtttttcaagatggagtgttccataccatgtggcacgtcacacggggcgctgtgctgatgtatcaggggaagagacttgagcccagctgggcctccgttaaaaaggacctgattagctacggaggcggctggcgctttcaggggtcttggaataccggagaggaagtgcaggtcatcgccgtggagcctggcaaaaaccccaagaatgtgcaaacaacgccggggaccttcaaaacacctgaaggagaggttggcgctattgccctcgattttaagcccgggacctccggaagccctatcgtcaaccgggaaggcaagattgtgggcctgtacgggaatggagtggtcaccacatctggcacgtatgtgtccgcgatcgctcaggccaaaaccagccaggaggggcccctccccgagattgaagacgaggttttcaagaaaagaaacctgacaatcatggatcttcaccctggatccggcaagacccgccggtacctgccggccatcgtgagagaagctattaaacgcaagctgcggacactcatcctggcccccaccagagtcgtggcgtctgagatggctgaagcccttaaggggatgcctattcgctatcaaacgacagccgttaaaagcgagcataccggccgggagatcgtggacctgatgtgccacgctacctttacaatgagactcctgtcccccgtccgggtgcctaattacaacatgattatcatggatgaagcccatttcaccgaccccgctagcatcgccgcgcgcggatatatttctacaagagttggcatgggggaggccgctgccatctttatgaccgctacgcctccgggatccgtggaagccttcccccagagcaatgccgtcattcaggatgaggaacgggacatccctgagcgctcttggaacagcggctacgattggattacagactttcccgggaagaccgtgtggttcgtgccttccatcaaatctggaaatgacatcgctaactgtctgagaaagaatggcaaacgggtcattcagctcagcagaaagacattcgataccgagtatcaaaagacgaaaaacaacgactgggattacgttgtgaccacagacatctccgaaatgggggcgaattttcgcgccgatcgggtgattgaccccagacgctgccttaagccggtcatcctgaaagatggccctgagcgggtgattctggctggacccatgcccgttaccgtggcctctgccgctcagagacgcggccggatcgggagaaaccagaataaggaaggagaccagtacgtctatatgggccaacctctcaacaatgatgaggaccacgcccattggacagaggcgaaaatgctgcttgataacattaatacccccgaagggatcatccctgctctgttcgagccggaacgcgaaaagagcgccgccattgacggagaatacagactccggggcgaggctcgcaagacatttgtggagctgatgagaagaggggatctgcccgtttggctctcctataaagtggccagcgaaggcttccagtactctgaccgcagatggtgctttgacggagagcggaacaatcaggtccttgaagagaacatggatgtggaaatctggaccaaggagggcgagcgcaagaagctgcgccctcggtggctggacgcgagaacgtattccgatcccctcgccctgcgcgagttcaaagagtttgctgccgggcggagaagcgtctccggagaccttattctggaaatcggcaagctccctcagcacctgacactgcgggctcaaaatgccctcgataaccttgtgatgctgcacaattctgagcaagggggaaaggcttaccgccatgccatggaggaactgcccgacaccattgagaccctcatgctgcttgcgctgatcgccgttctcacaggcggcgtgaccctgttctttctgagcgggaagggactcggcaagacatccatcgggcttctgtgtgtgatggcttctagcgccctgctctggatggctaacgtcgaaccgcactggattgccgcctccatcattctggagttctttcttatggttctgctcatccctgaacccgatagacagcggacgcctcaggacaatcaactggcttatgtggtgattggactcctgttcatcatccttaccgtcgcggccaacgagatgggcctgctggagacaaccaaaaaggatctcgggattggacatgtggctgccgaaagccagcaccacgccacaatgctggacgttgatcttcgccccgcttctgcctggaccctgtacgcggtggccacgaccgtcatcacacctatgatgagacataccattgagaacacaaccgctaatatctccctcacggccattgctaaccaggccgcgatcctgatgggcctggacaaaggctggcccattagcaagatggatatcggggtgccgctccttgccctgggatgctactctcaagtcaatcctctgacactcaccgctgccgtgctgatgcttgttgctcactatgccatcattggccccgggctgcaggctaaagccacacgggaagcgcagaagcgcaccgccgctggaatcatgaagaaccccaccgtggacggcattgtcgccatcgacctcgatcctgtggtttacgacgctaaatttgagaagcagctggggcaaattatgctgctcatcctttgtacatcccagatcctgctgatgagaacgacctgggccctctgcgaaagcattacactggccaccggaccgcttacaaccctgtgggagggctctcccggcaaattctggaatacgacaatcgcggtgagcatggctaacattttccgggggtcctatctcgccggagctggcctggccttttctctgatgaaaagcctcgggggaggccgcagagggaccggagcccagggcgagacccttggcgaaaaatggaagcggcagctgaatcaactgtccaagagcgagttcaacacatacaaaagatccgggatcatggaagtcgatcgctctgaggctaaggaaggactcaaacggggcgagaccacaaagcatgccgtgagcagagggacggcgaaactgcgctggtttgtggagcggaatcttgttaagcctgaaggaaaggtcattgacctgggctgtgggagaggaggctggtcctattactgcgccggcctcaaaaaggtgaccgaggtgaaagggtatacaaagggaggccccgggcacgaggaacctatccccatggctacctacggatggaacctggtcaaactgtactctggcaaggatgttttctttacacctccggaaaaatgtgacaccctcctttgcgatatcggggagagctcccccaatcctacgattgaggaaggacgcaccctgcgggtgctgaagatggtggagccctggctcagaggcaaccagttctgtatcaagattctgaatccttatatgccctctgtcgtggaaacacttgagcagatgcagcgcaaacatggcgggatgctggttcggaacccgctcagcagaaattccacccacgagatgtactgggtgagctgcggaacaggcaacatcgtctctgccgtgaatatgacctcccgcatgctgctgaaccggtttacaatggctcacagaaagcctacctatgaacgcgacgttgatctcggggccggaacgagacatgtggcggtcgagcccgaagtggccaacctggacattatcggccaacggattgagaatatcaaaaacgaacacaagagcacatggcattacgatgaggacaatccctataaaacctgggcttaccacgggtcttatgaggtgaagccttccggaagcgcctcttccatggtcaacggcgttgtgcgccttctgaccaagccctgggacgtgatccctatggtcacacagattgctatgacggataccacaccgttcggccagcaaagagtgtttaaagaaaaggttgacacccggacacccagagccaaacgggggaccgctcagatcatggaggtgacagccaagtggctctggggattcctgagccgcaataaaaagcctagaatttgtacccgggaagagtttacgcgcaaggtcagatccaacgcggccatcggcgctgtgttcgttgatgaaaatcagtggaacagcgccaaagaggctgtggaggacgaacggttttgggatcttgtccaccgcgagagagaactgcataagcaggggaaatgcgctacctgcgtgtacaatatgatgggaaagcgggagaaaaagctcggcgagttcgggaaggccaaaggctctcgcgcgatttggtacatgtggctgggagctagattcctggagtttgaggccctcggcttcatgaacgaagaccactggtttagccgggaaaattccttctctggggttgaaggagagggcctgcataaacttgggtatatcctgcgcgatatcagcaaaattcccggaggcaacatgtacgccgacgatacagctgggtgggacaccagaatcacagaggatgacctccaaaatgaagccaagattaccgatatcatggagcctgaacacgctctgcttgccacgtccatttttaaactgacatatcagaacaaggtggtccgggtgcagcgccccgcgaaaaatggcaccgtcatggacgtgatctctagacgggaccagagaggaagcggccaagttgggacatacggactcaacaccttcacgaacatggaggtgcagctgatccgccagatggaatccgagggcatttttctgccgtctgagctcgaaacccctaatctggccgagcgggtccttgattggctggaaaagcatgggacagagagactcaagcgcatggctatcagcggagacgattgtgtggtgaaacccgttgacgatcggttcgccaccgctctgattgcccttaacgacatgggcaaggtgagaaaagatatccctcagtgggaaccctccaaggggtggaatgactggcaacaggtccctttttgcagccaccacttccatcagctgattatgaaagatggccgcgagatcgtggttccctgtcggaaccaggacgagctcgtgggacgggcgcgcgtctctcaaggcgccgggtggtccctgcgggaaacagcttgcctgggaaagagctatgcccagatgtggcagctcatgtactttcacagacgcgatctgcggcttgctgccaatgctatctgttctgccgtgccggtcgactgggtgcctacctccagaacaacctggagcattcatgcgcaccaccaatggatgacgacagaggacatgctgtccgtttggaaccgggtgtggatcgaagagaatccctggatggaagataagacccatgtctctagctgggaggaggtgccctatctcggcaaaagagaagaccagtggtgcgggtccctgattggacttaccgcccgcgctacatgggccaccaacatccaggttgccattaatcaggtgcggagactgatcggcaacgagaattacctcgattacatgacaagcatgaagcgcttcaaaaacgaatctgaccctgagggggctctgtggtga

SEQ ID NO: 18755 - RNA, 9879 nt, synthetic construct
  misc_feature 1..9879: note = derived and/or modified CDS sequence (opt5) from DENV-1__FJ410184__SS-prME
  source 1..9879: mol_type = other RNA
agcgtgaccatgctgctgatgctgcttcccacagctctggctttccacctcacgacccggggcggggagcctcatatgatcgtctccaagcaggaacggggaaaatctctgctttttaagaccagcgctggcattaacatgtgcaccctgatcgcgatggacctcggggagctgtgtgaagatacaatgacctacaaatgccccagaattacagaggctgaacccgacgatgttgactgttggtgcaatgccaccgatacgtgggtgacctatggaacatgttcccaaaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttattgccctgtttctcgcgcatgccatcgggacatctatcacccagaagggaattatcttcattctgcttatgctggtgacccctagcatggctatgcgctgcgtcggcatcgggaacagagattttgtggagggactctccggcgccacatgggttgacgtggtcctggagcacgggagctgtgtgacgaccatggctaaagataagcccacactggacattgaactcctgaaaaccgaggtgacaaatcctgccgtccttcggaagctgtgcatcgaagcgaaaatttctaacaccacgacagattcccgctgtccgacccaaggagaggccaccctcgttgaggaacaagacgctaatttcgtgtgcagacggacatttgtggatcgcggctggggcaacgggtgtggactgttcggcaaggggagccttctgacctgcgccaagtttaaatgcgtcacaaagctcgagggaaaaatcgtgcagtacgaaaatctgaagtattctgttatcgtgacggtccacaccggcgaccagcatcaagtggggaacgagacaaccgaacacggaacaattgctaccatcacgccccaggcccctacctccgagattcagctgacagactacggcgccctcaccctggattgtagccccagaacaggccttgacttcaatgaaatggttctgctcaccatgaaagagaagtcttggctggtgcataaacagtggtttcttgatctgcctctcccctggacgtccggggctagcacatcccaagagacctggaaccggcaggacctgctggtcacattcaagaccgcgcacgccaagaaacaggaagtggtcgtgctcggatctcaagagggcgctatgcacaccgccctgacaggggccacggaaatccagaccagcggaacaaccacaatttttgctggccatcttaagtgccgcctgaaaatggataagctcaccctgaaagggatgtcctatgttatgtgtacgggcagcttcaagctggagaaggaagtggccgagacacagcacggaaccgtccttgtgcaggttaaatacgagggcaccgacgcgccgtgcaagatccctttctctgctcaagatgaaaaaggggtgacacagaatggaagactcatcaccgccaaccccattgtcacagacaaggagaaacctgtgaatatcgaaacggagccgccctttggcgagtcctatattgtggttggggccggagaaaaggctctgaagctgagctggttcaaaaagggctctagcatcgggaaaatgtttgaggccaccgctcggggcgccagacgcatggcgattctcggagatacagcctgggacttcggctccatcgggggagtctttacctctgtgggcaagctggtgcatcaggtcttcgggacagcttacggagtgctttttagcggcgtttcctggaccatgaaaatcgggattggcatcctgctcacgtggctgggactgaacagccggtctacctcccttagcatgacatgtattgccgtgggcatggtcaccctctacctgggggtgatggttcaggctgattctggatgcgtgatcaattggaagggcagagaactgaagtgtgggtccggaattttcgtcacaaacgaggtgcacacctggacagaacaatataaatttcaggccgacagccctaagcgcctctccgcggccatcggcaaggcttgggaggagggggtttgcggcattcggtctgccaccagactggaaaacatcatgtggaagcagatcagcaatgagcttaaccatattctgctcgaaaatgacatgaaattcacggtggtcgtgggagatgctaacggcatcctggcccaggggaagaaaatgattcgcccgcaacccatggagcaccggtactcctggaagtcttggggaaaggccaaaatcattggcgctgacatccagaatacaacctttatcattgatgggcctgacacccccgaatgtcctgatgaccagagagcgtggaacatctgggaggtggaggattatggattcggcatttttacaaccaatatctggctgaaacttcgcgacagctacacgcagatgtgcgatcaccggctcatgtccgccgctattaaagacagcaaggccgtccatgccgatatgggctattggatcgaatctgagaaaaacgaaacatggaagctggctagagcctccttcatcgaggttaagacctgtatttggcccaaaagccacacactgtggtctaatggggtgctcgaatccgagatgatcattccgaagatctacggaggccctattagccaacataactatcgccccgggtacttcacccagacagcgggaccttggcacctgggcaaacttgagctggactttgatctctgcgaagggaccacggtggtcgtggacgagcactgcggaaatcggggcccctctctgagaaccacaaccgttacaggcaagatcatccatgaatggtgttgccggagctgtaccctgcctccccttcgcttcagaggggaggacggatgctggtacggcatggagattcggccggtgaaagaaagagaggaaaacctcgtcaagtccatggtgagcgctgggctgggagaggttgattctttttccctgggcatcctctgtgtgagcattatgatcgaagaggtcatgcgctcccggtggtctagaaagatgctgatgacggggacacttgccgtgttcctgctcctgattatgggacagctgacctggaatgaccttatccgcctgtgcattatggttggcgccaacgctagcgatagaatgggcatggggacaacctatctcgccctgatggcgacctttaaaatgcggcctatgttcgctgtgggactcctgtttcgcagacttacatcccgggaggtcctgctcctgacgatcggcctgtctcttgtggccagcgtggaactgcccaattccctcgaggaactgggggacggactcgccatgggcatcatgatgctgaaacttctgaccgagttccaaccccaccagctctggacaaccctgctgtctcttacatttattaaaaccacgctgagcctcgattacgcttggaagacaatggccatggtcctgtccatcgttagcctcttccctctgtgtctttctaccacctcccagaaaacaacctggctgccggtgctgctcgggagcctgggatgcaagccccttacaatgtttctgattacggaaaacaagatctggggccgcaaatcttggcctctcaacgagggcattatggctatcgggatcgtgtccattctgctcagctctctgcttaagaatgacgtccccctggccggacctctgatcgcgggcgggatgctcattgcctgttatgtgatctccggaagctccgctgatctgagccttgagaaagccgctgaagtttcttgggaggaagaggccgaacatagcggcacctcccacaacattctggtggaggtccaggacgatgggacaatgaagatcaaagacgaggaaagagatgacaccctcacaatcctgctcaaggccaccctgcttgctgtgtctggagtttaccccatgagcattcctgcgacgctgttcgtgtggtatttttggcagaagaagaagcagcggtccggcgtcctgtgggataccccctctccgcctgaggtggaacgcgccgtcctcgacgacggcatctaccgcattctgcagcgggggcttctgggacgcagccaggtgggcgttggggtgttccaagatggagtcttccatacaatgtggcacgtgaccagaggcgctgttctcatgtatcaggggaaacggctggagccctcctgggcctctgtgaagaaagacctcatcagctacggaggcggctggagatttcagggggcctggaatacaggagaggaagtccaggtgattgctgtggagcctggcaagaaccccaaaaatgttcaaaccacaccggggacgttcaagacccctgaaggagaggtcggcgccatcgcgctggattttaagcccgggacatccggaagccctattgtgaaccgcgaaggcaaaatcgtgggcctttacgggaatggagtcgtgaccacctctggcacatatgtttccgctatcgcccaggccaagacgagccaggaggggtctctgcccgagattgaagacgaggtgttcaaaaagcggaacctgaccatcatggatctccaccccggatccggcaaaacaagacgctacctgcctgctattgtccgggaagccatcaagagaaaacttcgcaccctgattctcgcgccgacacgggtggttgctagcgagatggccgaagccctgaaagggatgcccatcagatatcaaaccacggctgtgaagtccgagcatacaggccgcgagatcgtcgacctgatgtgccacgccacctttaccatgcggctcctttctcctgtgagagttcccaattacaacatgattatcatggatgaagctcatttcacagaccctgccagcattgcggcccggggatatatctccacccgcgtgggcatgggggaggctgccgctatttttatgacagccacaccccctggaagcgtcgaagccttcccgcagtctaatgctgtgatccaggatgaggaaagagacatccccgagcggtcctggaacagcggctacgattggattacggactttcctgggaaaacagtgtggttcgtcccctctatcaagagcggaaatgacattgcgaactgtctgcgcaaaaatggcaagagagttatccagctgtcccggaagacctttgatacagagtatcagaagaccaagaacaacgactgggattacgtggtgacgaccgacatttctgaaatgggggccaatttcagagctgatcgcgtcatcgaccctcggagatgcctcaaacccgtgattctgaaggatggcccggagcgcgttatccttgccggacctatgcccgtgacagtcgccagcgctgcccagcggagaggccgcatcgggcggaaccagaataaagaaggagaccagtacgtgtatatgggccaacccctgaacaatgatgaggaccacgcgcattggaccgaggctaagatgctcctggataacattaatacacctgaagggatcattcccgccctgttcgagcctgaaagagagaagtccgccgctatcgacggagaataccgcctcagaggcgaggcccggaaaacctttgttgagcttatgcgcagaggggatctgccggtgtggctgtcttataaggtcgcgagcgaaggcttccagtactccgaccggcgctggtgctttgacggagagagaaacaatcaggtgctcgaagagaacatggatgtcgaaatttggacaaaagagggcgagcggaagaaactgagaccccgctggcttgacgcccggacctatagcgatcctctggctctcagagagttcaaggagtttgccgctgggcgccggtctgtgtccggagacctgatcctggaaatcggcaaactcccccagcaccttacgctgagagcccaaaatgctctggataacctcgttatgctgcacaatagcgagcaagggggaaaggcctaccggcatgcgatggaagaacttcctgacacaattgagaccctgatgctcctggccctgatcgctgtgctcaccggcggcgtgacacttttctttctgtccgggaagggactgggcaaaacctctattgggctcctgtgtgtcatggccagctccgcccttctgtggatggcctctgttgaaccccactggatcgccgctagcattatcctcgagttctttctgatggtgctgctcatcccggaacctgatcgccagagaacaccccaggacaaccaacttgcgtatgtggtcattggactgctgttcatgatcctcacggtggccgctaatgagatgggcctgcttgagaccacaaagaaagatctggggattggatacgttgccgccgaaaaccatcaccacgctaccatgctcgacgtggatctgcggcctgcctccgcgtggacactgtacgccgtcgctaccacggtgatcacccccatgatgcgccatacaattgagaacaccacagccaatatcagcctcaccgctattgccaaccaggcggccatccttatgggcctggacaagggctggcctatctctaaaatggatattggggtccccctgctcgctctgggatgctattcccaggtgaatccgcttacgctgacagccgctgttctcatgctggtggcccactacgctatcattggccctgggctgcaagccaaggcgaccagagaagcccagaagcggacagctgccggaatcatgaaaaaccccaccgtcgacggcattgtggctatcgacctcgatcccgttgtgtatgacgccaagtttgagaaacagcttgggcagatcatgctgctgattctctgtaccagccaaatcctgcttatgcgcacaacgtgggccctgtgcgaatctattaccctcgcgacaggacctctgaccacactgtgggagggctccccgggcaagttctggaataccacgatcgctgtcagcatggccaacatttttagagggtcttacctcgctggagccggccttgccttcagcctgatgaaatccctcgggggaggccggcgcgggacaggagctcagggcgagaccctcggcgaaaagtggaagagacagctgaatcagctttctaaaagcgagttcaacacctataagcggtccgggatcatggaagtggatagaagcgaggccaaagaaggactgaagcgcggcgagacaaccaaacatgcggtgtcccgggggacagccaagctcagatggtttgttgagcgcaatctggtcaagcccgaaggaaaagtgatcgacctgggctgtgggcggggaggctggtcttactattgcgctggcctcaagaaagtgacggaggtcaaggggtacaccaaaggaggccctgggcacgaggaacccattcctatggccacatacggatggaaccttgttaagctgcatagcggcaaagatgtgttctttacaccccctgaaaagtgtgacaccctgctctgcgatatcggggagtcctctccgaatcccaccattgaggaaggaagaacgctgcgcgtgcttaagatggtcgagccttggctgcggggcaaccaattctgtatcaaaattctcaatccctatatgcctagcgtggttgaaaccctggagcagatgcagagaaagcacggcgggatgctggtgcgcaaccccctctccagaaattctacacacgagatgtactgggtcagctgcggaaccggcaacatcgtgtccgctgttaatatgacaagcagaatgctgcttaaccgctttaccatggcccatcggaaaccgacatatgaaagagacgtggatctgggggcgggaacccgccacgtcgccgtggagcctgaagtggctaacctcgacattatcggccagagaatcgagaatattaagaacgaacataaatctacgtggcactacgatgaggacaatccctataagacatgggcctaccacgggtcctatgaggtcaagcccagcggatctgcttccagcatggttaacggcgtggtgcggctgcttaccaaaccttgggacgtcatccccatggtgacccaaattgccatgacagatacgacccctttcggccagcagcgcgtttttaaggaaaaagtggacacaagaaccccgcgggctaagagagggacagcccaaatcatggaggtcaccgcgaaatggctgtggggattcctctctcggaataagaagccccgcatttgtacaagagaagagtttacccggaaagtgcgctccaacgccgctatcggcgccgttttcgtggatgaaaatcagtggaacagcgctaaggaggccgtcgaggacgaaagattttgggatctggtgcatcgggagcgcgaactgcacaaacaggggaagtgcgccacgtgcgtttacaatatgatgggaaaaagagagaagaagctcggcgagttcgggaaagcgaagggctcccgggctatctggtacatgtggctgggagcccgctttcttgagttcgaggccctgggcttcatgaacgaagaccattggtttagcagagaaaattctttcagcggggtggaaggagagggcctccacaaactggggtatattcttcgggatatctccaagattcctggaggcaacatgtacgctgacgataccgccgggtgggacacacgcatcaccgaggatgacctgcagaatgaagctaaaattacagatatcatggagcccgaacatgccctcctggcgacctctatctttaagctgacgtatcaaaacaaagtcgtgagagtccagcggcctgccaagaatggcacagtgatggacgttattagccgcagagaccagcggggatccggccaggtggggacctacggactcaacacattcaccaacatggaggtccaactgatcagacagatggaatctgagggcatttttcttcccagcgagctggaaacgccgaatctcgctgagcgcgtgctggattggcttgaaaagcacgggaccgagcggctgaaaagaatggccatctccggagacgattgtgtggttaagcctgtggacgatcgcttcgctacagccctcattgcgctgaacgacatgggcaaagtccggaaggatatcccccagtgggaaccttctaaagggtggaatgactggcagcaagtgcccttttgcagccaccatttccaccagctgatcatgaaggatggcagagagattgttgtgccttgtcgcaaccaggacgagctcgtcggacgggccagagtgtcccagggcgctgggtggagcctgcgcgaaaccgcctgccttggaaagtcttatgctcaaatgtggcagctgatgtactttcatcggagagatctccgcctggccgctaatgccatctgttccgcggtccccgtggactgggttccgacaagccggaccacatggtctattcacgcccaccatcagtggatgaccacggaggacatgctttccgtgtggaacagagtctggatcgaagagaatccttggatggaagataaaacacacgtgagctcctgggaggaggttccctatctgggcaagcgggaagaccaatggtgcgggtctctcattggactgaccgctagagccacctgggccacaaacatccaggtggctattaatcaggtccgccggctgatcggcaacgagaattacctcgattacatgaccagcatgaaaagattcaagaacgaatccgaccccgagggggccctgtggtga

SEQ ID NO: 18756 - RNA, 9879 nt, synthetic construct
  misc_feature 1..9879: note = derived and/or modified CDS sequence (opt5) from DENV-1__FJ410185__SS-prME
  source 1..9879: mol_type = other RNA
agcgtgacaatgctgcttatgctgcttcccacagccctggctttccacctcacgaccagaggcggggaacctcatatgatcgtctccaagcaggaacggggaaaatctctgctttttaagacaagcgttggcattaacatgtgcaccctgatcgccatggacctcggggagctgtgtgaagatacaatgacctacaaatgccccagaattacagaggcggaacccgacgatgtggactgttggtgcaatgctaccgatacgtgggtgacctatggaacatgttcccaaaccggcgagcacagacgggacaagcgctctgtcgccctggcccctcatgtggggctcggactggagacaagaaccgaaacgtggatgagctccgagggcgcttggaaacagatccagaaggttgaaacatgggcccttcggcaccccggcttcaccgtgattgctctgtttctcgcccatgcgatcgggacatctatcacccagaagggaattatcttcattctgcttatgctggtcacccctagcatggccatgcgctgcgtgggcatcgggaacagagattttgttgagggactctccggcgctacatgggtggacgtcgtgctggagcacgggagctgtgtgacgaccatggccaaagataagcccacactggacattgaactcctgaaaaccgaggtcacaaatcctgctgttcttcggaagctgtgcatcgaagccaaaatttctaacaccacgacagattcccgctgtccgacccaaggagaggcgaccctcgtggaagaacaggacagcaatttcgtgtgcagacggacatttgtcgatcgcggctggggcaacgggtgtggactgttcggcaaggggtctcttctgacctgcgccaagtttaaatgcgtgacaaagctcgagggaaaaatcgttcagtacgaaaatctgaagtattccgtgatcgtcacggtgcacaccggcgaccagcatcaagttgggaacgagacaaccgaacacggaacaattgctaccatcacgccccaggcccctaccagcgagattcagctgacagactacggcgctctcaccctggattgttctcccagaacaggccttgacttcaatgaaatggtgctgctcaccatgaaagagaagtcctggctggtccataaacagtggtttcttgatctgcctctcccctggacgagcggggcctccacatctcaagagacctggaaccggcaggacctgctggtgacattcaagaccgcccacgctaagaaacaggaagtcgtggttctcggaagccaagagggcgcgatgcacaccgccctgacaggggctacggaaatccagacctccggaacaaccacaatttttgccggccatcttaagtgccgcctgaaaatggataagctcaccctgaaagggatgagctatgtgatgtgtacgggctctttcaagctggagaaggaagtcgccgagacacagcacggaaccgtgcttgttcaggtgaaatacgagggcaccgacgctccgtgcaagatccctttctccgcccaagatgaaaaaggggtcacacagaatggaagactcatcaccgcgaaccccattgtgacagacaaggagaaacctgtgaatatcgaaacggagccgccctttggcgagagctatattgttatcggggctggagaaaaggccctgaagctgtcttggttcaaaaagggcagctccattgggaaaatgtttgaggccaccgctcggggcgccagacgcatggctatcctcggagatacagcctgggacttcggctctatcgggggagtctttaccagcgtgggcaagctggtgcatcaggtcttcggggcggcctacggagtgctcttttccggcgttagctggacaatgaaaattgggatcggcattctgctcacctggctgggactgaactctcggtccacgagcctttctatgacctgtatcgctgtgggcatggtcacactctacctgggggtgatggttcaggccgattccggatgcgtgattaattggaagggcagagaactgaagtgtgggagcggaatcttcgtcaccaacgaggtgcacacatggaccgaacaatataaatttcaggctgactcccctaagcgcctctctgccgcgattggcaaagcctgggaggagggggtttgcggcatccggagcgctacaagactggaaaacatcatgtggaagcagatttccaatgagcttaaccatatcctgctcgaaaatgacatgaaattcaccgtggtcgtgggagatgccaacggcattctggctcaggggaagaaaatgatccgcccgcaacccatggagcaccggtactcttggaaaagctggggaaaggccaagattatcggcgccgacatccagaatacgacatttattatcgatgggcctgacacccccgaatgtcctgatgaccagagagcttggaacatttgggaggtggaggattatggattcggcatctttaccacaaatatttggctgaaacttcgcgactcctacacccagatgtgcgatcaccggctcatgagcgcggccatcaaagactctaaggctgtccatgccgatatgggctattggatcgaatccgagaaaaacgaaacgtggaagctggccagagctagcttcattgaggttaagacatgtatctggcccaaatctcacaccctgtggtccaatggggtgctcgaaagcgagatgattatcccgaagatttacggaggccctatctctcaacataactatcgccccgggtacttcacacagaccgccggaccttggcacctgggcaaacttgagctggactttgatctctgcgaagggacaaccgtggtcgtggacgagcactgcggaaatcggggccccagcctgagaacgaccacagttaccggcaagatcattcatgaatggtgttgccggtcctgtacactgcctccccttcgcttcagaggggaggacggatgctggtacggcatggagatccggccggtgaaagaaaaggaggaaaacctcgtcagaagcatggtgtctgcggggtccggagaggttgatagcttttccctgggcattctgtgtgtgtctatcatgattgaagaggtcatgcgcagccggtggtccagaaagatgctcatgaccgggacgctggctgtgttccttctgctcatcatgggacagctgacatggaatgacctgattcgcctttgcatcatggttggcgccaacgcctctgatagaatgggcatggggaccacatatctggctctcatggccacctttaaaatgcggcctatgttcgcggtgggactgctctttcgcagactgaccagccgggaggtccttctgctcacaatcggcctgtccctggtggcttctgtggaacttcccaatagcctggaggaactcggggacggactggccatgggcattatgatgctcaagctgcttacggagttccaaccccaccagctgtggaccacactcctgtccctgacctttatcaaaacaacccttagcctggattacgcctggcgcacgatggctatggtcctctctattgtttccctgttccctctctgtctgagcacaacctctcagaagaccacatggcttccggtgctgctggggtcctttggatgcaaacccctcaccatgttcctgatcacagaaaacaagatttggggcagaaagagctggcctcttaacgagggcatcatggccatcgggattgtgtctatcctgctctccagcctgctcaaaaatgacgtccccctggctggacctcttattgccggcgggatgctgatcgcgtgttatgtgatttccggaagctctgccgatctgagcctcgagaaggctgccgaagtttcctgggaggaagaggctgaacattctggcacgagccacaacatcctggtggaggtccaggacgatgggaccatgaaaatcaaggacgaggaacgggatgacacacttaccattctgctcaaagccacactgctcgccgtgtccggagtttaccccatgtctatccctgctaccctgtttgtgtggtatttctggcaaaagaaaaagcagcgcagcggcgtcctttgggatacgccctccccgcctgaggtggaaagagcggtcctggacgacggcatttaccggatcctgcagcgcgggctcctgggaagatctcaggtgggcgttggggtgttccaagatggagtctttcataccatgtggcacgtgacacggggcgccgttcttatgtatcaggggaagagactggagcccagctgggcttccgtgaaaaaggacctcattagctacggaggcggctggcgcttccaggggtcttggaataccggagaggaagtccaggtgatcgccgtggagcctggcaaaaaccccaagaatgttcaaacaaccccggggacatttaaaacgcctgaaggagaggtcggcgccattgctctggatttcaagcccgggacctccggaagccctatcgtgaaccgggaagagaagatcgtgggcctctacggcaatggggtcgtgacaacctctggaacctatgtttccgccattgcgcaggctaaaacaagccaggagggccccctgcccgaaatcgaggacgaagtgtttaagaaaagaaaccttacgattatggatctgcaccctgggtccggaaagacccgccggtacctgccggccatcgtcagagaggccattaaacgcaagctccggacactgatccttgctcccaccagagtggttgcctctgaaatggcggaggctctgaagggcatgcctatccgctatcaaacaaccgccgtgaaaagcgagcatacggggcgggaaattgtcgacctcatgtgccacgccacattcaccatgagactgctgtcccccgtgcgggttcctaattacaacatgatcattatggatgaggctcattttaccgaccccgccagcatcgctgcccgcggctatatttctacaagagtgggaatgggcgaagcggccgctatcttcatgaccgccacacctccggggtccgtcgaggcttttccccagagcaatgccgtgatccaggatgaagaacgggacattcctgagcgctcttggaacagcggatacgattggatcaccgacttccccggcaagacggtgtggtttgtcccttccattaaatctgggaatgacatcgccaactgtctcagaaagaatggaaaacgggttattcagcttagcagaaagacattcgataccgaatatcaaaagaccaagaataacgactgggattacgtggtgaccacggacatctccgagatgggcgctaatttccgcgcggatcgggtcattgaccccagacgctgcctgaagccggtgatcctgaaagatgggcctgaacgggttatcctcgccggccccatgcccgtgaccgtcgcttctgccgcccagagacgcggacggattggcagaaaccagaataaggagggggaccagtacgtgtatatgggacaacctctgaacaatgatgaggaccacgctcattggacagaagccaaaatgcttctggataacatcaatacccccgagggcattatccctgcgctctttgaaccggagcgcgaaaagagcgctgccattgacggggagtacagactgcggggagaggcccgcaagacattcgttgaactgatgagacggggcgatctccccgtgtggctttcctataaagtcgctagcgaggggtttcagtactctgaccgcagatggtgcttcgacggcgaacggaacaatcaggtgctggaggaaaacatggatgtcgagatctggaccaaggagggagaacgcaagaagctgcgccctcggtggctcgacgccagaacatattccgatcccctggcgcttcgcgagtttaaagagttcgccgctggccggagaagcgtgtccggggacctgatcctcgagattggaaagctgcctcagcacctgaccctccgggcccaaaatgctcttgataacctggttatgctgcacaattctgaacagggcgggaaagcctaccgccatgctatggaggagctccccgacacgatcgaaacactgatgcttctggccctcattgcggtgctgaccggaggcgtgaccctgtttttcctcagcggcaaggggcttggaaagacatccatcggcctgctgtgtgtcatggcctctagcgctctcctgtggatggccaacgttgagccgcactggattgctgcctccatcatccttgaatttttcctgatggtgctcctgattcctgagcccgatagacagcggacccctcaggacaatcaactggcctatgtggtcatcgggctcctttttatgattctgacagtggctgcgaacgagatgggactgctcgaaacgaccaaaaaggatctgggcatcgggcatgttgccgctgagaaccagcaccacgccacaatgcttgacgtggatctgcgccccgccagcgcttggaccctctacgccgtcgcgacaaccgtgattacgcctatgatgagacataccatcgaaaatacaaccgccaacatttctctgacagctatcgccaatcaggctgccatcctgatgggactcgacaaaggctggcccatttccaagatggatatcggcgtcccgcttctggcgctggggtgctacagccaagtgaaccctctcaccctgacggccgctgttcttatgctggtggcccactatgctattatcggacccggcctccaggccaaagctacacgggaggcccagaagcgcaccgcggccgggattatgaagaatcccacagtcgacggaatcgtggctatcgacctggatcctgttgtgtacgacgccaaattcgaaaagcagctgggccaaattatgctccttatcctgtgtacctctcagattctgctcatgagaaccacatgggctctgtgcgagtccatcacgcttgccaccgggccgctgacaaccctctgggagggaagccccggcaaattttggaacacaaccattgccgtctctatggcgaatatcttccggggcagctatctggctggggccggactggctttctccctcatgaagtctcttggcgggggacgcagaggcacgggggcccagggagaaacactgggcgagaaatggaagcggcagctgaaccaactcagcaagtccgaatttaatacctacaaaagaagcggcatcatggaggtggatcgctccgaagccaaggaggggctgaaacggggagagaccacaaagcatgctgtgtctagaggcaccgccaaacttcgctggttcgttgaacggaacctggtcaagcctgaggggaaggtgattgacctcggatgtggcagagggggatggagctattactgcgcgggcctgaaaaaggtgacagaagtcaaaggctatacgaaagggggacccggccacgaggaacctatccccatggccacctacgggtggaatctggttaaactctactccggaaaggatgtgtttttcacacctccggagaaatgtgacacccttctgtgcgatattggcgagtctagccccaaccctacaatcgaagaggggcgcaccctgcgggtgctcaagatggtcgaaccctggctgagaggaaatcagttttgtattaagatccttaacccttatatgccctccgtggttgagacgctggagcagatgcagcgcaaacatggcggcatgctcgtgcggaatccgctgtctagaaacagcacccacgaaatgtactgggtctcctgcgggacaggaaatattgtgagcgctgttaacatgacctctcgcatgctgctcaaccggttcacaatggcccacagaaagcctacctatgagcgcgacgtggatctgggcgctgggacaagacatgtcgccgtggaacccgaggtggcgaatcttgacatcatcggacaacggattgaaaacatcaaaaatgagcacaagtccacctggcattacgatgaggacaacccctataaaacgtgggcctaccacggcagctatgaagtcaagccttctgggtccgctagctctatggttaatggagtggtgcgcctgctcacaaagccctgggacgtcattcctatggtgacccagatcgccatgaccgatacaacgccgtttggccagcaaagagttttcaaagagaaggtggacacccggacacccagagctaaacggggcaccgcccagattatggaagtcacagctaagtggctgtgggggtttctttcccgcaacaaaaagcctagaatctgtacccgggaggagttcacacgcaaggtgagaagcaatgccgcgatcggagccgtttttgtggatgagaaccagtggaactccgctaaagaggccgtcgaagacgagcggttctgggatctggtgcaccgcgaaagagagctccataagcagggcaaatgcgctacctgcgtttacaacatgatggggaagcgggagaaaaagctgggagagtttggcaaggccaaagggagccgcgccatttggtacatgtggctgggcgcgagattcctcgagttcgaagctctgggatttatgaatgaggaccactggttctctcgggaaaacagcttttccggcgtggagggggagggacttcataagctgggctatatcctccgcgatatttctaaaatccccgggggaaatatgtacgccgacgatacggccggctgggacaccagaattacagaagatgacctgcaaaacgaggctaagatcaccgatatcatggaacctgagcacgcccttctggctacaagcattttcaaactcacctatcagaataaggtcgtgcgggtccagcgccccgccaaaaacgggacggtgatggacgttatctccagacgggaccagagaggctctggacaagtgggcacatacgggctgaacacctttacaaatatggaagtccagctgattcgccagatggagagcgagggaatcttcctcccgtccgaactggagacccctaaccttgcggaacgggtgctggattggctcgagaagcatggcacggaaagactgaagcgcatggccatttctggggacgattgtgtggttaaacccgtggacgatcggtttgctaccgcccttatcgctctgaatgacatgggaaaggtcagaaaagatatccctcagtgggagcccagcaagggctggaacgactggcaacaggtgcctttctgctcccaccactttcatcagctcattatgaaagatgggcgcgagatcgttgtgccctgtcggaatcaggacgaactggtcggcagagcccgcgtgagccaaggagcgggctggtctctgcgggagacagcctgcctcgggaagtcctatgctcagatgtggcagctgatgtacttccacagacgcgatcttcggctggccgctaacgccatttgtagcgctgtcccggtggactgggttcctacctctagaacaacctggtccatccatgcccaccaccaatggatgacaaccgaagacatgctcagcgtgtggaatcgggtctggattgaggaaaacccctggatggaggataagacgcatgtgtcctcttgggaggaagttccctatctgggaaaaagagaggaccagtggtgcggcagccttatcgggctgacagcgcgcgccacctgggctaccaatattcaggtggccatcaaccaggtccggagactcatcggaaatgaaaactacctggattacatgacatccatgaagcgctttaaaaatgagagcgaccctgagggcgccctgtggtga

SEQ ID NO: 18757 - RNA, 9879 nt, synthetic construct
  misc_feature 1..9879: note = derived and/or modified CDS sequence (opt5) from DENV-1__FJ547087__SS-prME
  source 1..9879: mol_type = other RNA
agcgtgacaatgctgctcatgctgcttcccacagctctggctttccacctcacgaccagaggcggggaacctcatatgatcgtctccaagcaggaacggggaaaatctctgctttttaagacaagcgctggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaagaacaggatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagtacgaaaacctgaagtattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagccccagaacaggccttgatttcaacgaaatggtgctgctcaccatgaaagagaagtcttggctggtccataaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcacaccgccctgacaggggccacggaaattcagaccagcggaacaaccacaatctttgctggccatcttaagtgccgcctgaaaatggacaagctcaccctgaaagggatgtcctatgtgatgtgtacgggcagcttcaagctggagaaggaagtcgccgagacacagcacggaaccgtgcttgttcaggtgaaatacgagggcaccgatgcgccgtgcaagattcctttctctacacaagacgaaaaaggggtcacccagaacggaagactcatcacagctaatcccatcgtgacggataaggagaaacctgtgaacattgaaaccgagccgccctttggcgagtcctatatcatggttggggccggagaaaaggccctgaagctgagctggttcaaaaagggctctagcattgggaaaatgtttgaggctacagcccggggcgctagacgcatggccatcctcggagacaccgcgtgggatttcggctccattgggggagtctttacatctgtgggcaagctggtgcatcaggtcttcgggaccgcctacggagtgctttttagcggcgtttcctggacgatgaaaatcgggatcggcattctgctcacctggctgggactgaatagccggtctgcttcccttagcatgacatgtatcgccgtgggcatggtcaccctctacctgggggtgatggttcaggctgactctggatgcgtgattaactggaagggcagagaactgaagtgtgggtccggaatcttcgtcacaaacgaggtgcacacctggacagaacaatataaatttcaggccgatagccctaagcgcctctccgcggccattggcaaggcttgggaggagggggtttgcggcatccggtctgccaccagactggaaaatattatgtggaagcagatcagcaacgagcttaatcatatcctgctcgaaaacgacatgaaattcacggtggtcgtgggagacgctaatggcattctggcccaggggaagaaaatgatccgcccgcaacccatggagcacaagtactcctggaagtcttggggaaaagccaagattatcggcgctgatattcagaacacaacctttatcatcgacgggcctgatacccccgaatgtcctgacgatcagcgggcgtggaatatttgggaggtggaggactatggattcggcatctttacaaccaacatttggctgaaacttagagatagctacacgcagatgtgcgaccaccgcctcatgtccgccgctatcaaggatagcaaagccgtccatgccgacatgggctattggattgaatctgagaagaatgaaacatggaagctggctcgggcctccttcatcgaggttaaaacctgtatctggcccaagagccacacactgtggtctaacggggtgctcgaatccgagatgattatcccgaaaatttacggaggccctatcagccaacataattatagacccgggtacttcacccagacagcgggaccttggcacctgggcaaacttgagctggattttgacctctgcgaagggaccacggtggtcgtggatgagcactgcggaaaccgcggcccctctctgcggaccacaaccgttacaggcaaaattatccatgaatggtgttgcagaagctgtaccctgcctccccttcggttccgcggggaggacggatgctggtacggcatggagatcagaccggtgaaggaaaaggaggaaaatctcgtccggtccatggtgagcgctgggtctggagaggttgactcctttagcctgggcattctgtgtgtgtccatcatgattgaagaggtcatgagatctcgctggagccggaaaatgctcatgacggggacactggccgtgttccttctgctcatcatgggacagctgacctggaacgatctgattagactttgcatcatggttggcgccaatgcttccgaccgcatgggcatggggacaacctatctggccctcatggcgacctttaagatgagacctatgttcgctgtgggactgctctttcggcgcctgacatctagagaggtccttctgctcacgattggcctgagcctggtggcctccgtggaacttcccaactctctggaggaactcggggatggactggccatgggcatcatgatgctcaaactgcttaccgagttccaaccccaccagctgtggacaaccctcctgagcctgacatttatcaagaccacgctttccctggactacgcttggaaaacaatggccatggtcctcagcattgtttctctgttccctctctgtctgtccaccaccagccagaagacaacctggcttccggtgctgctggggtcttttggatgcaagcccctcacaatgttcctgatcacggaaaacaaaatttggggccggaagtcctggcctcttaatgagggcatcatggctattgggatcgtgagcatcctgctctcttccctgctcaaaaacgatgtccccctggccggacctcttattgcgggcgggatgctgatcgcctgttatgtgattagcggatccagcgctgacctgtctctcgagaaggccgctgaagttagctgggaggaagaggccgaacattccggcacctctcacaatatcctggtggaggtccaggatgacgggacaatgaaaattaaggatgaggaacgcgacgatacccttacaatcctgctcaaagccaccctgctcgctgtgagcggagtttaccccatgtccatccctgcgacgctgtttgtgtggtatttctggcaaaagaagaaacagagatctggcgtcctttgggacacccccagcccgcctgaggtggaacgggccgtcctggatgacggcatttaccgcatcctgcagagagggctcctgggacggtcccaggtgggcgttggggtgttccaagacggagtctttcatacaatgtggcacgtgacccgcggcgctgttcttatgtatcaggggaagagactggagccctcttgggccagcgtgaaaaaggatctcatttcctacggaggcggctggcggttccaggggagctggaacacaggagaggaagtccaggtgatcgccgtggagcctggcaaaaatcccaagaacgttcaaaccacaccggggacgtttaagacccctgaaggagaggtcggcgctattgccctggacttcaaacccgggacatctggatcccctatcgtgaatagagaaggcaagattgtgggcctctacgggaacggagtcgtgaccaccagcggcacatatgtttctgcgatcgctcaggccaaagcctcccaggatgggcccctgcccgagatcgaggacgaagtgtttaagaaacgcaatcttacgattatggatctgcaccctggaagcggcaagacccggagatacctgccggctatcgtccgcgaggccattaagcggaaactcagaacactgatccttgcgcccacccgcgtggttgcttccgaaatggccgaggccctgaaggggatgcctattcggtatcaaacaaccgctgtgaaatctgaacatacgggcagagagatcgtcgacctcatgtgccacgccacattcaccatgcgcctgctgagccccgtgcgggttcctaactacaatatgatcattatggatgaggctcattttaccgaccccgcctccatcgcggccagaggatatattagcacacgggtgggcatgggggaagctgccgctatcttcatgaccgccacacctccgggatctgtcgaggcctttccccagtccaacgctgtgattcaggatgaagaaagagacatccctgaaagaagctggaactctggctacgattggatcaccgacttccccgggaagacggtgtggtttgtccctagcattaaatccggaaacgacatcgcgaattgtctccggaagaacggcaagcgcgttattcagctttctagaaaaacattcgataccgagtatcaaaagaccaaaaataatgactgggattacgtggtgaccacggacatcagcgagatgggggccaacttccgggctgatagagtcattgacccccgccggtgcctgaagccggtgatcctgaaagatggccctgaaagagttattctcgccggacccatgcccgtgaccgtcgcctccgctgcccagcgccggggcagaatcgggcgcaatcagaacaaggagggagaccagtacgtgtatatgggccaacctctgaataacgatgaagaccacgcgcattggacagaggctaagatgcttctggataatatcaacacccccgaggggattatccctgccctctttgaaccggagcgggaaaaatctgccgctattgacggagagtacagactgcgcggcgaagccagaaagacattcgttgagctgatgcggcgcggggatctccccgtgtggcttagctataaagtcgcgtccgagggctttcagtacagcgacagacggtggtgcttcgacggagaacgcaataaccaggtgctggaggaaaatatggatgtcgagatctggaccaaggaaggcgagcgcaaaaagctgcggcctagatggctcgacgcccgcacatattctgatcccctggcccttcgggagtttaaagagttcgccgctgggagacgctccgtgagcggagacctgattctcgagatcggcaagctgcctcagcacctgaccatccgggcccaaaacgctctcgataatcttgttatgctgcacaactccgaacaagggggaaaggcctacagacatgcgatggaggaactgcccgacacgattgagacactcatgctgcttgccctgatcgctgtgctcaccggcggcgtgaccctgtttttcctgtctgggaaaggactcggcaagacaagcattgggcttctgtgtgtcatggcctcctctgctctgctctggatggccagcgttgagccgcactggatcgccgcttccattatcctggaatttttccttatggtgctgctcatccctgagcccgatcggcagcgcacccctcaggacaatcaactggcgtatgtggtcattggactgctctttatgatccttacagtggccgctaacgaaatgggcctgctggagacgaccaaaaaggatctcgggattggacatgttgccgccgagaaccaccaccatgctacaatgctggacgtggatcttagacccgccagcgcgtggaccctgtacgccgtcgctacaaccgtgatcacgcctatgatgcggcacaccattgaaaatacaaccgccaacatctctctcacagctattgccaatcaggcggccatcctgatgggcctggacaaaggctggcccatctccaagatggatattggggtcccgctccttgctctgggatgctacagccaggtgaaccctctgaccctcacggccgctgttctgatgcttgtggcccattatgctatcattggccccgggctgcaagccaaggcgacacgcgaggcccagaaaagaaccgctgccggaatcatgaagaatcccacagtcgacggcattgtggctatcgacctcgatcctgttgtgtacgacgccaaattcgaaaagcagctggggcagatcatgctgctcattctttgtacctctcaaatcctgctgatgcggaccacatgggccctctgcgagtccattacgctggcgaccggaccgcttacaaccctgtgggaaggcagccccggcaaattttggaacacaaccatcgctgtctctatggccaatattttccgcgggagctatctcgctggagccggcctggccttctccctgatgaagtctctcgggggaggcagacgggggacgggagctcagggcgagacacttggcgagaagtggaaacgccagctgaaccagctgagcaagtccgaatttaatacctacaaaagaagcgggatcatggaggtggatcggtccgaagccaaggagggactcaaaagaggcgaaaccacaaagcacgcggtgtctcgcgggaccgccaagctgcggtggttcgttgagagaaaccttgtcaaacctgagggaaaggtgatcgacctgggctgtgggcgcggaggctggagctattactgcgctggcctcaaaaaggtgacagaagtcaaagggtatacgaagggaggccccgggcatgaggaacctattcccatggccacctacggatggaatctggttaaactgcactccggcaaggatgtgtttttcacacctccggagaagtgtgacaccctcctttgcgatatcggggaatctagccccaaccctacaattgaggagggacggaccctgagagtgctgaaaatggtcgaaccctggctccgcggcaatcaattttgtatcaagattctgaacccttacatgccctccgtggttgagacgcttgaacagatgcagcggaaacacggcgggatgctggtgagaaatccgctctctcgcaacagcacccatgagatgtattgggtctcctgcggaacaggcaatatcgtgagcgctgttaacatgacctctcggatgctgctgaacagattcacaatggcccaccgcaagcctacctacgagcgggacgtggatctcggggcgggaacaagacatgtcgccgtggaacccgaggtggctaatctggacattatcggccagcgcatcgaaaacattaaaaatgagcacaagtccacctggcactatgatgaagacaacccctacaagacgtgggcctatcatgggagctacgaggtcaaaccttctggatccgctagctctatggttaatggcgtggtgagacttctgacaaagccctgggacgtcatccctatggtgacccaaattgccatgaccgatacaacgccgtttggccagcagcgggttttcaaagagaaggtggacacccgcacacccagagctaaacgggggaccgcccaaatcatggaagtcacagcgaagtggctctggggatttctgtccagaaacaagaaacctcggatttgtacccgcgaggagttcacaagaaaggtgcggagcaatgccgctatcggcgccgtttttgtggatgagaaccagtggaactccgctaaagaagccgtcgaggacgagcgcttctgggatcttgtgcacagagaacgggagctgcataagcaggggaaatgcgcgacctgcgtttataacatgatgggaaagcgcgaaaagaaactcggcgagtttgggaaggccaaaggcagcagagctatctggtacatgtggctgggagcccggttcctggagttcgaggccctcggctttatgaatgaggaccactggttctctcgcgaaaacagcctgtccggggtggagggagaaggccttcataagctggggtacattctcagagatatctctaaaattcccggaggcaatatgtatgctgacgatacggccgggtgggacacccggatcacagaggatgacctgcagaacgaggctaagattaccgatatcatggaacctgagcacgcccttctggcgacaagcatctttaaactcacctaccaaaataaggtcgtgcgcgtccagagacccgccaagaacggcacggtgatggacgttatttcccggcgcgaccagagaggatctggccaggtggggacatatggactgaacaccttcacaaatatggaagtccaactgatccggcagatggagagcgaaggcatttttctcccgtgtgagctggagacccctaaccttgctgaaagagtgctggattggctcgagaaacacggggccgaacgcctgaagcggatggctatctccggagacgattgcgtggttaaacccattgacgatagattcgccacggcgcttatcgccctgaatgacatgggcaaggtgcgcaaagatatccctcagtgggagccctctaaggggtggaacgactggcagcaagtccctttttgtagccatcacttccatcagctcattatgaaggatggccgggaaatcgtggttccctgcagaaatcaggacgagctggtgggacgcgctcgggtctcccagggcgccgggtggagcctgagagagaccgcttgtctcggaaaatcttacgcccaaatgtggcagctgatgtattttcaccgccgggatcttagactggctgccaacgcgatttgctccgccgtgccggtcgactgggtgcctacaagccgcaccacatggtctatccacgctcatcaccagtggatgaccacagaagacatgctctccgtttggaatcgggtgtggattgaggaaaacccctggatggaggataagacccatgtcagctcctgggaagaggtgccctacctgggcaaaagagaggaccaatggtgtgggtctcttatcggactgacggcccgggccacatgggctaccaatattcaggttgccatcaaccaggtgagacgcctcatcggcaatgaaaactatctggattacatgaccagcatgaagcggttcaaaaatgagtccgaccctgaaggggcgctgtggtga

SEQ ID NO: 18758 - RNA, 9879 nt, synthetic construct
  misc_feature 1..9879: note = derived and/or modified CDS sequence (opt5) from DENV-1__FJ410186__SS-prME
  source 1..9879: mol_type = other RNA
agcgtgaccatgctgctcatgctgcttcccacagccctggctttccacctcacgaccagaggcggggagcctcatatgatcgtgtccaagcaggaacggggaaaatctctgctttttaagacaagcgccggcgttaacatgtgcaccctgattgcgatggacctcggggagctgtgtgaagatacaatgacctacaaatgccccagaatcacagaggtggaacccgacgatgtggactgttggtgcaatgctaccgatacgtgggtcacctatggaacatgttcccagaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgcctttttcctggcccatgcgattgggacatctatcacccagaagggaatcatttttatcctcctgatgcttgtgacccctagcatggccatgcgctgcgttggcattgggaacagagatttcgtggagggactgtccggcgctacatgggtcgacgtggtgctcgagcacgggagctgtgtcacgaccatggccaaaaataagcccacactggatatcgaactgctcaaaaccgaggttacaaaccctgctgtgctgcggaaactttgcattgaagccaaaatctctaataccacgacagactcccgctgtccgacccaaggagaggcgaccctggtggaagaacaggatgccaactttgtctgcagacggacattcgtggaccgcggctggggcaatgggtgtggactctttggcaaggggagcctgcttacctgcgctaagttcaaatgcgttacaaagctggagggaaaaattgtgcagtacgaaaacctcaagtattctgtcatcgtgacggttcacaccggcgatcagcatcaagtggggaatgagacaaccgaacacggaacaatcgccaccattacgccccaggctcctacctccgagatccagctgacagactacggcgccctgaccctcgactgtagccccagaacaggcctggattttaacgaaatggtccttctgaccatgaaagagaagtcttggctcgtgcataaacagtggttcctggaccttcctctgccctggacgtccggggccagcacatcccaagagacctggaatcggcaggatctcctggtcacatttaagaccgctcacgcgaagaaacaggaagtggttgtgctgggatctcaagagggcgccatgcacaccgctctcacaggggccacggaaattcagaccagcggaacaaccacaatcttcgccggccatctgaagtgccgccttaaaatggacaagctgaccctcaaagggatgtcctatgtcatgtgtacgggcagcttcaagctggagaaggaagtggctgagacacagcacggaaccgttctggtgcaggtcaaatacgagggcaccgatgccccgtgcaagattcctttttctacacaagacgaaaaaggggtgacccagaacggaagacttatcacagcgaatcccatcgtgacggataaggagaaacctgttaacattgaaaccgagccgcccttcggcgagtcctatatcattgtcggggctggagaaaaggccctcaagctgagctggtttaaaaagggctctagcatcgggaaaatgttcgaggccacagctcggggcgccagacgcatggctattctgggagacaccgcctgggattttggctccatcgggggagtgttcacatctgtgggcaagctcgtccatcaggtgtttgggaccgcgtacggagttctgttcagcggcgtgtcctggacgatgaaaatcgggattggcatccttctgacctggctcggactgaatagccggtctgcctccctgagcatgacatgtattgctgtcggcatggtgaccctttacctcggggttatggtgcaggccgactctggatgcgtcatcaactggaagggcagagaactgaagtgtgggtccggaatttttgtgacaaacgaggttcacacctggacagaacaatataaattccaggctgatagccctaagcgcctgtccgccgcgatcggcaaagcctgggaggagggggtgtgcggcattcggtctgctaccagactcgaaaatatcatgtggaagcagatcagcaacgagctgaatcatattcttctggaaaacgacatgaaatttacggtcgtggtgggagacgccaatggcatcctcgctcaggggaagaaaatgattcgcccgcaacccatggagcacaagtactcctggaagtcttggggaaaagccaagatcattggcgccgatatccagaacacaaccttcatcattgacgggcctgatacccccgaatgtcctgacgatcagcgggcttggaatatctgggaggtcgaggactatggatttggcattttcacaaccaacatctggctgaaactgagagatagctacacgcagatgtgcgaccaccgccttatgtccgcggccattaaggatagcaaagctgttcatgccgacatgggctattggatcgaatctgagaagaatgaaacatggaagctcgcccgggcttccttcatcgaggtgaaaacctgtatttggcccaagagccacacactgtggtctaacggggtgctggaatccgagatgatcattccgaaaatctacggaggccctaccagccaacataattatagacccgggtactttacacagaccgccggaccttggcacctcggcaagctggagcttgatttcgacctgtgcgaagggacgaccgtcgtggttgatgagcactgcggaaaccgcggcccctctctccggacaaccacagtgaccggcaaaattatccatgaatggtgttgcagaagctgtacgctgcctcccctgcggtttcgcggggaggacggatgctggtacggcatggagatcagaccggtcaaggaaaaggaggaaaatcttgtgcggtccatggttagcgcggggtctggagaggtggactccttcagcctcggcattctgtgtgtctccatcatgattgaagaggtgatgagatctcgctggagccggaaaatgctgatgacagggaccctcgctgtttttctgcttctgatcatgggacagctcacatggaacgatctgattagactgtgcatcatggtgggcgccaatgcctccgaccgcatgggcatggggaccacctatcttgctctgatggccacattcaagatgagacctatgtttgcggtcggactcctgttccggcgcctcacgtctagagaggtgctgcttctgaccattggcctcagcctggtggcttccgtcgaactgcccaactctcttgaggaactgggggatggactcgccatgggcatcatgatgctgaaactcctgacagagtttcaaccccaccagctttggaccacactgctcagcctgaccttcatcaagacgacactgtcccttgactacgcctggaaaaccatggctatggttctgagcattgtgtctctctttcctctgtgtctctccaccacaagccagaagaccacatggctgccggtgcttctggggtctttcggatgcaagcccctgacgatgtttctcatcaccgaaaacaaaatttggggccggaagtcctggcctctgaatgagggcatcatggccattgggatcgtcagcatccttctgtcttccctcctgaaaaacgatgtgcccctcgctggacctctgattgccggcgggatgcttatcgcgtgttatgttattagcggatccagcgccgacctgtctctggagaaggctgccgaagtgagctgggaggaagaggctgaacattccggcacatctcacaatatcctcgtcgaggtgcaggatgacgggaccatgaaaattaaggatgaggaacgcgacgatacactgaccatccttctgaaagccacgctcctggccgttagcggagtgtaccccatgtccatccctgctaccctcttcgtctggtatttctggcaaaagaagaaacagagatctggcgtgctgtgggacacacccagcccgcctgaggtcgaacgggcggtgcttgatgacggcatttaccgcatcctgcagagagggctgctcggacggtcccaggttggcgtgggggtctttcaagacggagtgttccataccatgtggcacgttacacgcggcgccgtgctgatgtatcaggggaagagacttgagccctcttgggctagcgtcaaaaaggatctgatttcctacggaggcggctggcggtttcaggggctctggaacaccggagaggaagtccaggtgatcgccgttgagcctggcaaaaatcccaagaacgtccaaacaacgccggggaccttcaagacacctgaaggagaggtgggcgccattgctctggactttaaacccgggaccagcggatctcctatcgtgaatagagaaggcaagattgtcggcctctacgggaacggagtggttaccacatccggcacgtatgtgagcgccatcgcgcaggctaaagcctctcaggaggggcccctgcccgagatcgaagatgaggtcttcaagaaacgcaatcttaccattatggacctgcaccctggatccggcaagacacggagatacctgccggccatcgtgcgcgaagctattaagcggaaactcagaaccctgatccttgcccccacacgcgttgtggcgagcgagatggctgaagccctgaaggggatgcctattcggtatcaaaccacggccgtcaaatccgagcatacaggcagagagatcgtggatctcatgtgccacgctacctttaccatgcgcctgctgtctcccgttcgggtgcctaactacaatatgatcattatggacgaagcccatttcacagatcccgctagcatcgccgcgagaggatatatttccacccgggtcggcatgggggaggccgctgccatctttatgacagctacccctccgggaagcgtggaagccttcccccagtctaacgccgtgattcaggacgaggaacgcgatatccctgagagatcctggaatagcggctacgactggatcacggattttcccgggaagacagtctggttcgttccttctattaaaagcggaaacgacatcgctaattgtctccggaagaacggcaagcgcgtgattcagctttccagaaaaaccttcgacacagagtatcaaaagaccaaaaacaatgattgggactacgtggtcacgaccgatatctctgaaatgggggcgaactttcgggccgacagagtgattgatccccgccggtgcctgaagccggttatcctgaaagacggccctgagagagtgattctcgctggacccatgcccgtcacagtggccagcgccgctcagcgccggggcagaatcgggcgcaatcagaacaaggaaggagatcagtacgtttatatgggccaacctctgaataacgacgaggatcacgcccattggaccgaggcgaagatgcttctggacaatatcaacacacccgaagggattatccctgctctcttcgagccggaacgggagaaatccgccgccattgatggagaatacagactgcgcggcgaggctagaaagacctttgtggagctgatgcggcgcggggacctccccgtctggctttcttataaagtggccagcgaaggcttccagtactccgatagacggtggtgctttgacggagagcgcaataaccaggtcctggaagagaatatggacgtggaaatctggacaaaggagggcgagcgcaagaagctgcggcctagatggctcgatgcgcgcacctatagcgaccccctggcccttcgggagttcaaagagtttgctgccgggagacgctctgtttccggagatctgattctcgaaatcggcaagctgcctcagcacctgacgctccgggctcaaaacgcccttgacaatctggtgatgctgcacaacagcgagcaagggggaaaggcttacagacatgccatggaagaactccccgatacaatcgagaccctgatgcttctggcgctcattgccgtgctgaccggcggcgtcacactgttctttctctccgggaaaggacttggcaagacctctatcgggctgctgtgtgttatggctagctccgccctcctgtggatggcttctgtggaaccgcactggattgccgccagcatcattcttgagttctttctgatggtgctcctgatccctgaacccgaccggcagcgcacacctcaggataatcaactggcttatgtcgtgatcggactccttttcatgattctgacggttgcggccaacgagatgggcctgctcgagaccaccaagaaggacctggggatcggacatgtggctgccgaaaaccaccaccatgccaccatgcttgatgtcgacctgagacccgcttccgcctggacactctacgcggtggccaccacggtcattacccctatgatgcggcacacaatcgagaataccacagctaacattagcctgaccgccatcgctaatcaggccgcgattctgatgggcctcgataaaggctggcccatctctaagatggacatcggggtgccgcttctggccctgggatgctactcccaggttaaccctctcacgctgacagctgccgtgcttatgctggtcgctcattatgccattatcggccccgggctccaagctcgcgccaccagagaagcgcagaagcggacagccgctggaattatgaaaaatcccaccgtggatggcatcgttgccattgacctggaccctgtggtctacgatgctaagtttgagaaacagctggggcagatcatgctccttatcctgtgtaccagccaaattctgctcatgcgcacaacgtgggccctgtgcgaatctatcacccttgccacaggaccgctgaccacactctgggagggctcccccggcaagttctggaacaccacgattgcggtgagcatggctaatatcttcagagggtcttatctggccggagctggcctggcctttagcctcatgaaatcccttgggggaggccggcgcgggacaggagcccagggcgagaccctgggcgaaaagtggaagagacagctgaaccagctctctaaaagcgagttcaatacctacaagcggtccgggattatggaagtggacagaagcgaggctaaagaaggactgaagcgcggcgagacaaccaaacacgccgtttcccgggggacagcgaaacttagatggtttgtcgagcgcaacctggtgaagcctgaaggaaaagtgatcgatctcggctgtgggcggggaggctggtcttattactgcgccggcctgaagaaagtcacggaggttaaggggtataccaaaggaggccccgggcatgaggaacctatccccatggctacatacggatggaatctggtgaagctccacagcggcaaagacgtgttctttacccctccggaaaagtgtgatacacttctgtgcgacattggggagtcctctcccaaccctaccatcgaggaaggaagaacgctgcgcgtcctcaagatggtggagccctggctgcggggcaatcaattctgtattaaaatccttaacccttacatgcccagcgttgtggaaaccctggagcagatgcagagaaagcacggcgggatgctcgtccgcaatccgctgtcccggaactctacacatgagatgtattgggtgagctgcggaaccggcaatattgtttccgccgtgaacatgacaagcagaatgctgctcaaccgctttaccatggctcaccggaaacctacatacgaaagagatgtcgacctgggggccggaacccgccatgtggcggtggagcccgaagtcgccaatcttgatatcattggccagagaatcgagaacatcaagaatgaacacaaatctacgtggcactatgacgaggataacccctacaagacatgggcttatcatgggtcctacgaggttaagcctagcggatctgcctccagcatggtgaatggcgtggtccggctgctcaccaaaccctgggacgtgattcctatggttacccaaatcgctatgacagacacgaccccgttcggccagcagcgcgtgtttaaggaaaaagtcgatacaagaacaccccgggccaagagagggacagctcaaattatggaggtgaccgccaaatggctgtggggattcctttctcggaacaagaagcctcgcatctgtacaagagaagagtttacccggaaagttcgctccaatgcggccattggcgctgtgttcgtcgacgaaaaccagtggaatagcgccaaggaggctgtggaggatgaaagattttgggacctggttcggcgcgagagagaactccacaaacaggggaagtgcgccacgtgcgtgtataacatgatgggaaaacgggagaagaagctgggcgagttcgggaaagccaagggctcccgcgcgatctggtacatgtggctgggagctagattcctcgagtttgaggccctgggcttcatgaatgaagatcattggtttagccgggagaactctcttagcggggtcgaaggagagggcctgcacaaactcgggtacatcctgcgcgacatttccaagatccccggaggcaatatgtatgccgatgacaccgctgggtgggatacaagaattaccgaggacgatcttcagaacgaagccaaaatcacagacattatggagcctgaacatgctctgctcgccacctctatcttcaagctgacgtaccaaaataaagtggtccgggtgcagcgccccgcgaagaacggcacagttatggatgtgatcagcagacgggaccagagaggatccggccaggtcgggacctatggactgaacacatttaccaatatggaggtgcaactcattcgccagatggaatctgagggcatcttcctgccgagcgagcttgaaacgcctaacctggccgagcgggtgctcgactggctggaaaagcacggggctgagagacttaaacgcatggccatttccggagatgactgtgttgtgaagcccgtcgatgaccggtttgctaccgccctgatcgcgctcaatgatatgggcaaagtgagaaaggacattcctcagtgggaaccctctaaagggtggaacgattggcagcaagttcctttctgcagccaccattttcaccagctgatcatgaaggacggccgcgagatcgtggtcccctgtcggaatcaggatgagctggtgggcagagctcgcgtctcccagggagctgggtggagcctccgggaaacagcctgcctgggaaagtcttacgctcaaatgtggcagcttatgtatttccatagacgcgacctgcggctcgccgctaacgccatttgttccgcggatccggtggactgggttcctaccagcagaacaacctggtctatccacgcccaccatcagtggatgacaaccgaggacatgctgtccgtgtggaatcgggtctggattgaagagaacccctggatggaagataaaacgcacgtgagctcctgggaggaggttccctaccttggcaagagagaagaccaatggtgcgggtctctgatcggactcacagctcgcgccacctgggccaccaatattcaggtggctatcaaccaggtccggagactgattggcaatgagaactatctggattacatgatcagcatgaaacgctttaagaatgaatccgaccctgagggggccctctggtga

SEQ ID NO: 18759 - RNA, 9879 nt, synthetic construct
  misc_feature 1..9879: note = derived and/or modified CDS sequence (opt5) from DENV-1__FJ410187__SS-prME
  source 1..9879: mol_type = other RNA
agcgtgaccatgctgcttatgctgcttcccaccgctctggctttccacctcacgaccagaggcggggagcctcatatgatcgtctccaagcaggaacggggaaagtctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatttacggaggccctatcagccaacataactatcgccccgggtacttcacacagaccgcgggaccttggcacctgggcaaacttgagctggactttgatctctgcgaagggacaaccgtggtcgtggacgagcactgcggaaatcggggcccctccctgagaacgaccacagttaccggcaagattatccatgaatggtgttgccggagctgtacactgcctccccttcgcttcagaggggaggacggatgctggtacggcatggagatccggccggtgaaagaaaaggaggaaaacctcgtcagatctatggtgtccgctgggagcggagaggttgattccttttctctgggcattctgtgtgtgagcatcatgattgaagaggtcatgcgctcccggtggtctagaaagatgctcatgaccgggacgctggccgtgttccttctgctcatcatgggacagctgacatggaatgacctgattcgcctttgcatcatggttggcgccaacgctagcgatagaatgggcatggggaccacatatctggccctcatggcgacctttaaaatgcggcctatgttcgctgtgggactgctctttcgcagactgacctcccgggaggtccttctgctcacaattggcctgtctctggtggccagcgtggaacttcccaattccctggaggaactcggggacggactggccatgggcatcatgatgctcaagctgcttacggagttccaaccccaccagctgtggaccacactcctgagcctgacctttatcaaaacaaccctttctctggattacgcttggcgcacgatggccatggtcctctccattgttagcctgttccctctctgtctgtctacaacctcccagaagaccacatggcttccggtgctgctggggagctttggatgcaaacccctcaccatgttcctgatcacagaaaacaagatttggggcagaaagtcttggcctcttaacgagggcatcatggctattgggatcgtgtccatcctgctcagctccctgctcaaaaatgacgtccccctggccggacctcttattgcgggcgggatgctgatcgcctgttatgtgattagcggatctagcgctgatctgtccctcgagaaggccgctgaagtttcttgggaggaagaggccgaacatagcggcacgtcccacaacatcctggtggaggtccaggacgatgggaccatgaaaattaaggacgaggaacgggatgacacacttaccatcctgctcaaagccacactgctcgctgtgtctggagtttaccccatgagcatccctgcgaccctgtttgtgtggtatttctggcaaaagaaaaagcagcgctccggcgtcctttgggatacgccctctccgcctgaggtggaaagagccgtcctggacgacggcatttaccggatcctgcagcgcgggctcctgggaagaagccaggtgggcgttggggtgttccaagatggagtctttcataccatgtggcacgtgacacggggcgctgttcttatgtatcaggggaagagactggagccctcctgggccagcgtgaaaaaggacctcatttcttacggaggcggctggcgcttccaggggtcctggaataccggagaggaagtccaggtgatcgccgtggagcctggcaaaaaccccaagaatgttcaaacaaccccggggacatttaaaacgcctgaaggagaggtcggcgctattgccctggatttcaagcccgggaccagcggatctcctatcgtgaaccgggaaggcaagattgtgggcctctacgggaatggagtcgtgacaacctccggcacctatgttagcgcgatcgctcaggccaaaacatcccaggaggggcccctgcccgagatcgaagaggaagtgtttaagaaaagaaaccttacgattatggacctgcaccctggatctggcaagacccgccggtacctgccggccatcgtcagagaggctattaaacgcaagctccggacactgatccttgcccccaccagagtggttgcgagcgaaatggctgaggccctgaaggggatgcctattcgctatcaaacaaccgccgtgaaatccgagcatacgggccgggaaatcgtcgatctcatgtgccacgctacattcaccatgagactgctgagccccgtgcgggttcctaattacaacatgatcattatggacgaggcccattttaccgatcccgcttctatcgccgcgcgcggatatatttccacaagagtgggcatgggggaagccgctgccatcttcatgaccgctacacctccgggaagcgtcgaggcctttccccagtctaatgccgtgattcaggacgaagaacgggatatccctgagcgcagctggaactccggctacgactggatcaccgatttccccgggaagacggtgtggtttgtcccttctattaaaagcggaaatgacatcgctaactgtctcagaaagaatggcaaacgggttattcagctttccagaaagacattcgacaccgaatatcaaaagacacgcaacaacgattgggactacgtggtgaccacggatatctctgagatgggggcgaatttccgggccgacagagtcattgatccccgccggtgcctgaaaccggtgatcctgaaggacggccctgaaagagttattctcgctggacccatgcccgtgaccgtcgccagcgccgctcagcgccggggcagaatcgggcgcaaccagaataaagagggagatcagtacgtgtatatgggccaacctctgaacaatgacgaggatcacgcccattggacagaagcgaagatgcttctggacaacatcaatacccccgaggggattatccctgctctctttgaaccggagagagaaaaatccgccgccattgatggagagtaccggctgcgcggcgaggctagaaagacattcgttgaactgatgcggcgcggggacctccccgtgtggcttagctataaggtcgcctctgagggctttcagtactccgatagacggtggtgcttcgacggagaaagaaacaatcaggtgctggaggaaaacatggacgtcgagatctggaccaaagagggcgaacgcaagaaactgcggcctagatggctcgatgcgcgcacatatagcgaccccctggcccttcgggagtttaaggagttcgctgccgggagacggtccgtgtctggagatctgattctcgagatcggcaaactgcctcagcacctgaccctccgcgctcaaaatgcccttgacaacctggttatgctgcacaatagcgaacaagggggaaaggcttacagacatgccatggaggagctccccgatacgatcgaaacactgatgcttctggcgctcattgccgtgctgaccggcggcgtgaccctgtttttcctctccgggaaaggacttggcaagacatctatcgggctgctgtgtgtcatggctagctccgccctcctgtggatggctaacgttgagccgcactggattgccgccagcatcattcttgaatttttcctgatggtgctcctgatccctgagcccgaccggcagcgcacccctcaggataatcaactggcttatgtggtcatcggactcctttttatgattctgacagtggcggccaacgagatgggcctgctcgaaacgaccaagaaagacctggggatcggacatgttgctgccgagaaccagcaccacgccacaatgcttgatgtggacctgagacccgcttctgcctggaccctctacgcggtcgccacaaccgtgattacgcctatgatgcggcataccatcgaaaatacaaccgctaacatttccctgacagccatcgctaatcaggccgcgattctgatgggcctcgataagggctggcccatcagcaaaatggacatcggggtcccgcttctggccctgggatgctactctcaagtgaaccctctcaccctgacggctgccgttcttatgctggtggctcactatgccattatcggccccgggctccaggctaaggccacacgcgaggcgcagaaaagaaccgccgctggaattatgaagaatcccacagtcgatggcatcgtggccattgacctggaccctgttgtgtacgatgctaagttcgaaaaacagctggggcaaatcatgctccttatcctgtgtacctcccagattctgctcatgcggaccacatgggccctgtgcgagagcatcacgcttgccaccggaccgctgacaaccctctgggagggctctcccggcaagttttggaacacaaccattgcggtcagcatggctaatatcttccgcgggtcctatctggccggagctggcctggccttctctctcatgaaaagccttgggggaggcagacgggggacgggagcccagggcgaaacactgggcgagaagtggaaaagacagctgaaccaactctccaagagcgaatttaatacctacaagcgctccgggattatggaggtggaccggtctgaagctaaagagggactgaagagaggcgagaccacaaaacatgccgtgagccgcgggaccgcgaaacttcggtggttcgttgaaagaaacctggtcaaacctgagggaaaggtgatcgatctcggctgtgggcgcggaggctggtcctattactgcgccggcctgaagaaagtgacagaagtcaaggggtatacgaaaggaggccccgggcacgaggaacctatccccatggctacctacggatggaatctggttaagctctactctggcaaagacgtgtttttcacacctccggagaagtgtgatacccttctgtgcgacattggggagagctcccccaaccctacaatcgaagagggacggaccctgagagtgctcaaaatggtcgaaccctggctgcgcggcaatcagttttgtattaagatccttaacccttatatgccctctgtggttgagacgctggagcagatgcagcggaagcatggcgggatgctcgtgagaaatccgctgagccgcaactccacccacgaaatgtactgggtcagctgcggaacaggcaatattgtgtctgccgttaacatgacctcccggatgctgctcaacagattcacaatgacccaccgcaaacctacatatgagagagatgtggacctgggggctggaacccggcatgtcgccgtggaacccgaggtggcgaatcttgatatcattggccaacgcatcgaaaacatcaagaatgagcacaaaagcacgtggcattacgacgaggataacccctataagacatgggcctaccacgggtcttatgaagtcaaaccttccggaagcgcttcttccatggttaatggcgtggtgagactgctcaccaagccctgggacgtcattcctatggtgacccagatcgccatgacagacacgaccccgtttggccagcaacgggttttcaaggagaaagtggatacaagaacaccccgggctaagcgcgggacagcccagattatggaagtcaccgctaaatggctgtggggatttcttagcagaaacaagaaacctcggatctgtacacgcgaggagttcaccagaaaggtgcggtccaatgccgcgattggcgccgtttttgtggacgagaaccagtggaatagcgctaaggaggccgtcgaagatgagcgcttctgggacctggtgcacagagaacgggagctccataaacaggggaagtgcgctacgtgcgtttacaacatgatgggaaaacgcgaaaagaaactgggcgagtttgggaaggccaagggctctagagccatctggtacatgtggctgggagcgcggttcctcgagttcgaagctctgggctttatgaatgaggatcactggttcagccgcgaaaactccttttctggggtggagggagagggccttcataaactggggtatatcctcagagacattagcaagatccccggaggcaatatgtacgccgatgacaccgccgggtgggatacacggattaccgaagacgatctgcaaaacgaggctaaaatcacagacattatggaacctgagcacgcccttctggctacctccatcttcaagctcacgtatcagaataaagtcgtgcgcgtccagagacccgccaagaacggcacagtgatggatgttatctctcggagagaccagcgcggaagcggccaagtggggacctacggactgaacacatttaccaatatggaagtccagctgattcggcagatggagtccgagggcatcttcctcccgtctgaactggagacgcctaaccttgcggaaagagtgctggactggctcgagaaacatgggaccgaacgcctgaagcggatggccattagcggagatgactgtgtggttaagcccgtggatgacagatttgctacagcccttatcgctctgaatgatatgggcaaagtccgcaaggacattcctcagtgggagccctccaaagggtggaacgattggcaacaggtgcctttctgcagccaccactttcatcagctcatcatgaaggacggccgggagatcgttgtgccctgtagaaatcaggatgaactggtcggacgcgcccgggtgtctcaaggcgcggggtggtccctgagagagaccgcctgcctcggaaaaagctatgctcagatgtggcagctgatgtacttccaccgccgggaccttagactggccgctaacgccatttgttctgctgtcccggtggattgggttcctacatcccggaccacatggagcatccatgcccaccaccaatggatgaccacggaagacatgctctccgtgtggaatagagtctggattgaggaaaacccctggatggaggacaagacacatgtgtctagctgggaggaagttccctatctgggcaagcgcgaggatcagtggtgcgggtcccttatcggactgaccgcgcgggccacctgggctacaaatattcaggtggccatcaaccaggtcagacgcctcattggcaatgaaaactacctggactacatgaccagcatgaaaagatttaagaatgagtctgatcctgagggggccctgtggtga

SEQ ID NO: 18760 - RNA, 9879 nt, synthetic construct
  misc_feature 1..9879: note = derived and/or modified CDS sequence (opt5) from DENV-1__FJ478457__SS-prME
  source 1..9879: mol_type = other RNA
agcgtgaccatgctgctcatgctgcttcccacagctctggctttccacctcacgaccagaggcggggagcctcatatgatcgtctccaagcaggaacggggaaagtctctgctttttaagaccagcgccggcgttaacatgtgcaccctgattgcgatggacctcggggagctgtgtgaagataccatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagaaggttgaaacatgggcccttcggcaccccggcttcaccgtgatcgccctgtttctcgcgcatgccattgggacatctatcacccagaagggaatcattttcatcctgcttatgctggtcacccctagcatggctatgcgctgcgtgggcattgggaacagagattttgttgagggactctccggcgccacatgggtggacgtcgtgctggagcacgggagctgtgtgacgaccatggctaaaaataagcccacactggatatcgaactcctgaaaaccgaggtcacaaaccctgccgttcttcggaagctgtgcattgaagcgaaaatctctaataccacgacagactcccgctgtccgacccaaggagaggccaccctcgtggaggaacaagatgctaacttcgtgtgcagacggacatttgtcgaccgcggctggggcaatgggtgtggactgttcggcaaggggagccttctgacctgcgccaagtttaaatgcgtgacaaagctcgagggaaaaattgttcagcacgaaaacctgaagtactctgtgatcgtcacggtgcataccggcgatcagcaccaagttgggaatgagacaaccgaacatggaacaatcgctaccattacgccccaggcccctacctccgagatccagctgacagactatggcgccctcaccctggactgtagccccagaacaggccttgatttcaacgaaatggtgctgctcaccatgaaagagaagtcttggctggtccacaaacagtggtttcttgacctgcctctcccctggacgtccggggctagcacatcccaagagacctggaatcggcaggatctgctggtgacattcaagaccgcgcacgccaagaaacaggaagtcgtggttctcggatctcaagagggcgctatgcataccgccctgacaggggccacggaaattcagaccagcggaacaaccacaatctttgctggccaccttaagtgccgcctgaaaatggacaagctcaccctgaaagggatgtcctacgtgatgtgtacgggcagcttcaagctggagaaggaagtcgccgagacacagcatggaaccgtgcttgttcaggtgaaatatgagggcaccgatgcgccgtgcaagattcctttctctacacaagacgaaaaaggggtcacccagaacggaagactcatcacagctaatcccatcgtgacggataaggagaaacctgtgaacattgaaaccgagccgccctttggcgagtcctacatcgttgtcggggccggagaaaaggccctgaagctgagctggttcaaaaagggctctagcattgggaaaatgtttgaggctacagcccggggcgctagacgcatggccatcctcggagacaccgcgtgggatttcggctccattgggggaatgtttacatctgtgggcaagctggtgcaccaggtcttcgggaccgcctatggagtgctttttagcggcgtttcctggacgatgaaaatcgggatcggcattctgctcacctggctgggactgaatagccggtctacatcccttagcatgacctgtatcgctgtgggcatggtcacactctacctgggggtgatggttcaggccgactctggatgcgtgattaactggaagggcagagaactgaagtgtgggtccggaatcttcgtcaccaacgaggtgcatacatggaccgaacaatacaaatttcaggctgatagccctaagcgcctctccgccgcgattggcaaagcctgggaggagggggtttgcggcatccggtctgctacgagactggaaaatattatgtggaagcagatcagcaacgagcttaatcacatcctgctcgaaaacgacatgaaattcacagtggtcgtgggagacgcctccggcattctggctcaggggaagaaaatgatccgcccgcaacccatggagcacaagtattcttggaaaagctggggaaaggccaagattatcggcgccgatattcagaataccacctttatcatcgacgggcctgatacacccgaatgttccgacgatcagcgggcttggaacatttgggaggtggaggactacggattcggcatctttaccacgaatatttggctgaaacttagagatagctatacacagatgtgcgaccatcgcctcatgtctgcggccatcaaggattccaaagctgtccacgccgacatgggctactggattgaaagcgagaagaacgaaacctggaagctggcccgggcttctttcatcgaggttaaaacatgtatctggcctaagtcccataccctgtggagcaatggggtgctcgaatctgagatgattatccccaaaatttatggaggcccgatcagccaacacaactacagacctgggtatttcacacagaccgccggaccctggcacctgggcaaacttgagctggattttgacctctgcgaagggacgaccgtgattgtcgatgagcattgcggaaatcgcggcccttccctgcggacaaccacagtgaccggcaaaatcatccacgaatggtgttgcagaagctgtacgctgccccctcttcggttccgcggggaggacggatgctggtacggcatggagattagacccgttaaggaaaaggaggaaaacctcgtgcggtctatggtctccgcggggagcggagaggtggactccttttctctgggcatcctgtgtgttagcattatgatcgaagaggtgatgagatcccgctggtctcggaaaatgctcatgacagggaccctggctgtcttccttctgctcattatgggacagctgacatggaatgatctgatcagactttgcattatggtgggcgccaacgccagcgaccgcatgggcatggggaccacctacctggctctcatggccacatttaagatgagaccgatgttcgcggttggactgctctttcggcgcctgacgtccagagaggtgcttctgctcaccatcggcctgtctctggtcgctagcgtggaacttcctaattccctggaggaactcggggatggactggccatgggcatcatgatgctcaaactgcttacagagttccaaccccatcagctgtggaccacactcctgagcctgacctttattaagacgacactttctctggactatgcctggaaaaccatggctatggccctctccatcgtgagcctgttccccctctgtctgtctaccacatcccagaagaccacatggcttcctgtcctgctggggagctttggatgcaagccgctcacgatgttcctgattaccgaaaacaaaatctggggccggaagtcttggccccttaacgagggcattatggctatcgggatcgtttccattctgctcagctccctgctcaaaaatgatgtgcctctggccggaccccttatcgcgggcgggatgctgattgcctgttacgtgatcagcggatctagcgctgacctgtccctcgagaaggccgctgaagtctcttgggaggaagaggccgaacacagcggcacatcccataacatgctggtggaggttcaggatgacgggaccatgaaaattaaggatgaggaacgcgacgatacacttaccatcctgctcaaagccacgctgctcgctgtgtctggagtctatcctatgagcatccccgcgaccctgtttgtgtggtacttctggcaaaagaagaaacagagatccggcgttctttgggacacaccttctcccccggaggtggaacgggccgtcctggatgacggcatttatcgcatcctgcagagagggctcctgggacggagccaggtgggcgtcggggtgttccaagacggagtttttcacaccatgtggcacgtgacacgcggcgctgtccttatgtaccaggggaagagactggagccttcctgggccagcgtgaaaaaggatctcatttcttatggaggcggctggcggttccaggggtcctggaataccggagaggaagttcaggtgatcgccgtcgagcccggcaaaaaccctaagaatgtgcaaacaacgcccgggacctttaagacaccggaaggagaggtgggcgctattgccctggacttcaaacctgggaccagcggatctcccatcgttaacagagaaggcaagattgtcggcctctacgggaatggagtggtgaccacatccggcacgtacgtcagcgcgatcgctcaggccaaagcctcccaggaggggcctctgcccgagatcgaagatgaggtgtttcgcaagcggaaccttaccattatggacctgcatcccggatctggcaaaacaagacgctatctgcctgctatcgttcgggaagccattaagagaaagctccgcaccctgatccttgcgccgacacgggtggtcgctagcgagatggccgaagccctgaaagggatgcccattagataccaaaccacggctgtgaagtccgagcacacaggccgcgagatcgttgatctcatgtgccatgccaccttcaccatgcggctgctgagccctgtgagagtccccaattataacatgatcattatggacgaagctcactttacagatcctgcctctatcgcggcccggggatacatttccacccgcgtgggcatgggggaggctgccgctatcttcatgacagccacaccccctggaagcgttgaagcctttccgcagtctaatgctgtgattcaggacgaggaaagagatatccccgagcggagctggaactccggctatgactggatcacggatttccctgggaaaacagtctggtttgtgccctctattaagagcggaaatgacatcgcgaactgtctccgcaaaaatggcaagagagtgattcagctttcccggaagaccttcgacacagagtaccagaagaccaagaacaacgattgggactatgtcgttacgaccgatatctctgaaatgggggccaatttcagagctgaccgcgtgattgatcctcggagatgcctgaaacccgtgatcctgaaggacggcccggagcgcgtcattctcgccggacctatgcccgtgacagttgccagcgctgcccagcggagaggccgcatcgggcggaaccagaataaagaaggagatcagtacgtgtacatgggccaacccctgaacaatgacgaggatcatgcgcactggaccgaggctaagatgcttctggacaacatcaatacacctgaagggattatccccgccctctttgagcctgaaagagagaagtccgccgctattgatggagaatatcgcctgagaggcgaggcccggaaaaccttcgtcgagctgatgcgcagaggggacctcccggtgtggcttagctacaaggttgcgtctgaaggctttcagtattccgatcggcgctggtgcttcgacggagagagaaacaatcaggtgctggaagagaacatggacgtcgaaatctggacaaaagagggcgagcggaagaaactgagaccccgctggctcgatgcccggacctacagcgaccctctggctcttagagaatttaaggagttcgccgctgggcgccggtccgtgtctggagatctgattctcgaaatcggcaaactgccccagcacctgacgctcagagcccaaaatgctcttgacaacctggtcatgctgcataatagcgagcaagggggaaaggcctatcggcacgcgatggaggaactccctgatacaatcgagaccctgatgcttctggccctcattgctgtgctgaccggcggcgttacactgtttttcctctccgggaagggacttggcaaaacctctatcgggctgctgtgtgtgatggccagctccgctctcctgtggatggccagcgtggaaccccattggattgccgcttctatcattcttgagtttttcctgatggtcctcctgatcccggaacctgaccgccagagaacaccccaggataaccaactggcgtacgttgtgatcggactcctttttatgattctgacggtggccgctaatgagatgggcctgctcgagaccacaaagaaagacctggggatcggacacgtcgccgccgaaaaccaccatcacgctaccatgcttgatgtggacctgcggcctgcctccgcgtggacactctatgccgttgctaccacggtgattacccccatgatgcgccatacaatcgagaacaccacagccaatattagcctgaccgctatcgccaaccaggcggccattctgatgggcctcgataagggctggcctatctctaaaatggacatcggggtcccccttctggctctgggatgctactcccaggtgaatccgctcacgctgacagccgctgtccttatgctggtggcccactacgctattatcggccctgggctccaagccaaggcgaccagagaagcccagaagcggacagctgccggaattatgaaaaaccccaccgttgatggcatcgtggctattgacctggaccccgtcgtgtatgatgccaagttcgagaaacagctggggcagatcatgctccttatcctgtgtaccagccaaattctgctcatgcgcacaacgtgggccctgtgcgaatctatcacccttgcgacaggacctctgaccacactctgggagggcagcccgggcaagttttggaataccacgattgctgtttccatggccaacatcttcagagggtcttacctggctggagccggcctggccttcagcctcatgaaatcccttgggggaggccggcgcgggacaggagctcagggcgagaccctgggcgaaaagtggaagagacagctgaatcagctcagcaaatccgagtttaacacctataagcggtctgggattatggaagtggacagaagcgaggccaaagaaggactgaagcgcggcgagacaaccaaacatgcggtctcccgggggacagccaaacttagatggttcgtggagcgcaatctggtgaagcccgaaggaaaagttatcgatctcggctgtgggcggggaggctggtcttactattgcgctggcctgaagaaagtcacggaggtgaaggggtacaccaaaggaggccctgggcacgaggagcccatccctatggccacatatggatggaacctggtgaagctccacagcggcaaagacgtctttttcacaccccctgaaaagtgtgatacacttctgtgcgacattggggagtcctctccgaatcccaccatcgaggaaggaagaacgctgcgcgttctcaagatggtggagccttggctgcggggcaaccaattttgtattaaaatccttaatccctacatgcctagcgtggtcgaaaccctggagcagatgcagagaaagcatggcgggatgctcgtgcgcaaccccctgtcccggaatagcacacacgagatgtactgggtttcttgcggaaccggcaacattgtgtccgctgtcaatatgacaagcagaatgctgctcaaccgcttcaccatggcccatcggaaaccgacatatgaaagagatgtggacctgggggcgggaacccgccacgttgccgtggagcctgaagtcgctaaccttgatatcattggccagagaatcgagaatatcaagaacgaacacaaatctacgtggcattacgacgaggataatccctataagacatgggcctaccacgggtcctatgaggtgaagcccagcggatctgcttccagcatggtgaacggcgtcgttcggctgctcaccaaaccttgggacgtgattcccatggtgacccaaatcgccatgacagacacgaccccttttggccagcagcgcgtcttcaaggaaaaagtggatacaagaaccccgcgggctaagagagggacagcccaagttatggaggtgaccgcgaaatggctgtggggatttctttcccggaataagaagccccgcatttgtacaagagaagagttcacccggaaagtccgcagcaacgccgctatcggcgccgtgtttgttgacgaaaatcagtggaactctgctaaggaggccgtggaggatgaaaaattctgggacctggtccatagagagcgggaactccacaagcaggggaaatgcgccacgtgcgtgtacaatatgatgggaaagcgcgagaagaaactgggcgaatttgggaaggcgaaaggcagcagagctatttggtatatgtggctgggagcccggttcctcgagttcgaggccctgggctttatgaacgaagatcattggttctcccgcgaaaattctcttagcggggttgaaggagagggcctgcacaagctcgggtacatcctgagagacatctccaaaattcctggaggcaacatgtacgctgatgacaccgccgggtgggatacacggatcaccgaggacgatcttcagaatgaagctaagattacagacatcatggagcccgaacacgccctgctcgcgacctctatttttaaactgacgtatcaaaacaaggtggtccgcgtgcagagacctgccaagaatggcacagtcatggatgtgatcagccggcgcgaccagagaggatccggccaggttgggacctacggactgaacacattcaccaacatggaggtgcaactcatccggcagatggaatctgagggcatttttctgcccagcgagcttgaaacgccgaatctggctgagagagtcctcgactggctggaaaaacatgggaccgagcgccttaagcggatggccatctccggagatgactgtgtggtgaaacctattgatgacagattcgctacagccctgatcgcgctcaacgatatgggcaaggttcgcaaagacattccccagtgggaacctagcaaggggtggaatgagtggcagcaagtgcccttttgctctcaccatttccaccagctgatcatgaaggatggccgggagatcgtcgtgccttgtagaaaccaggacgaactggttggacgcgcccgggtgtcccagggcgctgggtggagcctcagagagaccgcctgcctgggaaaatcttatgctcaaatgtggcagcttatgtactttcaccgccgggatctgagactcgccgctaatgccatttgttccgcggtccccgtggactgggtcccgacaagccgcaccacatggtccatccatgcccaccatcagtggatgaccacggaagatatgctgtctgtgtggaaccgggtttggattgaggaaaatccttggatggaggacaagacacacgtgagctcctgggaggaagtcccctatcttggcaaaagagaggaccaatggtgcgggagcctgatcggactcaccgctcgggccacctgggccacaaacattcaggtggctatcaatcaggttagacgcctgattggcaacgaaaattacctggattatatgacctctatgaagcggttcaaaaacgagtccgaccccgagggggccctctggtga

SEQ ID NO: 18761 - RNA, 9879 nt, synthetic construct
  misc_feature 1..9879: note = derived and/or modified CDS sequence (opt5) from DENV-1__FJ410188__SS-prME
  source 1..9879: mol_type = other RNA
agcgtgaccatgctgctcatgctgcttcccacagtcctggccttccacctcacgaccagaggcggggagcctcatatgatcgtttccaagcaggaacggggaaagtctctgctttttaagaccagcgctggcgtgaacatgtgcaccctgattgccatggacctcggggagctgtgtgaagataccatgacctacaaatgcccccgcatcacagaggcggaacccgacgatgtggactgttggtgcaatgctaccgatacgtgggttacctatggaacatgttcccagaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaggaacaagatgccaacttcgtctgcagacggacatttgtggaccgcggctggggcaatgggtgtggactgttcggcaaggggagccttctgacctgcgctaagtttaaatgcgttacaaagctcgagggaaaaattgtgcagcacgaaaacctgaagtactctgtcatcgtgacggttcataccggcgatcagcaccaagtggggaatgagacaaccgaacatggaacaatcgccaccattacgccccaggctcctacctccgagatccagctgacagactatggcgccctcaccctggactgtagccccagaacaggccttgatttcaacgaaatggtcctgctcaccatgaaagagaagtcttggctggtgcacaaacagtggtttcttgacctgcctctcccctggacgtccggggccagcacatcccaagagacctggaatcggcaggatctgctggtcacattcaagaccgctcacgcgaagaaacaggaagtggttgtgctcggatctcaagagggcgccatgcataccgctctgacaggggccacggaaattcagaccagcggaacaaccacaatctttgccggccaccttaagtgccgcctgaaaatggacaagctcaccctgaaagggatgtcctacgtcatgtgtacgggcagcttcaagctggagaaggaagtggctgagacacagcatggaaccgttcttgtgcaggtcaaatatgagggcaccgatgccccgtgcaagattcctttctctacacaagacgaaaaaggggtgacccagaacggaagactcatcacagcgaatcccatcgtgacggataaggagaaacctgttaacattgaaaccgagccgccctttggcgagtcctacatcgtcgtgggggctggagaaaaggccctgaagctgagctggttcaaaaagggctctagcattgggaaaatgtttgaggccacagctcggggcgccagacgcatggctatcctcggagacaccgcctgggatttcggctccattgggggaatgtttacatctgtgggcaagctggtccaccaggtgttcgggaccgcgtatggagttctttttagcggcgtgtcctggacgatgaaaatcgggatcggcattctgctcacctggctgggactgaatagccggtctacatcccttagcatgacctgtatcgccgtcggcatggtgacactctacctgggggttatggtgcaggctgactctggatgcgtcattaactggaagggcagagaactgaagtgtgggtccggaatcttcgtgaccaacgaggttcatacatggaccgaacaatacaaatttcaggccgatagccctaagcgcctctccgctgccattggcaaagcgtgggaggagggggtgtgcggcatccggtctgccacgagactggaaaatattatgtggaagcagatcagcaacgagcttaatcacatcctgctcgaaaacgacatgaaattcacagtcgtggtgggagacgcttccggcattctggcccaggggaagaaaatgatccgcccgcaacccatggagcacaagtattcttggaaaagctggggaaaggctaagattatcggcgccgatattcagaataccacctttatcatcgacgggcctgatacacccgaatgttccgacgatcagcgggcctggaacatttgggaggtcgaggactacggattcggcatctttaccacgaatatttggctgaaacttagagatagctatacacagatgtgcgaccatcgcctcatgtctgctgcgatcaaggattccaaagccgttcacgctgacatgggctactggattgaaagcgagaagaacgaaacctggaagctggcccgggcctctttcatcgaggtgaaaacatgtatctggcctaagtcccataccctgtggagcaatggggtgctcgaatctgagatgattatccccaaaatttatggaggcccgatcagccaacacaactacagacctgggtatttcacacagaccgctggaccctggcacctgggcaaacttgagctggattttgacctctgcgaagggacgaccgtcattgtggatgagcattgcggaaatcgcggcccttccctgcggacaaccacagttaccggcaaaatcatccacgaatggtgttgcagaagctgtacgctgccccctcttcggttccgcggggaggacggatgctggtacggcatggagattagacccgtgaaggaaaaggaggaaaacctcgtccggtctatggtgtccgccgggagcggagaggttgactccttttctctgggcatcctgtgtgtgagcattatgatcgaagaggtcatgagatcccgctggtctcggaaaatgctcatgacagggaccctggcggtgttccttctgctcattatgggacagctgacatggaatgatctgatcagactttgcattatggttggcgctaacgccagcgaccgcatgggcatggggaccacctacctggccctcatggctacatttaagatgagaccgatgttcgccgtgggactgctctttcggcgcctgacgtccagagaggtccttctgctcaccatcggcctgtctctggtggcgagcgtggaacttcctaattccctggaggaactcggggatggactggctatgggcatcatgatgctcaaactgcttacagagttccaaccccatcagctgtggaccacactcctgagcctgacctttattaagacgacactttctctggactatgcctggaaaaccatggccatggctctctccatcgtcagcctgttccccctctgtctgtctaccacatcccagaagaccacatggcttcctgttctgctggggagctttggatgcaagccgctcacgatgttcctgattaccgaaaacaaaatctggggccggaagtcttggccccttaacgagggcattatggccatcgggatcgtgtccattctgctcagctccctgctcaaaaatgatgtgcctctggctggaccccttatcgccggcgggatgctgattgcgtgttacgtcatcagcggatctagcgccgacctgtccctcgagaaggctgccgaagtgtcttgggaggaagaggctgaacacagcggcacatcccataacatgctggttgaggtgcaggatgacgggaccatgaaaattaaggatgaggaacgcgacgatacacttaccatcctgctcaaagccacgctgctcgccgtctctggagtgtatcctatgagcatccccgctaccctgtttgtttggtacttctggcaaaagaagaaacagagatccggcgtgctttgggacacaccttctcccccggaggtcgaacgggcggtgctggatgacggcatttatcgcatcctgcagagagggctcctgggacggagccaggtcggcgtgggggttttccaagacggagtgtttcacaccatgtggcacgtcacacgcggcgccgtgcttatgtaccaggggaagagactggagccttcctgggctagcgttaaaaaggatctcatttcttatggaggcggctggcggttccaggggtcctggaataccggagaggaagtgcaggtcatcgccgtggagcccggcaaaaaccctaagaatgtgcaaacaacgcccgggacctttaagacaccggaaggagaggttggcgccattgctctggacttcaaacctgggaccagcggatctcccatcgtcaacagagaaggcaagattgtgggcctctacgggaatggagtggtcaccacatccggcacgtacgtgagcgccatcgcgcaggctaaagcctcccaggaggggcctctgcccgagatcgaagatgaggtttttcgcaagcggaaccttaccattatggacctgcatcccggatctggcaaaacaagacgctatctgcctgccatcgtgcgggaagctattaagagaaagctccgcaccctgatccttgccccgacacgggtcgtggcgagcgagatggctgaagccctgaaagggatgcccattagataccaaaccacggccgttaagtccgagcacacaggccgcgagatcgtggatctcatgtgccatgctaccttcaccatgcggctgctgagccctgtcagagtgcccaattataacatgatcattatggacgaagcccactttacagatcctgcttctatcgccgcgcggggatacatttccacccgcgttggcatgggggaggccgctgccatcttcatgacagctacaccccctggaagcgtggaagcctttccgcagtctaatgccgtcattcaggacgaggaaagagatatccccgagcggagctggaactccggctatgactggatcacggatttccctgggaaaacagtgtggtttgtgccctctattaagagcggaaatgacatcgctaactgtctccgcaaaaatggcaagagagtcattcagctttcccggaagaccttcgacacagagtaccagaagaccaagaacaacgattgggactatgttgtgacgaccgatatctctgaaatgggggcgaatttcagagccgaccgcgtgattgatcctcggagatgcctgaaacccgtcatcctgaaggacggcccggagcgcgtgattctcgctggacctatgcccgttacagtggccagcgccgctcagcggagaggccgcatcgggcggaaccagaataaagaaggagatcagtacgtctacatgggccaacccctgaacaatgacgaggatcatgcccactggaccgaggcgaagatgcttctggacaacatcaatacacctgaagggattatccccgctctctttgagcctgaaagagagaagtccgccgccattgatggagaatatcgcctgagaggcgaggctcggaaaaccttcgtggagctgatgcgcagaggggacctcccggtttggcttagctacaaggtggcctctgaaggctttcagtattccgatcggcgctggtgcttcgacggagagagaaacaatcaggtcctggaagagaacatggacgtggaaatctggacaaaagagggcgagcggaagaaactgagaccccgctggctcgatgcgcggacctacagcgaccctctggcccttagagaatttaaggagttcgctgccgggcgccggtccgtctctggagatctgattctcgaaatcggcaaactgccccagcacctgacgctcagagctcaaaatgcccttgacaacctggtgatgctgcataatagcgagcaagggggaaaggcttatcggcacgccatggaggaactccctgatacaatcgagaccctgatgcttctggcgctcattgccgttctgaccggcggcgtgacactgtttttcctctccgggaagggacttggcaaaacctctatcgggctgctgtgtgtgatggctagctccgccctcctgtggatggctagcgtcgaaccccattggattgccgcctctatcattcttgagtttttcctgatggttctcctgatcccggaacctgaccgccagagaacaccccaggataaccaactggcttacgtggtgatcggactcctttttatgattctgacggtcgcggccaatgagatgggcctgctcgagaccacaaagaaagacctggggatcggacacgtggctgccgaaaaccaccatcacgccaccatgcttgatgttgacctgcggcctgcttccgcctggacactctatgcggtggccaccacggtcattacccccatgatgcgccatacaatcgagaacaccacagctaatattagcctgaccgccatcgctaaccaggccgcgattctgatgggcctcgataagggctggcctatctctaaaatggacatcggggtgccccttctggccctgggatgctactcccaggtcaatccgctcacgctgacagctgccgtgcttatgctggttgctcactacgccattatcggccctgggctccaagctaaggccaccagagaagcgcagaagcggacagccgctggaattatgaaaaaccccaccgtggatggcatcgtcgccattgacctggaccccgtggtttatgatgctaagttcgagaaacagctggggcagatcatgctccttatcctgtgtaccagccaaattctgctcatgcgcacaacgtgggccctgtgcgaatctatcacccttgccacaggacctctgaccacactctgggagggcagcccgggcaagttttggaataccacgattgcggtgtccatggctaacatcttcagagggtcttacctggccggagctggcctggccttcagcctcatgaaatcccttgggggaggccggcgcgggacaggagcccagggcgagaccctgggcgaaaagtggaagagacagctgaatcagctcagcaaatccgagtttaacacctataagcggtctgggattatggaagtcgacagaagcgaggctaaagaaggactgaagcgcggcgagacaaccaaacatgccgtgtcccgggggacagcgaaacttagatggttcgtggagcgcaatctggttaagcccgaaggaaaagtcatcgatctcggctgtgggcggggaggctggtcttactattgcgccggcctgaagaaagtgacggaggtgaaggggtacaccaaaggaggccctgggcacgaggagcccatccctatggctacatatggatggaacctggtcaagctccacagcggcaaagacgtctttttcacaccccctgaaaagtgtgatacacttctgtgcgacattggggagtcctctccgaatcccaccatcgaggaaggaagaacgctgcgcgtgctcaagatggtggagccttggctgcggggcaaccaattttgtattaaaatccttaatccctacatgcctagcgtcgtggaaaccctggagcagatgcagagaaagcatggcgggatgctcgttcgcaaccccctgtcccggaatagcacacacgagatgtactgggtgtcttgcggaaccggcaacattgtctccgccgtgaatatgacaagcagaatgctgctcaaccgcttcaccatggctcatcggaaaccgacatatgaaagagatgttgacctgggggccggaacccgccacgtggcggtcgagcctgaagtggccaaccttgatatcattggccagagaatcgagaatatcaagaacgaacacaaatctacgtggcattacgacgaggataatccctataagacatgggcttaccacgggtcctatgaggtgaagcccagcggatctgcctccagcatggtcaacggcgttgtgcggctgctcaccaaaccttgggacgtgattcccatggtcacccaaatcgctatgacagacacgaccccttttggccagcagcgcgtgttcaaggaaaaagttgatacaagaaccccgcgggccaagagagggacagctcaagtgatggaggtcaccgccaaatggctgtggggatttctttcccggaataagaagccccgcatttgtacaagagaagagttcacccggaaagtgcgcagcaacgcggccatcggcgctgtttttgtggacgaaaatcagtggaactctgccaaggaggctgtcgaggatgaaaaattctgggacctggtgcatagagagcgggaactccacaagcaggggaaatgcgccacgtgcgtttacaatatgatgggaaagcgcgagaagaaactgggcgaatttgggaaggccaaaggcagcagagcgatttggtatatgtggctgggagctcggttcctcgagttcgaggccctgggctttatgaacgaagatcattggttctcccgcgaaaattctcttagcggggtggaaggagagggcctgcacaagctcgggtacatcctgagagacatctccaaaattcctggaggcaacatgtacgccgatgacaccgctgggtgggatacacggatcaccgaggacgatcttcagaatgaagccaagattacagacatcatggagcccgaacacgctctgctcgccacctctatttttaaactgacgtatcaaaacaaggtcgtgcgcgtccagagacctgcgaagaatggcacagtgatggatgttatcagccggcgcgaccagagaggatccggccaggtggggacctacggactgaacacattcaccaacatggaggtccaactcatccggcagatggaatctgagggcatttttctgcccagcgagcttgaaacgccgaatctggccgagagagtgctcgactggctggaaaaacatgggaccgagcgccttaagcggatggctatctccggagatgactgtgtggttaaacctattgatgacagattcgccacagctctgatcgccctcaacgatatgggcaaggtgcgcaaagacattccccagtgggaacctagcaaggggtggaatgagtggcagcaagtccccttttgctctcaccatttccaccagctgatcatgaaggatggccgggagatcgtggttccttgtagaaaccaggacgaactggtgggacgcgcgcgggtctcccagggcgccgggtggagcctcagagagaccgcttgcctgggaaaatcttatgcccaaatgtggcagcttatgtactttcaccgccgggatctgagactcgctgccaatgctatttgttccgccgtgcccgtcgactgggtgccgacaagccgcaccacatggtccatccatgcgcaccatcagtggatgaccacggaagatatgctgtctgtttggaaccgggtgtggattgaggaaaatccttggatggaggacaagacacacgtcagctcctgggaggaagtgccctatcttggcaaaagagaggaccaatggtgcgggagcctgatcggactcaccgcccgggctacctgggccacaaacattcaggttgccatcaatcaggtgagacgcctgattggcaacgaaaattacctggattatatgacctctatgaagcggttcaaaaacgagtccgaccccgagggggctctctggtga

SEQ ID NO: 18762 - RNA, 9879 nt, synthetic construct
  misc_feature 1..9879: note = derived and/or modified CDS sequence (opt5) from DENV-1__FJ478458__SS-prME
  source 1..9879: mol_type = other RNA
agcgtgaccatgctgcttatgctgcttcccacagctctggctttccacctcacgaccagaggcggggaacctcatatgatcgtctccaagcaggaacggggaaaatctctgctttttaagacaagcgccggcattaatatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccattcttcggaagctgtgcatcgaagcgaaaatttctaacacgacaaccgattcccgctgtccgacccaaggagaggccacactcgtcgaagaacaggacagcaatttcgtttgcagacggacctttgtggatcgcggctggggcaacgggtgtggactgttcggcaaggggtctcttctgacatgcgctaagtttaaatgcgtgacgaagctcgagggaaaaatcgtccagtacgaaaatctgaagtattccgtgatcgttaccgtgcacacaggcgaccagcatcaagtcgggaacgagaccacagaacacggaaccattgccacgatcacaccccaggctcctacaagcgagattcagctgaccgactacggcgccctcacactggattgttctcccagaaccggccttgacttcaatgaaatggtgctgctcacgatgaaagagaagtcctggctggttcataaacagtggtttcttgatctgcctctcccctggacaagcggggcctccacctctcaagagacatggaaccggcaggacctgctggtgaccttcaagaccgctcacgcgaagaaacaggaagtcgtggtcctcggaagccaagagggcgccatgcacacagctctgacgggggccaccgaaatccagacatccggaaccacaaccatttttgccggccatcttaagtgccgcctgaaaatggataagctcacgctgaaagggatgagctatgtgatgtgtacaggctctttcaagctggagaaggaagttgctgagacccagcacggaaccgtgcttgtccaggtgaaatacgagggcacagacgccccgtgcaagatccctttctccgcgcaagatgaaaaaggggttacccagaatggaagactcatcacagctaaccccattgtgacggacaaggagaaacctgtcaatatcgaaaccgagccgccctttggcgagagctatattgtggtgggggccggagaaaaggccctgaagctgtcttggttcaaaaagggcagctccatcgggaaaatgtttgaggctacagcccggggcgctagacgcatggccattctcggagataccgcgtgggacttcggctctatcgggggagtttttacaagcgtcggcaagctggtgcatcaggtgttcggggccgcttacggagtcctcttttccggcgtgagctggaccatgaaaatcgggattggcatcctgctcacgtggctgggactgaactctcggtccaccagcctttctatgacatgtattgccgttggcatggtgaccctctacctgggggtcatggtgcaggctgattccggatgcgttatcaattggaagggcagagaactgaagtgtgggagcggaattttcgtgacaaacgaggtccacacctggacagaacaatataaatttcaggccgactcccctaagcgcctctctgcggccatcggcaaggcttgggaggagggggtgtgcggcattcggagcgccaccagactggaaaacatcatgtggaagcagatctccaatgagcttaaccatattctgctcgaaaatgacatgaaattcacggttgtggtcggagatgctaacggcatcctggcccaggggaagaaaatgattcgcccgcaacccatggagcaccggtactcttggaaaagctggggaaaggccaagatcattggcgctgacatccagaatacaacctttatcattgatgggcctgacacccccgaatgtcctgatgaccagagagcgtggaacatctgggaggtggaggattatggattcggcatttttacaaccaatatctggctgaaacttcgcgactcctacacgcagatgtgcgatcaccggctcatgagcgccgctattaaagactctaaggccgtgcatgccgatatgggctattggatcgaatccgagaaaaacgaaacatggaagctggctagagccagcttcatcgaggtcaagacctgtatttggcccaaatctcacacactgtggtccaatggggttctcgaaagcgagatgatcattccgaagatctacggaggccctatttctcaacataactatcgccccgggtacttcacccagacagcgggaccttggcacctgggcaaacttgagctggactttgatctctgcgaagggaccacggtggtggtcgacgagcactgcggaaatcggggccccagcctgagaaccacaaccgtgacaggcaagatcatccatgaatggtgttgccggtcctgtaccctgcctccccttcgcttcagaggggaggacggatgctggtacggcatggagattcggccggttaaagaaaaggaggaaaacctcgtgagaagcatggtctctgctgggtccggagaggtggatagcttttccctgggcatcctgtgtgtttctattatgatcgaagaggtgatgcgcagccggtggtccagaaagatgctcatgacggggacactggccgtcttccttctgctcattatgggacagctgacctggaatgacctgatccgcctttgcattatggtgggcgccaacgcttctgatagaatgggcatggggacaacctatctggccctcatggcgacctttaaaatgcggcctatgttcgctgttggactgctctttcgcagactgacaagccgggaggtgcttctgctcacgatcggcctgtccctggtcgcctctgtggaacttcccaatagcctggaggaactcggggacggactggccatgggcatcatgatgctcaagctgcttaccgagttccaaccccaccagctgtggacaaccctcctgtccctgacatttattaaaaccacgcttagcctggattacgcttggcgcacaatggccatggtgctctctatcgcttccctgttccctctctgtctgagcaccacctctcagaagacaacctggcttccggtcctgctggggtcctttggatgcaaacccctcacaatgttcctgattacggaaaacaagatctggggcagaaagagctggcctcttaacgagggcattatggccatcgggatcgtttctattctgctctccagcctgctcaaaaatgacgtgcccctggcgggacctcttatcgccggcgggatgctgattgcttgttatgtgatctccggaagctctgccgatctgagcctcgagaaggctgccgaagtctcctgggaggaagaggccgaacattctggcaccagccacaacattctggtggaggttcaggacgatgggacaatgaaaatcaaggacgaggaacgggatgacacccttacaatcctgctcaaagctaccctgctcgcggtgtccggagtctaccccatgtctattcctgccacgctgtttgtgtggtatttctggcaaaagaaaaagcagcgcagcggcgttctttgggataccccctccccgcctgaggtggaaagagctgtcctggacgacggcatctaccggattctgcagcgcgggctcctgggaagatctcaggtgggcgtcggggtgttccaagatggagtttttcatacaatgtggcacgtgacccggggcgccgtccttatgtatcaggggaagagactggagcccagctgggcctccgtgaaaaaggacctcatcagctacggaggcggctggcgcttccaggggtcttggaatacaggagaggaagttcaggtgattgctgtcgagcctggcaaaaaccccaagaatgtgcaaaccacaccggggacgtttaaaacccctgaaggagaggtgggcgccatcgcgctggatttcaagcccgggacatccggaagccctattgttaaccgggaaggcaagatcgtcggcctctacgggaatggagtggtgaccacctctggcacatatgtctccgctatcgcccaggccaaaacgagccaggaggggcccctgcccgagattgaagaggaagtgtttaagaaaagaaaccttaccatcatggacctgcaccctggatccggcaagacacgccggtacctgccggctattgttagagaggccatcaaacgcaagctccggaccctgattcttgcgcccacaagagtggtcgcttctgaaatggccgaggccctgaaggggatgcctatccgctatcaaaccacggctgtgaaaagcgagcatacaggccgggaaatcgttgatctcatgtgccacgccaccttcaccatgagactgctgtcccccgtgcgggtccctaattacaacatgattatcatggacgaggctcattttacagatcccgccagcattgcggcccgcggatatatctctaccagagtgggcatgggggaagctgccgctattttcatgacagccacccctccgggatccgttgaggcctttccccagagcaatgctgtgatccaggacgaagaacgggatatccctgagcgctcttggaacagcggctacgactggattacggatttccccgggaagacagtctggtttgtgccttccatcaaatctggaaatgacattgcgaactgtctcagaaagaatggcaaacgggtgatccagcttagcagaaagaccttcgacacagaatatcaaaagaccaaaaacaacgattgggactacgtcgttacgaccgatatttccgagatgggggccaatttccgcgctgaccgggtgatcgatcccagacgctgcctgaagccggtgattctgaaagacggccctgaacgggtcatcctcgccggacccatgcccgtgacagttgcctctgctgcccagagacgcggccggatcgggagaaaccagaataaggagggagatcagtacgtgtatatgggccaacctctgaacaatgacgaggatcacgcgcattggaccgaagctaaaatgcttctggacaacattaatacacccgaggggatcattcctgccctctttgaaccggagcgcgaaaagagcgccgctatcgatggagagtacagactgcggggcgaggcccgcaagaccttcgtcgaactgatgagaagaggggacctccccgtgtggctttcctataaagttgcgagcgagggctttcagtactctgatcgcagatggtgcttcgacggagaacggaacaatcaggtgctggaggaaaacatggacgtcgagatttggacaaaggagggcgaacgcaaaaagctgcgccctcggtggctcgatgccagaacctattccgaccccctggctcttagagagtttaaagagttcgccgctgggcggagaagcgtgtccggagatctgatcctcgagatcggcaagctgcctcagcacctgacgctccgggcccaaaatgctcttgacaacctggtcatgctgcacaattctgaacaagggggaaaagcctaccgccatgcgatggaggagctccccgatacaattgaaaccctgatgcttctggccctcatcgctgtgctgaccggcggcgttacactgtttttcctcagcgggaagggacttggcaagacctccattgggctgctgtgtgtgatggcctctagcgctctcctgtggatggccaacgtggagccgcactggatcgccgcttccattatccttgaatttttcctgatggtcctcctgatccctgagcccgacagacagcggacacctcaggataatcaactggcgtatgttgtgattggactcctttttatgatcctgacggtggccgctaacgagatgggcctgctcgaaaccaccaaaaaggacctggggattggacatgtcgccgccgagaaccagcaccacgctaccatgcttgatgtggacctgcgccccgccagcgcgtggacactctacgccgttgctaccacggtgatcacccctatgatgagacatacaattgaaaataccacagccaacatctctctgaccgctattgccaatcaggcggccatcctgatgggcctcgataaaggctggcccatctccaagatggacattggggtcccgcttctggctctgggatgctacagccaagtgaaccctctcacgctgacagccgctgtccttatgctggtggcccactatgctatcattggccccgggctccaggccaaagcgacccgggaggcccagaagcgcacagctgccggaatcatgaagaatcccaccgttgatggcattgtggctatcgacctggaccctgtcgtgtacgatgccaaattcgaaaagcagctggggcaaatcatgctccttattctgtgtacctctcagatcctgctcatgagaacaacgtgggccctgtgcgagtccattacccttgcgacaggaccgctgaccacactctgggagggcagccccggcaaattttggaacaccacgatcgctgtttctatggccaatattttccgggggagctatctggctggagccggcctggccttctccctcatgaagtctcttgggggaggccgcagagggacaggagctcagggcgaaaccctgggcgagaaatggaagcggcagctgaaccaactcagcaagtccgaatttaatacctacaaaagaagcgggatcatggaggtggaccgctccgaagccaaggagggactgaaacggggcgagacaaccaagcatgcggtctctagagggacagccaaacttcgctggttcgtggaacggaacctggtgaagcctgagggaaaggttatcgatctcggctgtgggagaggaggctggagctattactgcgctggcctgaaaaaggtcacggaagtgaaagggtataccaagggaggccccgggcacgaggaacctattcccatggccacatacggatggaatctggtgaaactctactccggcaaggacgtctttttcacccctccggagaaatgtgatacacttctgtgcgacatcggggagtctagccccaaccctaccattgaagagggacgcacgctgcgggttctcaagatggtggaaccctggctgagaggcaatcagttttgtatcaagattcttaacccttatatgccctccgtggtcgagaccctggagcagatgcagcgcaaacatggcgggatgctcgtgcggaatccgctgtctagaaacagcacacacgaaatgtactgggtttcctgcggaaccggcaatatcgtgagcgctgtcaacatgacatctcgcatgctgctcaaccggttcaccatgacacacagaaagcctacctatgagcgcgatgtggacctgggggccggaacgagacatgttgcggtggaacccgaggtcgccaatcttgatattatcggccaacggatcgaaaacattaaaaatgagcacaagtccacatggcattacgacgaggataacccctataaaacctgggcttaccacgggagctatgaagtgaagccttctggatccgccagctctatggtgaatggcgtcgttcgcctgctcaccaagccctgggacgtgatccctatggtgacacagattgctatgacggacaccacaccgtttggccagcaaagagtcttcaaagagaaggtggatacccggacacccagagccaaacgggggaccgctcagatcatggaagttacagccaagtggctgtggggatttctttcccgcaacaaaaagcctagaatttgtacccgggaggagttcacgcgcaaggtgagaagcaatgcggccatcggcgctgtctttgtggacgagaaccagtggaactccgccaaagaggctgttgaagatgagcggttctgggacctggtgcaccgcgaaagagagctccataagcaggggaaatgcgctacctgcgtctacaacatgatgggaaagcgggagaaaaagctgggcgagtttgggaaggccaaaggcagccgcgcgatctggtacatgtggctgggagctagattcctcgagttcgaagccctgggctttatgaatgaggatcactggttctctcgggaaaacagcttttccggggtggagggagagggccttcataagctggggtatattctccgcgacatctctaaaattcccggaggcaatatgtacgccgatgacacagctgggtgggataccagaatcacagaagacgatctgcaaaacgaggccaagattaccgacatcatggaacctgagcacgcccttctggccacgagcatcttcaaactcacatatcagaataaggttgtgcgggtccagcgccccgcgaaaaacggcaccgtgatggatgtcatttccagacgggaccagagaggatctggccaagtggggacatacggactgaacacctttacgaatatggaagttcagctgatccgccagatggagagcgagggcattttcctcccgtccgaactggagacccctaaccttgccgaacgggtgctggactggctcgagaagcatgggacagaaagactgaagcgcatggctatctctggagatgactgtgtcgtgaaacccgtggatgaccggtttgccaccgctcttattgccctgaatgatatgggcaaggttagaaaagacatccctcagtgggagcccagcaaggggtggaacgattggcaacaggtgcctttctgctcccaccactttcatcagctcatcatgaaagacggccgcgagattgtcgtgccctgtcggaatcaggatgaactggttggacgggcgcgcgtgagccaaggcgccgggtggtctctgcgggagacagcttgcctcggaaagtcctatgcccagatgtggcagctgatgtacttccacagacgcgaccttcggctggctgccaacgctatctgtagcgccgtcccggtggattgggtccctacctctagaacaacctggtccattcatgcgcaccaccaatggatgacgacagaagacatgctcagcgtgtggaatcgggtttggatcgaggaaaacccctggatggaggacaagacccatgtgtcctcttgggaggaagtcccctatctgggcaaaagagaggatcagtggtgcgggagccttattggactgaccgcccgcgctacatgggccaccaatatccaggtggccattaaccaggttcggagactcatcggcaatgaaaactacctggactacatgacatccatgaagcgctttaaaaatgagagcgatcctgagggggctctgtggtga

SEQ ID NO: 18763 - RNA, 9879 nt, synthetic construct
  misc_feature 1..9879: note = derived and/or modified CDS sequence (opt5) from DENV-1__FJ410190__SS-prME
  source 1..9879: mol_type = other RNA
agcgtgacaatgctgcttatgctgcttcccacagccctggctttccacctcacgaccagaggcggggaacctcatatgatcgtctccaagcaggaacggggaaaatctctgctttttaagacaagcgttggcattaacatgtgcaccctgatcgccatggacctcggggagctgtgtgaagatacaatgacctacaaatgccccagaattacagaggcggaacccgacgatgtggactgttggtgcaatgctaccgatacgtgggtgacctatggaacatgttcccagaccggcgagcacagacgggacaagcgctctgtcgccctggcccctcatgtggggctcggactggagacaagaaccgaaacgtggatgagctccgagggcgcttggaaacagatccagaaggttgaaacatgggcccttcggcaccccggcttcaccgtgattgctctgtttctcgcccatgcgatcgggacatctatcacccagaagggaattatcttcattctgcttatgctggtcacccctagcatggccatgcgctgcgtgggcatcgggaacagagattttgttgagggactctccggcgctacatgggtggacgtcgtgctggagcacgggagctgtgtgacgaccatggccaaagataagcccacactggacattgaactcctgaaaaccgaggtcacaaatcctgctgttcttcggaagctgtgcatcgaagccaaaatttctaacaccacgacagattcccgctgtccgacccaaggagaggcgaccctcgtggaagaacaggacagcaatttcgtgtgcagacggacatttgtcgatcgcggctggggcaacgggtgtggactgttcggcaaggggtctcttctgacctgcgccaagtttaaatgcgtgacaaagctcgagggaaaaatcgttcagtacgaaaatctgaagtattccgtgatcgtcacggtgcacaccggcgaccagcatcaagttgggaacgagacaaccgaacacggaacaattgctaccatcacgccccaggcccctaccagcgagattcagctgacagactacggcgctctcaccctggattgttctcccagaacaggccttgacttcaatgaaatggtgctgctcaccatgaaagagaagtcctggctggtccataaacagtggtttcttgatctgcctctcccctggacgagcggggcctccacatctcaagagacctggaaccggcaggacctgctggtgacattcaagaccgcccacgctaagaaacaggaagtcgtggttctcggaagccaagagggcgcgatgcacaccgccctgacaggggctacggaaatccagacctccggaacaaccacaatttttgccggccatcttaagtgccgcctgaaaatggataagctcaccctgaaagggatgagctatgtgatgtgtacgggctctttcaagctggagaaggaagtcgccgagacacagcacggaaccgtgcttgttcaggtgaaatacgagggcaccgacgctccgtgcaagatccctttctccgcccaagatgaaaaaggggtcacacagaatggaagactcatcaccgcgaaccccattgtgacagacaaggagaaacctgtgaatatcgaaacggagccgccctttggcgagagctatattgttatcggggctggagaaaaggccctgaagctgtcttggttcaaaaagggcagctccattgggaaaatgtttgaggccaccgctcggggcgccagacgcatggctatcctcggagatacagcctgggacttcggctctatcgggggagtctttaccagcgtgggcaagctggtgcatcaggtcttcggggcggcctacggagtgctcttttccggcgttagctggacaatgaaaattgggatcggcattctgctcacctggctgggactgaactctcggtccacgagcctttctatgacctgtatcgctgtgggcatggtcacactctacctgggggtgatggttcaggccgattccggatgcgtgattaattggaagggcagagaactgaagtgtgggagcggaatcttcgtcaccaacgaggtgcacacatggaccgaacaatataaatttcaggctgactcccctaagcgcctctctgccgcgattggcaaagcctgggaggagggggtttgcggcatccggagcgctacaagactggaaaacatcatgtggaagcagatttccaatgagcttaaccatatcctgctcgaaaatgacatgaaattcaccgtggtcgtgggagatgccaacggcattctggctcaggggaagaaaatgatccgcccgcaacccatggagcaccggtactcttggaaaagctggggaaaggccaagattatcggcgccgacatccagaatacgacatttattatcgatgggcctgacacccccgaatgtcctgatgaccagagagcttggaacatttgggaggtggaggattatggattcggcatctttaccacaaatatttggctgaaacttcgcgactcctacacccagatgtgcgatcaccggctcatgagcgcggccatcaaagactctaaggctgtccatgccgatatgggctattggatcgaatccgagaaaaacgaaacgtggaagctggccagagctagcttcattgaggttaagacatgtatctggcccaaatctcacaccctgtggtccaatggggtgctcgaaagcgagatgattatcccgaagatttacggaggccctatctctcaacataactatcgccccgggtacttcacacagaccgccggaccttggcacctgggcaaacttgagctggactttgatctctgcgaagggacaaccgtggtcgtggacgagcactgcggaaatcggggccccagcctgagaacgaccacagttaccggcaagatcattcatgaatggtgttgccggtcctgtacactgcctccccttcgcttcagaggggaggacggatgctggtacggcatggagatccggccggtgaaagaaaaggaggaaaacctcgtcagaagcatggtgtctgcggggtccggagaggttgatagcttttccctgggcattctgtgtgtgtctatcatgattgaagaggtcatgcgcagccggtggtccagaaagatgctcatgaccgggacgctggctgtgttccttctgctcatcatgggacagctgacatggaatgacctgattcgcctttgcatcatggttggcgccaacgcctctgatagaatgggcatggggaccacatatctggctctcatggccacctttaaaatgcggcctatgttcgcggtgggactgctctttcgcagactgaccagccgggaggtccttctgctcacaatcggcctgtccctggtggcttctgtggaacttcccaatagcctggaggaactcggggacggactggccatgggcattatgatgctcaagctgcttacggagttccaaccccaccagctgtggaccacactcctgtccctgacctttatcaaaacaacccttagcctggattacgcctggcgcacgatggctatggtcctctctattgtttccctgttccctctctgtctgagcacaacctctcagaagaccacatggcttccggtgctgctggggtcctttggatgcaaacccctcaccatgttcctgatcacagaaaacaagatttggggcagaaagagctggcctcttaacgagggcatcatggccatcgggattgtgtctatcctgctctccagcctgctcaaaaatgacgtccccctggctggacctcttattgccggcgggatgctgatcgcgtgttatgtgatttccggaagctctgccgatctgagcctcgagaaggctgccgaagtttcctgggaggaagaggctgaacattctggcacgagccacaacatcctggtggaggtccaggacgatgggaccatgaaaatcaaggacgaggaacgggatgacacacttaccattctgctcaaagccacactgctcgccgtgtccggagtttaccccatgtctatccctgctaccctgtttgtgtggtatttctggcaaaagaaaaagcagcgcagcggcgtcctttgggatacgccctccccgcctgaggtggaaagagcggtcctggacgacggcatttaccggatcctgcagcgcgggctcctgggaagatctcaggtgggcgttggggtgttccaagatggagtctttcataccatgtggcacgtgacacggggcgccgttcttatgtatcaggggaagagactggagcccagctgggcttccgtgaaaaaggacctcattagctacggaggcggctggcgcttccaggggtcttggaataccggagaggaagtccaggtgatcgccgtggagcctggcaaaaaccccaagaatgttcaaacaaccccggggacatttaaaacgcctgaaggagaggtcggcgccattgctctggatttcaagcccgggacctccggaagccctatcgtgaaccgggaagagaagatcgtgggcctctacggcaatggggtcgtgacaacctctggaacctatgtttccgccattgcgcaggctaaaacaagccaggagggccccctgcccgaaatcgaggacgaagtgtttaagaaaagaaaccttacgattatggatctgcaccctgggtccggaaagacccgccggtacctgccggccatcgtcagagaggccattaaacgcaagctccggacactgatccttgctcccaccagagtggttgcctctgaaatggcggaggctctgaagggcatgcctatccgctatcaaacaaccgccgtgaaaagcgagcatacggggcgggaaattgtcgacctcatgtgccacgccacattcaccatgagactgctgtcccccgtgcgggttcctaattacaacatgatcattatggatgaggctcattttaccgaccccgccagcatcgctgcccgcggctatatttctacaagagtgggaatgggcgaagcggccgctatcttcatgaccgccacacctccggggtccgtcgaggcttttccccagagcaatgccgtgatccaggatgaagaacgggacattcctgagcgctcttggaacagcggatacgattggatcaccgacttccccggcaagacggtgtggtttgtcccttccattaaatctgggaatgacatcgccaactgtctcagaaagaatggaaaacgggttattcagcttagcagaaagacattcgataccgaatatcaaaagaccaagaataacgactgggattacgtggtgaccacggacatctccgagatgggcgctaatttccgcgcggatcgggtcattgaccccagacgctgcctgaagccggtgatcctgaaagatgggcctgaacgggttatcctcgccggccccatgcccgtgaccgtcgcttctgccgcccagagacgcggacggattggcagaaaccagaataaggagggggaccagtacgtgtatatgggacaacctctgaacaatgatgaggaccacgctcattggacagaagccaaaatgcttctggataacatcaatacccccgagggcattatccctgcgctctttgaaccggagcgcgaaaagagcgctgccattgacggggagtacagactgcggggagaggcccgcaagacattcgttgaactgatgagacggggcgatctccccgtgtggctttcctataaagtcgctagcgaggggtttcagtactctgaccgcagatggtgcttcgacggcgaacggaacaatcaggtgctggaggaaaacatggatgtcgagatctggaccaaggagggagaacgcaagaagctgcgccctcggtggctcgacgccagaacatattccgatcccctggcgcttcgcgagtttaaagagttcgccgctggccggagaagcgtgtccggggacctgatcctcgagattggaaagctgcctcagcacctgaccctccgggcccaaaatgctcttgataacctggttatgctgcacaattctgaacagggcgggaaagcctaccgccatgctatggaggagctccccgacacgatcgaaacactgatgcttctggccctcattgcggtgctgaccggaggcgtgaccctgtttttcctcagcggcaaggggcttggaaagacatccatcggcctgctgtgtgtcatggcctctagcgctctcctgtggatggccaacgttgagccgcactggattgctgcctccatcatccttgaatttttcctgatggtgctcctgattcctgagcccgatagacagcggacccctcaggacaatcaactggcctatgtggtcatcgggctcctttttatgattctgacagtggctgcgaacgagatgggactgctcgaaacgaccaaaaaggatctgggcatcgggcatgttgccgctgagaaccagcagcacgccacaatgcttgacgtggatctgcgccccgccagcgcttggaccctctacgccgtcgcgacaaccgtgattacgcctatgatgagacacaccatcgaaaatacaaccgccaacatttctctgacagctatcgccaatcaagctgccatcctgatgggactcgacaaaggctggcccatttccaagatggatatcggcgtcccgcttctggcgctggggtgctacagccaggtgaaccctctcaccctgacggccgctgttcttatgctggtggcccattatgctattatcggacccggcctccaggccaaagctacacgggaggcccagaagcgcaccgcggccgggattatgaagaatcccacagtcgacggaatcgtggctatcgacctggatcctgttgtgtacgacgccaaattcgaaaagcaactgggccagattatgctccttatcctgtgtacctctcagattctgctcatgagaaccacatgggctctgtgcgagtccatcacgcttgccaccgggccgctgacaaccctctgggagggaagccccggcaaattttggaacacaaccattgccgtctctatggcgaatatcttccggggcagctatctggctggggccggactggctttctccctcatgaagtctcttggcgggggacgcagaggcacgggggcccagggagaaacactgggcgagaaatggaagcggcaactgaaccagctcagcaagtccgaatttaatacctacaaaagaagcggcatcatggaggtggatcgctccgaagccaaggaggggctgaaacggggagagaccacaaagcacgctgtgtctagaggcaccgccaaacttcgctggttcgttgaacggaacctggtcaagcctgaggggaaggtgattgacctcggatgtggcagagggggatggagctattactgcgcgggcctgaaaaaggtgacagaagtcaaaggctatacgaaagggggacccggccatgaggaacctatccccatggccacctacgggtggaatctggttaaactctactccggaaaggatgtgtttttcacacctccggagaaatgtgacacccttctgtgcgatattggcgagtctagccccaaccctacaatcgaagaggggcgcaccctgcgggtgctcaagatggtcgaaccctggctgagaggaaatcagttttgtattaagatccttaacccttatatgccctccgtggttgagacgctggagcagatgcaacgcaaacacggcggcatgctcgtgcggaatccgctgtctagaaacagcacccatgaaatgtactgggtctcctgcgggacaggaaatattgtgagcgctgttaacatgacctctcgcatgctgctcaaccggttcacaatggcccacagaaagcctacctatgagcgcgacgtggatctgggcgctgggacaagacacgtcgccgtggaacccgaggtggcgaatcttgacatcatcggacagcggattgaaaacatcaaaaatgagcataagtccacctggcactacgatgaggacaacccctataaaacgtgggcctaccatggcagctatgaagtcaagccttctgggtccgctagctctatggttaatggagtggtgcgcctgctcacaaagccctgggacgtcattcctatggtgacccagatcgccatgaccgatacaacgccgtttggccaacagagagttttcaaagagaaggtggacacccggacacccagagctaaacggggcaccgcccagattatggaagtcacagctaagtggctgtgggggtttctttcccgcaacaaaaagcctagaatctgtacccgggaggagttcacacgcaaggtgagaagcaatgccgcgatcggagccgtttttgtggatgagaaccagtggaactccgctaaagaggccgtcgaagacgagcggttctgggatctggtgcaccgcgaaagagagctccacaagcaaggcaaatgcgctacctgcgtttacaacatgatggggaagcgggagaaaaagctgggagagtttggcaaggccaaagggagccgcgccatttggtacatgtggctgggcgcgagattcctcgagttcgaagctctgggatttatgaatgaggaccattggttctctcgggaaaacagcttttccggcgtggagggggagggacttcacaagctgggctatatcctccgcgatatttctaaaatccccgggggaaatatgtacgccgacgatacggccggctgggacaccagaattacagaagatgacctgcagaacgaggctaagatcaccgatatcatggaacctgagcatgcccttctggctacaagcattttcaaactcacctatcagaataaggtcgtgcgggtccagcgccccgccaaaaacgggacggtgatggacgttatctccagacgggaccaaagaggctctggacaggtgggcacatacgggctgaacacctttacaaatatggaagtccagctgattcgccagatggagagcgagggaatcttcctcccgtccgaactggagacccctaaccttgcggaacgggtgctggattggctcgagaagcacggcacggaaagactgaagcgcatggccatttctggggacgattgtgtggttaaacccgtggacgatcggtttgctaccgcccttatcgctctgaatgacatgggaaaggtcagaaaagatatccctcaatgggagcccagcaagggctggaacgactggcaacaggtgcctttctgctcccatcactttcaccagctcattatgaaagatgggcgcgagatcgttgtgccctgtcggaatcaagacgaactggtcggcagagcccgcgtgagccagggagcgggctggtctctgcgggagacagcctgcctcgggaagtcctatgctcagatgtggcaactgatgtacttccatagacgcgatcttcggctggccgctaacgccatttgtagcgctgtcccggtggactgggttcctacctctagaacaacctggtccatccacgcccatcaccagtggatgacaaccgaagacatgctcagcgtgtggaatcgggtctggattgaggaaaacccctggatggaggataagacgcacgtgtcctcttgggaggaagttccctatctgggaaaaagagaggaccagtggtgcggcagccttatcgggctgacagcgcgcgccacctgggctaccaatattcaggtggccatcaaccaagtccggagactcatcggaaatgaaaactacctggattacatgacatccatgaagcgctttaaaaatgagagcgaccctgagggcgccctgtggtga

SEQ ID NO: 18764 - RNA, 9879 nt, synthetic construct
  misc_feature 1..9879: note = derived and/or modified CDS sequence (opt5) from DENV-1__EU482591__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcgacctgtgcgagggaaccacagtggttgtggatgaacactgcggcaacagaggcccctctctccggaccacaaccgtcacggggaaaattatccatgagtggtgttgccgcagctgtacactgcctcccctgagatttcggggagaggacggctgctggtacgggatggaaattagaccggtgaaggagaaagaagagaatcttgttcgctccatggtgagcgcgggatctggcgaagtcgattccttcagcctcgggatcctgtgtgtgtccatcatgattgaggaggttatgcggtctagatggagccgcaagatgctgatgaccggaacactcgctgtgtttctgcttctgatcatgggccagctcacctggaacgacctgattagactgtgcatcatggtcggcgccaatgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagaactgggagatggcctcgccatggggatcatgatgctgaaactcctgaccgaatttcaaccccaccagctttggacaaccctgctcagcctgacgttcgtgaagacaaccctgtcccttgactacgcctggaaaaccacagctatggccctgagcattgtgtctctctttcctctgtgtctctccaccacaagccagaagacgacctggctgccggtccttctgggatctttcggctgcaaacccctgacaatgtttctcatcaccgagaacaagatctggggcagaaagtcctggcctctgaatgaggggattatggctatcggaattgtgagcatccttctgtcttccctcctgaaaaacgatgttcccctcgccggccctctgattgccgggggaatgcttatcgcctgttatgtgatcagcggctccagcgctgacctgtctctggaaaaggccgctgaggtcagctgggaacaggaggccgaacattccggggcctctcacagcattctcgtggaggttcaagatgacggaacaatgaaaatcaaggatgaggaacgggacgataccctgacgattcttctgaaagctaccctcctggcggtgtccggcgtctaccccatgtctatccctgccacactcttcgtgtggtatttctggcagaagaaaaagcagcgcagcggcgtcctgtgggacaccccctccccgcctgaggtggaaagagctgttcttgataatgggatttaccggatcctgcagcgcggactgctcggcagatctcaagtgggggtcggagtgtttcaggacggcgttttccatacaatgtggcacgtgaccagaggggcggtcctgatgtatcagggaaagcggcttgagcccagctgggcctccgtgaaaaaggatctgatcagctacggcggcgggtggcgctttcagggatcttggaacacaggcgaggaagtgcaagttattgctgtcgagcctgggaaaaatcccaagaacgtgcagacgaccccgggaacattcaaaacccctgaaggcgaggtgggggccatcgcgctcgactttaagcccggaacctccggcagccctattgtcaatcgggaaggcaagatcgtggggctgtacggaaacggcgttgtgacaacgtctgggacctatgtctccgctattgcccaggccaaagctagccaagagggacccctccccgagatcgaagacgaggtgttcaagaaaagaaatctgacaattatggatcttcaccctggctccgggaagacccgccggtacctgccggccatcgttagagaagcgatcaaacgcaagctgcggacactcattctggctcccaccagagtggtcgcctctgagatggccgaagctcttaagggcatgcctatccgctatcagacgacagccgtgaaaagcgagcataccggacgggagattgttgacctgatgtgccacgctacctttacaatgagactcctgtcccccgtgcgggtccctaactacaatatgatcattatggatgaagcccatttcaccgaccccgcgagcatcgccgctcgcggctatatctctacaagagtggggatgggagaggccgctgccatttttatgaccgccacgcctccgggctccgtggaggctttcccccagagcaacgcggtcatccaggatgaggaacgggacattcctgagcgctcttggaatagcgggtacgattggatcacagactttcccggaaagaccgtttggttcgtgccttccattaaatctggcaacgatatcgccaattgtctgagaaagaacgggaaacgggtgatccaactcagcagaaagacattcgacaccgagtatcagaagacgaaaaacaatgattgggactacgtcgtgaccacagacatttccgaaatgggcgctaactttcgcgccgatcgggttatcgaccccagacgctgccttaagccggtgattctgaaagatggacctgagcgggtcatcctggccggccccatgcccgtgaccgttgcttctgccgcgcagagacgcgggcggattggaagaaatcagaacaaggaaggcgaccaatacgtgtatatggggcagcctctcaataacgatgaggaccacgctcattggacagaggccaaaatgctgcttgataatatcaacacccccgaaggaattatccctgccctgttcgagccggaacgcgaaaagagcgctgccatcgacggcgaatacagactcagaggggaagcgcgcaagacatttgtcgagctgatgagacggggcgatctgcccgtgtggctctcctataaagtcgccagcgaaggattccagtactctgaccgcagatggtgctttgatggcgagcggaataaccaggtgcttgaagagaatatggacgttgaaatttggaccaaggagggggagcgcaagaagctgcgccctcggtggctggatgctagaacgtattccgaccccctcgccctgcgcgagttcaaagagtttgctgccggacggagaagcgtgtccggcgaccttatcctggaaattgggaagctccctcaacacctgacactgcgggctcagaacgccctcgataatcttgtgatgctgcacaactctgagcagggaggcaaagcgtaccgccatgccatggaggaactgcccgacaccatcgagaccctcatgctgcttgctctgattgccgtcctcacaggcggggttaccctgttctttctgagcggaaagggcctcgggaagacatccatcggacttctgtgtgtgacggcttctagcgccctgctctggatggcctccgtggaaccgcactggatcgctgcgagcattatcctggagttctttcttatggtcctgctcattcctgaacccgatagacagcggacccctcaagacaatcagctggcctatgtggttatcggcctcctgttcatgattcttacagtggctgccaacgagatggggctgctggagaccaccaaaaaggatctcggaatcggctacgtcgccgctgaaaaccatcagcacgccaccatgctggacgtggatcttcaccccgcgtctgcctggacgctgtacgctgtcgccaccacagtgatcacccctatgatgcgccatacaattgagaataccacggctaacatctccctcacagccattgcgaatcaagccgctatcctgatgggcctggacaaagggtggcccattagcaagatggatatcggagttccgctccttgccctgggctgctattctcaggtgaaccctctgaccctcacagctgccgtcctgatgcttgtggctcactacgccattatcgggcccggactgcaggcgaaagccaccagagaagctcagaagcggaccgccgctggcatcatgaagaatcccacagttgacgggattgtggccatcgatctcgaccctgtcgtgtatgatgccaaatttgagaagcaactgggacagattatgctgctcatcctttgtacgtcccagattctgctgatgcgcaccacatgggcgctctgcgaaagcatcaccctggctacaggcccgcttaccacgctgtgggagggctctcccgggaaattctggaacacaaccatcgccgtgagcatggctaatattttcagaggatcctacctcgccggcgccgggctggctttttctctgatgaaaagcctcggaggcgggcggcgcggaaccggcgcccagggcgagacacttggggaaaaatggaagagacaactgaaccagctgtccaagagcgagttcaatacctataaacggtccggaatcatggaagttgacagatctgaggcgaaggaaggcctcaaacgcggggagacaacgaagcatgccgtcagccggggaaccgctaaactgagatggtttgtggagcgcaaccttgtgaagcctgaaggcaaggtcattgacctggggtgtggacggggcggctggtcctactattgcgccgggctcaaaaaggttacagaggtgaaaggatacaccaagggcgggcccggacacgaggaacctatccccatggctacatacggctggaatctggtgaaactgcattctgggaaggatgtcttctttatgcctccggaaaaatgtgacaccctcctttgcgatattggagagagctcccccaaccctacgatcgaggaaggcagaaccctgcgcgtgctgaagatggttgagccctggctccggggcaatcagttctgtatcaagattctgaacccttatatgccctctgtggtcgaaacacttgagagaatgcagcgcaaacacgggggaatgctggtgcggaatccgctcagcagaaactccacccacgagatgtactgggttagctgcggcacagggaatatcgtgtctgccgtcaacatgacctcccgcatgctgctgaaccggtttacaatggcgcatagaaagcctacctatgaacgcgacgtggatctcggagccggcacgagacacgtggctgtcgagcccgaagttgccaatctggacattatcgggcaacggattgagaacatcaaaaatgaacataagagcacatggcactacgatgaggacaacccctataaaacctgggcttaccacggatcttatgaggtgaagccttccggcagcgcctcttccatggtgaatggcgtcgtgcgccttctgaccaagccctgggatgttattcctatggtgacacagatcgctatgacggacaccacaccgttcgggcagcaaagagtctttaaagaaaaggtggatacccggacacccagagccaaacggggaaccacacagatcatggaggttaccgcgaagtggctctggggcttcctgagccgcaacaaaaagcctagaatttgtacgcgggaagagtttacccgcaaggtgagatccaatgccgctatcggggccgtcttcgtggacgaaaaccagtggaatagcgctaaagaggccgttgaggacgaacggttttgggatcttgtgcatcgcgagagagaactgcacaagcagggaaaatgcgccacatgcgtctacaacatgatgggcaagcgggagaaaaagctcggggagttcggcaaggcgaaaggatctcgcgctatttggtacatgtggctgggcgccagattcctggagtttgaggccctcgggttcatgaatgaagaccattggtttagccgggagaactccctgtctggagtggaaggcgaggggcttcacaagctgggatatatcctccgcgatattagcaaaatccccggcgggaatatgtacgctgacgataccgccggctgggacacaagaatcaccgaggatgacctgcaaaacgaagctaagattacggatatcatggagcctgaacatgcccttctggcgacatccattttcaaactcacctatcagaataaggtcgtgcgggttcagcgccccgccaaaaacggaacagtgatggacgtcatctctagacgggatcagagaggcagcgggcaagtgggaacctacggcctgaacacgtttaccaatatggaggtgcagctgattcgccagatggaatccgaggggatcttcctcccgtctgagctggaaacacctaaccttgctgagcgggccctggactggctcgaaaagcacggagctgagagactgaagcgcatggccatcagcggcgatgactgtgttgtgaaacccattgacgatcggtttgcgaccgcccttacagctctgaatgacatggggaaggtcagaaaagatatccctcagtgggaaccctccaagggctggaacgactggcaacaggtgcctttctgcagccaccattttcaccagctcattatgaaagatggacgcgagatcgttgtgccctgtcggaatcaggacgagctggtcggcagagcccgcgtgtctcaaggggctggatggtccctgcgggaaaccgcctgcctcggcaagagctatgctcagatgtggcagctgatgtacttccatagacgcgatcttcggctggccgcgaacgccatttgttctgctgtcccggtggactgggttcctacatccagaaccacgtggagcatccacgcccaccatcaatggatgacaaccgaggatatgctctccgtgtggaatcgggtctggatcgaagagaacccctggatggaagacaagacccacgtgtctagctgggaggaggttccctatctggggaaaagagaagatcagtggtgcggatcccttattggcctgacagcccgcgctacctgggccacaaatatccaggtggcgattaaccaggtccggagactcatcgggaatgagaactacctggactacatgacgagcatgaagcgctttaaaaatgaatctgactccgagggcgctctgtggtga

SEQ ID NO: 18765 - RNA, 9879 nt, synthetic construct
  misc_feature 1..9879: note = derived and/or modified CDS sequence (opt5) from DENV-1__EU482592__SS-prME
  source 1..9879: mol_type = other RNA
agcgtgaccatgctgcttatgctgcttcccaccgctctggctttccacctcacgaccagaggcggggagcctcatatgatcgtctccaagcaggaacggggaaagtctctgctttttaagaccagcgccggcattaacatgtgcaccctgatcgcgatggacctcggggagctgtgtgaagatacaatgacctacaaatgcccccgcattacagaggctgaacccgacgatgttgactgttggtgcaatgccaccgatacgtgggtgacctatggaacatgttcccagaccggcgagcacagacgggacaagcgctctgtggccctggctcctcatgtcgggctcggactggagacaagaaccgaaacgtggatgagctccgagggcgcctggaaacagatccagaaggtggaaacatgggcccttcggcaccccggcttcaccgttacagccctgtttctcgcgcatgccattgggacctctatcacccagaagggaatcattttcatcctgcttatgctggtgacacctagcatggctatgcgctgcgtcggcattgggaacagagattttgtggagggactctccggcgccacgtgggttgacgtggtcctggagcacgggagctgtgtgaccacaatggctaaagataagcccaccctggacatcgaactcctgaaaacagaggtgaccaatcctgccgtccttcggaagctgtgcattgaagcgaaaatctctaacacgacaaccgattcccgctgtccgacccagggagaggccacactcgttgaagaacaggacagcaatttcgtgtgcagacggacctttgtggatcgcggctggggcaacgggtgtggactgttcggcaaggggtctcttctgacatgcgctaagtttaaatgcgtcacgaagctcgagggaaaaattgtgcagtacgaaaatctgaagtattccgttatcgtgaccgtccacacaggcgaccagcatcaagtggggaacgagaccacagaacacggaaccatcgccacgattacaccccaggctcctacaagcgagatccagctgaccgactacggcgccctcacactggattgttctcccagaaccggccttgacttcaatgaaatggttctgctcacgatgaaagagaagtcctggctggtgcataaacagtggtttcttgatctgcctctcccctggacaagcggggcctccacctctcaagagacatggaaccggcaggacctgctggtcaccttcaagaccgctcacgcgaagaaacaggaagtggtcgtgctcggaagccaagagggcgccatgcacacagctctgacgggggccaccgaaattcagacatccggaaccacaaccatctttgccggccatcttaagtgccgcctgaaaatggataagctcacgctgaaagggatgagctatgttatgtgtacaggctctttcaagctggagaaggaagtggctgagacccagcacggaaccgtccttgtgcaggttaaatacgagggcacagacgccccgtgcaagattcctttctccgcgcaagatgaaaaaggggtgacccagaatggaagactcatcacagctaaccccatcgtcacggacaaggagaaacctgtgaatattgaaaccgagccgccctttggcgagagctatatcgtggttggggccggagaaaaggccctgaagctgtcttggttcaaaaagggcagctccattgggaaaatgtttgaggctacagcccggggcgctagacgcatggccatcctcggagataccgcgtgggacttcggctctattgggggagtctttacaagcgtgggcaagctggtgcatcaggtcttcggggccgcttacggagtgctcttttccggcgttagctggaccatgaaaatcgggatcggcattctgctcacgtggctgggactgaactctcggtccaccagcctttctatgacatgtatcgccgtgggcatggtcaccctctacctgggggtgatggttcaggctgattccggatgcgtgattaattggaagggcagagaactgaagtgtgggagcggaatcttcgtcacaaacgaggtgcacacctggacagaacaatataaatttcaggccgactcccctaagcgcctctctgcggccattggcaaggcttgggaggagggggtttgcggcatccggagcgccaccagactggaaaacattatgtggaagcagatctccaatgagcttaaccatatcctgctcgaaaatgacatgaaattcacggtggtcgtgggagatgctaacggcattctggcccaggggaagaaaatgatccgcccgcaacccatggagcaccggtactcttggaaaagctggggaaaggccaagattatcggcgctgacattcaaaattccacatttatcatcgatgggcctgacacccccgaatgtcctgatgaccagagagcgtggaacatttgggaggtggaggattatggattcggcatctttaccacaaatatttggctgaaacttcgcgacagctacacccagatgtgcgatcaccggctcatgtctgccgctatcaaagactccaaggccgtccatgccgatatgggctattggattgaaagcgagaaaaacgaaacgtggaagctggctagagcctctttcatcgaggttaagacatgtatctggcccaaatcccacaccctgtggagcaatggggtgctcgaatctgagatgattatcccgaagatttacggaggccctatcagccaacataactatcgccccgggtacttcacacagaccgcgggaccttggcacctgggcaaacttgagctggactttgatctctgcgaagggacaaccgtggtcgtggacgagcactgcggaaatcggggcccctccctgagaacgaccacagttaccggcaagattatccatgaatggtgttgccggagctgtacactgcctccccttcgcttcagaggggaggacggatgctggtacggcatggagatccggccggtgaaagaaaaggaggaaaacctcgtcagatctatggtgtccgctgggagcggagaggttgattccttttctctgggcattctgtgtgtgagcatcatgattgaagaggtcatgcgctcccggtggtctagaaagatgctcatgaccgggacgctggccgtgttccttctgctcatcatgggacagctgacatggaatgacctgattcgcctttgcatcatggttggcgccaacgctagcgatagaatgggcatggggaccacatatctggccctcatggcgacctttaaaatgcggcctatgttcgctgtgggactgctctttcgcagactgacctcccgggaggtccttctgctcacaattggcctgtctctggtggccagcgtggaacttcccaattccctggaggaactcggggacggactggccatgggcatcatgatgctcaagctgcttacggagttccaaccccaccagctgtggaccacactcctgagcctgacctttatcaaaacaaccctttctctggattacgcttggcgcacgatggccatggtcctctccattgttagcctgttccctctctgtctgtctacaacctcccagaagaccacatggcttccggtgctgctggggagctttggatgcaaacccctcaccatgttcctgatcacagaaaacaagatttggggcagaaagtcttggcctcttaacgagggcatcatggctattgggatcgtgtccatcctgctcagctccctgctcaaaaatgacgtccccctggccggacctcttattgcgggcgggatgctgatcgcctgttatgtgattagcggatctagcgctgatctgtccctcgagaaggccgctgaagtttcttgggaggaagaggccgaacatagcggcacgtcccacaacatcctggtggaggtccaggacgatgggaccatgaaaattaaggacgaggaacgggatgacacacttaccatcctgctcaaagccacactgctcgctgtgtctggagtttaccccatgagcatccctgcgaccctgtttgtgtggtatttctggcaaaagaaaaagcagcgctccggcgtcctttgggatacgccctctccgcctgaggtggaaagagccgtcctggacgacggcatttaccggatcctgcagcgcgggctcctgggaagaagccaggtgggcgttggggtgttccaagatggagtctttcataccatgtggcacgtgacacggggcgctgttcttatgtatcaggggaagagactggagccctcctgggccagcgtgaaaaaggacctcatttcttacggaggcggctggcgcttccaggggtcctggaataccggagaggaagtccaggtgatcgccgtggagcctggcaaaaaccccaagaatgttcaaacaaccccggggacatttaaaacgcctgaaggagaggtcggcgctattgccctggatttcaagcccgggaccagcggatctcctatcgtgaaccgggaaggcaagattgtgggcctctacgggaatggagtcgtgacaacctccggcacctatgttagcgcgatcgctcaggccaaaacatcccaggaggggcccctgcccgagatcgaagaggaagtgtttaagaaaagaaaccttacgattatggacctgcaccctggatctggcaagacccgccggtacctgccggccatcgtcagagaggctattaaacgcaagctccggacactgatccttgcccccaccagagtggttgcgagcgaaatggctgaggccctgaaggggatgcctattcgctatcaaacaaccgccgtgaaatccgagcatacgggccgggaaatcgtcgatctcatgtgccacgctacattcaccatgagactgctgagccccgtgcgggttcctaattacaacatgatcattatggacgaggcccattttaccgatcccgcttctatcgccgcgcgcggatatatttccacaagagtgggcatgggggaagccgctgccatcttcatgaccgctacacctccgggaagcgtcgaggcctttccccagtctaatgccgtgattcaggacgaagaacgggatatccctgagcgcagctggaactccggctacgactggatcaccgatttccccgggaagacggtgtggtttgtcccttctattaaaagcggaaatgacatcgctaactgtctcagaaagaatggcaaacgggttattcagctttccagaaagacattcgacaccgaatatcaaaagacacgcaacaacgattgggactacgtggtgaccacggatatctctgagatgggggcgaatttccgggccgacagagtcattgatccccgccggtgcctgaaaccggtgatcctgaaggacggccctgaaagagttattctcgctggacccatgcccgtgaccgtcgccagcgccgctcagcgccggggcagaatcgggcgcaaccagaataaagagggagatcagtacgtgtatatgggccaacctctgaacaatgacgaggatcacgcccattggacagaagcgaagatgcttctggacaacatcaatacccccgaggggattatccctgctctctttgaaccggagagagaaaaatccgccgccattgatggagagtaccggctgcgcggcgaggctagaaagacattcgttgaactgatgcggcgcggggacctccccgtgtggcttagctataaggtcgcctctgagggctttcagtactccgatagacggtggtgcttcgacggagaaagaaacaatcaggtgctggaggaaaacatggacgtcgagatctggaccaaagagggcgaacgcaagaaactgcggcctagatggctcgatgcgcgcacatatagcgaccccctggcccttcgggagtttaaggagttcgctgccgggagacggtccgtgtctggagatctgattctcgagatcggcaaactgcctcagcacctgaccctccgcgctcaaaatgcccttgacaacctggttatgctgcacaatagcgaacaagggggaaaggcttacagacatgccatggaggagctccccgatacgatcgaaacactgatgcttctggcgctcattgccgtgctgaccggcggcgtgaccctgtttttcctctccgggaaaggacttggcaagacatctatcgggctgctgtgtgtcatggctagctccgccctcctgtggatggctaacgttgagccgcactggattgccgccagcatcattcttgaatttttcctgatggtgctcctgatccctgagcccgaccggcagcgcacccctcaggataatcaactggcttatgtggtcatcggactcctttttatgattctgacagtggcggccaacgagatgggcctgctcgaaacgaccaagaaagacctggggatcggatacgttgctgccgagaaccagcatcacgccacaatgcttgatgtggacctgagacccgcttctgcctggaccctctacgcggtcgccacaaccgtgattacgcctatgatgcggcacaccatcgaaaatacaaccgctaacatttccctgacagccatcgctaatcaggccgcgattctgatgggcctcgataagggctggcccatcagcaaaatggacatcggggtcccgcttctggccctgggatgctattctcaagtgaaccctctcaccctgacggctgccgttcttatgctggtggctcattacgccattatcggccccgggctccaggctaaggccacacgcgaggcgcagaaaagaaccgccgctggaattatgaagaatcccacagtcgatggcatcgtggccattgacctggaccctgttgtgtatgatgctaagttcgaaaaacagctggggcaaatcatgctccttatcctgtgtacctcccagattctgctcatgcggaccacatgggccctgtgcgagagcatcacgcttgccaccggaccgctgacaaccctctgggagggctctcccggcaagttttggaacacaaccattgcggtcagcatggctaatatcttccgcgggtcctacctggccggagctggcctggccttctctctcatgaaaagccttgggggaggcagacgggggacgggagcccagggcgaaacactgggcgagaagtggaaaagacagctgaaccaactctccaagagcgaatttaatacctataagcgctccgggattatggaggtggaccggtctgaagctaaagagggactgaagagaggcgagaccacaaaacacgccgtgagccgcgggaccgcgaaacttcggtggttcgttgaaagaaacctggtcaaacctgagggaaaggtgatcgatctcggctgtgggcgcggaggctggtcctactattgcgccggcctgaagaaagtgacagaagtcaaggggtacacgaaaggaggccccgggcatgaggaacctatccccatggctacctacggatggaatctggttaagctctattctggcaaagacgtgtttttcacacctccggagaagtgtgatacccttctgtgcgacattggggagagctcccccaaccctacaatcgaagagggacggaccctgagagtgctcaaaatggtcgaaccctggctgcgcggcaatcagttttgtattaagatccttaacccttacatgccctctgtggttgagacgctggagcagatgcagcggaagcacggcgggatgctcgtgagaaatccgctgagccgcaactccacccatgaaatgtattgggtcagctgcggaacaggcaatattgtgtctgccgttaacatgacctcccggatgctgctcaacagattcacaatgacccaccgcaaacctacatacgagagagatgtggacctgggggctggaacccggcacgtcgccgtggaacccgaggtggcgaatcttgatatcattggccaacgcatcgaaaacatcaagaatgagcataaaagcacgtggtattacgacgaggataacccctataagacatgggcctaccacgggtcttacgaagtcaaaccttccggaagcgcttcttccatggttaatggcgtggtgagactgctcaccaagccctgggacgtcattcctatggtgacccagatcgccatgacagacacgaccccgtttggccagcaacgggttttcaaggagaaagtggatacaagaacaccccgggctaagcgcgggacagcccagattatggaagtcaccgctaaatggctgtggggatttcttagcagaaacaagaaacctcggatctgtacacgcgaggagttcaccagaaaggtgcggtccaatgccgcgattggcgccgtttttgtggacgagaaccagtggaatagcgctaaggaggccgtcgaagatgagcgcttctgggacctggtgcatagagaacgggagctccacaaacaggggaagtgcgctacgtgcgtttataacatgatgggaaaacgcgaaaagaaactgggcgagtttgggaaggccaagggctctagagccatctggtacatgtggctgggagcgcggttcctcgagttcgaagctctgggctttatgaatgaggatcactggttcagccgcgaaaactccttttctggggtggagggagagggccttcataaactggggtatatcctcagagacattagcaagatccccggaggcaatatgtacgccgatgacaccgccgggtgggatacacggattaccgaagacgatctgcaaaacgaggctaaaatcacagacattatggaacctgagcacgcccttctggctacctccatcttcaagctcacgtatcagaataaagtcgtgcgcgtccagagacccgccaagaacggcacagtgatggatgttatctctcggagagaccagcgcggaagcggccaagtggggacctacggactgaacacatttaccaatatggaagtccagctgattcggcagatggagtccgagggcatcttcctcccgtctgaactggagacgcctaaccttgcggaaagagtgctgaattggctcgagaaacatgggaccgaacgcctgaagcggatggccattagcggagacgattgtgtggttaagcccgtggacgatagatttgctacagcccttatcgctctgaacgacatgggcaaagtccgcaaggatattcctcagtgggagccctccaaagggtggaatgactggcaacaggtgcctttctgcagccaccattttcaccagctcatcatgaaggatggccgggagatcgttgtgccctgtagaaaccaggacgaactggtcggacgcgcccgggtgtctcaaggcgcggggtggtccctgagagagaccgcctgcctcggaaaaagctatgctcagatgtggcagctgatgtacttccaccgccgggatcttagactggccgctaatgccatttgttctgctgtcccggtggactgggttcctacatcccggaccacatggagcatccatgcccaccatcaatggatgaccacggaagatatgctctccgtgtggaacagagtctggattgaggaaaatccctggatggaggacaagacacacgtgtctagctgggaggaagttccctacctgggcaagcgcgaggaccagtggtgcgggtcccttatcggactgaccgcgcgggccacctgggctacaaacattcaggtggccatcaatcaggtcagacgcctcattggcaacgaaaattatctggattacatgaccagcatgaaaagatttaagaacgagtctgaccctgagggggccctgtggtga

SEQ ID NO: 18766 - RNA, 9879 nt, synthetic construct
  misc_feature 1..9879: note = derived and/or modified CDS sequence (opt5) from DENV-1__EU482609__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggcccgggcctcccaagaaggacccctgcccgagattgaggacgaagtgtttaagaaaagaaatcttacaatcatggatctgcaccctggcagcgggaagacccgccggtacctgccggctatcgttagagaggccattaaacgcaagctccggacactgatccttgcgcccaccagagtggtcgcttccgaaatggccgaggccctgaagggcatgcctattcgctatcagacgacagctgtgaaatctgaacataccggacgggagatcgttgacctcatgtgccacgccaccttcacaatgagactgctgagccccgtgcgggtccctaactacaatatgattatcatggatgaggctcattttaccgaccccgcctccatcgcggcccgcggctatattagcacaagagtggggatgggagaagctgccgctatcttcatgaccgccacgcctccgggctctgtggaggcctttccccagtccaacgctgtcattcaggatgaagagcgggacatccctgaacgcagctggaattctgggtacgattggattacagacttccccggaaagaccgtttggtttgtgcctagcatcaaatccggcaacgatatcgcgaattgtctcagaaagaacgggaaacgggtgattcaactttctagaaagacattcgacaccgagtatcagaagacgaaaaacaatgactgggattacgtcgtgaccacagacatcagcgagatgggcgccaacttccgcgctgatcgggttattgaccccagacgctgcctgaagccggtgatcctgaaagatggacctgaacgggtcattctcgccggccccatgcccgtgaccgttgcctccgctgcccagagacgcgggcggatcggaagaaatcagaacaaggagggcgaccaatacgtgtatatggggcagcctctgaataacgatgaagaccacgcgcattggacagaggctaaaatgcttctggataatattaacacccccgagggaatcatccctgccctctttgaaccggagcgcgaaaagtctgccgctattgacggcgagtacagactgcggggggaagcccgcaagacattcgtcgagctgatgagacggggcgatctccccgtgtggcttagctataaagtcgcgtccgagggatttcagtacagcgaccgcagatggtgcttcgatggcgaacggaataaccaggtgctggaggaaaatatggacgttgagatctggaccaaggaaggggagagaaaaaagctgcgccctcggtggctcgacgccagaacgtattctgatcccctggctcttcgcgagtttaaagaattcgccgctggacggagatccgtgagcggcgacctgattctcgagatcgggaagctgcctcaacacctgacactccgggcccagaacgctcttgataatctggtgatgctgcacaactccgaacagggaggcaaagcctaccgccatgcgatggaggaactccccgacaccattgagaccctgatgcttctggccctcatcgctgtcctgacaggcggggttaccctgtttttcctctctggaaagggccttgggaagacaagcatcggactgctgtgtgtgacggcctcctctgctctcctgtggatggccagcgtggagccgcactggattgccgcttccatcattcttgaatttttcctgatggtcctcctgatccctgagcccgatagacagcggacccctcaagacaatcagctggcgtatgtggttattggcctcctttttatgatcctgacagtggccgctaacgaaatggggctgctcgagaccacaaaaaaggatctgggaatcggctacgtcgccgccgagaaccatcagcacgctaccatgcttgacgtggatctgcgccccgccagcgcgtggacgctctacgccgtcgctaccacagtgattacccctatgatgagacacacaatcgaaaataccacggccaacatttctctgacagctatcgccaatcaagcggccattctgatgggcctcgacaaagggtggcccatctccaagatggatattggagttccgcttctggctctgggctgctatagccaggtgaaccctctcaccctgacagccgctgtccttatgctggtggcccattacgctatcatcgggcccggactccaggccaaagcgacccgggaggcccagaagcgcaccgctgccggcattatgaagaatcccacagttgacgggatcgtggctattgatctggaccctgtcgtgtatgacgccaaattcgaaaagcaactgggacagatcatgctccttattctgtgtacgtctcagatcctgctcatgagaaccacatgggccctgtgcgagtccatcacccttgcgacaggcccgctgaccacgctctgggaaggcagccccgggaaattttggaacacaaccattgctgtgtctatggccaatatcttccggggaagctacctggctggcgccgggctggccttctccctcatgaagtctcttggaggcgggcgcagaggaaccggcgctcagggcgagacactgggggagaaatggaagcggcaactgaaccagctcagcaagtccgaatttaatacctataaaagaagcggaattatggaggttgatcgctccgaagccaaggagggcctgaaacggggggaaacaacgaagcacgcggtctctagaggaaccgccaaacttcgctggttcgtggagcggaacctggtgaagcctgagggcaaggtcatcgacctcgggtgtggaagaggcggctggagctactattgcgctgggctgaaaaaggttacagaagtgaaaggatacaccaagggcgggcccggacatgaggaacctattcccatggccacatacggctggaatctggtgaaactccactccgggaaggatgtctttttcatgcctccggagaaatgtgacacccttctgtgcgatatcggagaatctagccccaaccctacgatcgaggagggccgcaccctgcgggtgctcaagatggttgaaccctggctgaagggcaatcagttttgtattaaaatccttaacccttatatgccctccgtggtcgagacactggaacagatgcaaagaaagcatgggggaatgctcgtgcgcaatccgctgtctcggaacagcacccacgagatgtactgggtttcctgcggcacagggaatattgtgagcgctgtcaacatgacctctagaatgctgctcaaccgcttcacaatggcccaccggaaacctacctatgagagagacgtggatctgggagcgggcacgcgccatgtggccgtcgaacccgaggttgctaatcttgacatcattgggcagagaatcgaaaacattaagaatgagcacaaatccacatggcattacgatgaagacaacccctataagacctgggcctaccacggaagctatgaggtgaagccttctggctccgctagctctatggtgaatggcgtcgtgcggctgctcaccaaaccctgggatgttatccctatggtgacacagatcgccatgacggacaccacaccgtttgggcaacagcgcgtcttcaaggagaaagtggacaccagaacaccccgggctaagagaggaaccacacagattatggaagttaccgcccggtggctgtggggctttctttcccgcaacaaaaagcctagaatctgtacgcgggaggaattcacccgcaaggtgagaagcaatgcggccattggggctgtctttgtggatgagaaccagtggaattccgccaaagaagctgttgaggacgagcggttctgggatctggtgcaccgcgaaagagagctccataagcaaggaaaatgcgccacatgcgtctacaacatgatgggcaagcgggaaaaaaagctgggggagtttggcaaggccaaaggaagccgcgcgatctggtacatgtggctgggcgctagattcctcgaattcgaggccctggggtttatgaatgaggaccactggttctctcgggaaaacagcctttccggagtggagggcgaagggctgcataagctcggatatattctgcgcgatatctctaaaatccccggcgggaatatgtacgccgacgataccgctggctgggacacaagaattaccgaggatgaccttcagaacgaggccaagatcacggatattatggaacctgagcacgctctgctcgccacaagcatctttaaactgacctatcagaataaggtcgtgcgggttcagcgccccgcgaaaaacggaacagtgatggacgtcatttccagacgggatcaaagaggctctgggcaggtgggaacctacggcctgaacacgttcaccaatatggaagtgcagctcatccgccagatggagagcgaagggatcttttccccgtctgagctggagacacctaaccttgccgaacgggttctggactggctcgagaagcatggagctgaaagactgaagcgcatggccattagcggcgacgattgtgtggtcaaacccatcgacgatcggttcgctaccgcccttacagcgctgaatgacatggggaaggtgagaaaagatattcctcaatgggagccctccaagggctggaacgactggcagcaggttcctttttgcagccaccacttccatcagctcatcatgaaagatggacgcgaaattgtggtcccctgtcggaatcaagacgagctggtgggcagagcccgcgtctctcagggggctggatggtccctgcgggagaccgcctgcctcggcaagagctatgctcagatgtggcaactgatgtactttcacagacgcgatcttcggctggccgctaacgccatctgttctgcggtgccggttgactgggtgcctacatccagaaccacgtggagcatccatgcccaccaccagtggatgacaaccgaagatatgctctccgtctggaatcgggtgtggattgaggaaaacccctggatggaggacaagacccatgtttctagctgggaagaggtgccctatctggggaaaagagaggaccagtggtgcggatcccttatcggcctgacagctcgcgccacctgggccacaaatattcaggtcgctatcaaccaagtgcggagactcattgggaatgaaaactacctggattacatgacgagcatgaagcgcttcaaaaatgagtctgaccctgaaggcgccctgtggtga

SEQ ID NO: 18767 - RNA, 9879 nt, synthetic construct
  misc_feature 1..9879: note = derived and/or modified CDS sequence (opt5) from DENV-1__EU482610__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggtgcttcgccaccccggcttcaccgtcatcgcttttttcctggcccatgcgattgggacatctatcacccagaagggaatcatttttatcctcctgatgcttgtgacccctagcatggccatgagatgcgttggcattgggaaccgggacttcgtggagggactgtccggcgctacatgggtcgatgtggtgctcgaacacgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggccagcacatcccaagaaacctggaatcgccaggacctcctggtcacatttaaaaccgctcacgcgaagaagcaggaggtggttgtgctgggatctcaagaaggcgccatgcacaccgctctcacaggggccacggagattcagaccagcggaacaaccacaatcttcgccggccatctgaaatgcagacttaagatggataaactgaccctcaaggggatgtcctatgtcatgtgtacgggcagcttcaaactggaaaaggaggtggctgagacacagcacggaaccgttctggtgcaggtcaagtacgaaggcaccgacgccccgtgcaaaattcctttttctacacaagatgagaagggggtgacccagaacggacggcttatcacagcgaatcccatcgtgacggacaaagaaaagcctgttaacattgagaccgagccccccttcggcgaatcctatatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcatcaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttacctcggggtgatggtccaggctgattctggatgcgtgattaactggaagggccgggagctgaaatgtgggtccggaatctttgttaccaacgaagtgcacacatggaccgagcaatataagttccaggccgacagccctaagagactgtccgctgccattggcaaagcgtgggaggaaggggtctgcggcatccgctctgccacgcggctcgagaatattatgtggaagcagatcagcaacgaactgaatcatatccttctggagaacgatatgaaactcacagtggtggtcggagacgctaatggcattctggcccaggggaagaaaatgatcagaccgcaacccatggaacacaagtactcctggaaatcttggggaaaggctaagattatcggcgccgacattcagaacaccacctttatcatcgatgggcctgacacacccgagtgtcctgatggacagcgcgcctggaatatttgggaggttgaagactatggcttcggcgtgtttaccacgaacatctggctgaaacttcgggatagctacacacagatgtgcgaccacagactcatgtccgctgcgattaaggatagcaaagccgtgcatgctgacatggggtattggatcgagtctgaaaagaatgagacctggaaactggcccgcgcctccttcattgaagtcaagacatgtacctggcccaagagccacacactgtggtctaacggagtgctcgagtccgagatgatcatcccgaaaatttacggcgggcctatcagccaacataattatcggcccggatacttcacccagacggctggcccttggcacctggggaagcttgaactggattttgacctctgcgagggaaccacagttgtggtcgatgaacactgcggcaacagaggcccctctctgcggaccacaaccgtgacggggaaaattatccatgagtggtgttgccgcagctgtacactgcctccccttagattccggggagaggacggctgctggtacgggatggaaattagaccggttaaggagaaagaagagaatctcgtgcgctccatggtcagcgccggatctggcgaagtggattcctttagcctggggatcctgtgtgtttccatcatgattgaggaggtgatgcggtctagatggagccgcaagatgctcatgaccggaacactggcggtcttccttctgctcatcatgggccagctgacctggaacgacctgattagactttgcatcatggtgggcgctaatgcctccgaccggatggggatgggaaccacatatctggccctcatggctacgtttaagatgcgccctatgttcgccgtgggcctgctctttagacggctgacctctcgcgaagtccttctgctcacaattgggctgagcctggttgcgtccgtggagcttcccaactctctggaagagctcggagatggcctggctatggggatcatgatgctcaaactgcttaccgaattccaaccccaccagctgtggacaaccctcctgagcctgacgtttgtgaagacaaccctttccctggactacgcctggaaaaccacagccatggtcctcagcattgtgtctctgttccctctctgtctgtccaccacaagccagaagacgacctggcttccggttctgctgggatcttttggctgcaaacccctcacaatgttcctgatcaccgagaacaagatctggggcagaaagtcctggcctcttaatgaggggattatggctatcggaattgtgagcatcctgctctcttccctgctcaaaaacgatgtccccctggccggccctcttattgctgggggaatgctgatcgcctgttatgtgatcagcggctccagcgcggacctgtctctcgaaaaggccgctgaggttagctgggaacaggaggccgaacattccggggcttctcacaatattctggtggaggtccaagatgacggaacaatgaaaatcaaggatgaggaacgggacgatacccttacgattctgctcaaagccaccctgctcgccgtgagcggcgtctaccccatgtccatccctgctacactgtttgtgtggtatttctggcagaagaaaaagcagcgctctggcgttctttgggacacccccagcccgcctgaggtggaaagagcggtcctggatgacgggatttaccggatcctgcagcgcggactcctgggcagatcccaagtgggggttggagtgttccaggatggcgtctttcatacaatgtggcacgtgacccggggggccgtgcttatgtatcagggaaagagactggagccctcttgggctagcgttaaaaaggacctcatctcctacggcggcgggtggcgcttccagggaagctggaacacaggcgaggaagtccaagtgattgccgtggagcctgggaaaaatcccaagaacgtccagacgaccccgggaacatttaaaacccctgaaggcgaggtgggggccatcgctctggacttcaagcccggaacctctggctcccctattgttaatcgggaaggcaagatcgtggggctctacggaaacggcgtcgtgacaacgagcgggacctatgtttctgccattgcgcaggctaaagcctcccaagagggacccctgcccgagatcgaagatgaggtgtttaagaaaagaaatcttacaattatggacctgcaccctggcagcgggaagacccgccggtacctgccggccatcgtcagagaagctatcaaacgcaagctccggacactgattcttgcccccaccagagtggttgcgtccgagatggctgaagccctgaagggcatgcctatccgctatcagacgacagccgtgaaatctgagcataccggacgggagattgtcgatctcatgtgccacgctaccttcacaatgagactgctgagccccgtgcgggtgcctaactacaatatgatcattatggacgaagcccattttaccgatcccgcttccatcgccgcgcgcggctatatcagcacaagagtcgggatgggagaggccgctgccattttcatgaccgctacgcctccgggctctgttgaagcctttccccagtccaacgccgtgatccaggacgaggaacgggatattcctgagcgcagctggaattctgggtacgactggatcacagatttccccggaaagaccgtgtggtttgtccctagcattaaatccggcaacgacatcgctaattgtctcagaaagaacgggaaacgggtgatccaactttctagaaagacattcgataccgagtatcagaagacgaaaaacaatgactgggactacgttgtgaccacagatattagcgaaatgggcgcgaacttccgcgccgaccgggtcatcgatcccagacgctgcctgaagccggtgattctgaaagacggacctgagcgggttatcctcgctggccccatgcccgtgaccgtcgcctccgccgctcagagacgcgggcggattggaagaaatcagaacaaggaaggcgatcaatacgtgtatatggggcagcctctgaataacgacgaggatcacgcccattggacagaggcgaaaatgcttctggacaatatcaacacccccgaaggaattatccctgctctctttgagccggaacgcgagaagtctgccgccatcgatggcgaatacagactgcggggggaggctcgcaagacattcgtcgagctgatgagacggggcgacctccccgtgtggcttagctataaagttgcctccgaaggatttcagtacagcgatcgcagatggtgcttcgacggcgagcggaataaccaggtgctggaagagaatatggatgtggaaatttggaccaaggagggggagagaaaaaagctgcgccctcggtggctcgacgcgagaacgtattctgaccccctggcccttcgcgaatttaaagagttcgctgccggacggagatccgtcagcggcgatctgatcctcgaaattgggaagctgcctcaacacctgacactccgggctcagaacgcccttgacaatctggttatgctgcacaactccgagcagggaggcaaagcttaccgccatgccatggaagagctccccgataccatcgagaccctgatgcttctggcgctcattgccgtgctgacaggcggggtgaccctgtttttcctctctggaaagggccttgggaagacaagcatcggactgctgtgtgtcacggcttcctctgccctcctgtggatggctagcgtggaaccgcactggatcgccgcctccattatccttgagtttttcctgatggttctcctgattcctgaacccgacagacagcggacccctcaagataatcagctggcttatgtggtcatcggcctcctttttatgattctgacagtggcggccaacgagatggggctgctcgagaccacaaaaaaggacctgggaatcggctacgtcgctgccgaaaaccatcagcacgccaccatgcttgatgtggacctgcaccccgctagcgcctggacgctctacgcggttgccaccacagtgatcacccctatgatgcgccatacaattgagaataccacggctaacatctctctgacagccattgctaatcaagccgcgatcctgatgggcctcgataaagggtggcccatttccaagatggacatcggagtcccgcttctggccctgggctgctatagccaggtgaaccctctcaccctgacagctgccgttcttatgctggtggctcactacgccattatcgggcccggactccaggctaaagccaccagagaagcgcagaagcggaccgccgctggcatcatgaagaatcccacagtcgatgggattgtggccatcgacctggatcctgtggtttatgacgctaaattcgagaagcaactgggacagattatgctccttatcctgtgtacgtctcagattctgctcatgcgcaccacatgggccctgtgcgaatccatcacccttgccacaggcccgctgaccacgctctgggagggcagccccgggaaattttggaacacaaccatcgcggtctctatggctaatattttcagaggaagctacctggccggcgctgggctggccttctccctcatgaagtctcttggaggcgggcggcgcggaaccggcgcccagggcgagacactgggggaaaaatggaagagacaactgaaccagctcagcaagtccgagtttaatacctataaacggagcggaatcatggaagtggacagatccgaggctaaggaaggcctgaaacgcggggagacaacgaagcatgccgtgtctcggggaaccgcgaaacttagatggttcgtcgagcgcaacctggttaagcctgaaggcaaggtgattgatctcgggtgtggacggggcggctggagctactattgcgccgggctgaaaaaggtgacagaggtcaaaggatacaccaagggcgggcccggacacgaagagcctatccccatggctacatacggctggaatctggtgaaactccattccgggaaggacgtttttttcatgcctccggaaaaatgtgatacccttctgtgcgacattggagagtctagccccaaccctacgatcgaggaaggcagaaccctgcgcgtgctcaagatggtcgagccctggctgcggggcaatcagttttgtatcaagattcttaacccttatatgccctccgtggttgaaacactggagcagatgcaaagaaaacacgggggaatgctcgtgcgcaatccgctgtctcggaacagcacccacgagatgtactgggtctcctgcggcacagggaatatcgtgagcgccgtgaacatgacctctagaatgctgctcaaccgcttcacaatggctcatcggaagcctacctatgaaagagatgtcgacctgggagccggcacgcgccacgttgcggtggagcccgaagtggccaatcttgatattatcgggcagagaattgagaacatcaaaaatgaacataagtccacatggcactacgacgaggataacccctataaaacctgggcttaccacggaagctatgaggtcaagccttctggctccgccagctctatggtgaatggcgttgtgcggctgctcaccaagccctgggacgtcattcctatggtgacacagatcgctatgacggataccacaccgtttgggcaacagcgcgttttcaaagaaaaggtggacaccagaacaccccgggccaaaagaggaaccacacagatcatggaggtcaccgctaagtggctgtggggctttctttcccggaacaaaaagcctcgcatttgtacgagagaagagttcacccggaaggtgcgcagcaatgccgcgatcggggccgtttttgtggacgaaaaccagtggaattccgctaaagaggccgtcgaggatgaaagattctgggacctggtgcatcgggagcgcgaactccacaagcaaggaaaatgcgctacatgcgtctacaacatgatgggcaagagagagaaaaagctgggggaatttggcaaggccaaaggaagccgggccatttggtacatgtggctgggcgcgcgcttcctcgagttcgaggctctggggtttatgaatgaagatcattggttctctagagagaacagcctttccggagtggaaggcgaggggctgcacaagctcggatatatcctgcgggacatttctaaaatccccggcgggaatatgtacgccgatgacaccgccggctgggatacacgcatcaccgaggacgatcttcagaacgaagctaagattacggacatcatggagcctgaacatgccctgctcgctacaagcatttttaaactgacctatcagaataaggttgtgagagtccagcggcccgccaaaaacggaacagtgatggatgtgatctcccgcagagaccaacggggctctgggcaggttggaacctacggcctgaacacgttcaccaatatggaggtgcagctcattagacagatggaaagcgaggggatctttctgccgtccgagcttgaaacacctaacctggcggagcgcgccctcgattggctggaaaagcacggagctgagcggcttaagagaatggccatctctggcgacgactgtgtcgtgaaacccattgatgaccgcttcgctaccgccctgacagcgctcaatgatatggggaaggttcggaaagacatccctcaatgggaacccagcaagggctggaacgattggcagcaggtgcctttttgctcccaccatttccaccagctgattatgaaagacggaagagagatcgtcgtgccctgtcgcaatcaagatgagctggtcggccgggccagagtgagccagggggctggatggtctctccgcgaaaccgcctgcctgggcaagtcctatgctcagatgtggcaacttatgtactttcatcggagagacctgcgcctcgccgctaacgccatttgtagcgcggttccggtggattgggtccctacatctcggaccacgtggtccatccacgcccaccatcagtggatgacaaccgaggacatgctgagcgtgtggaatagagtttggatcgaagagaacccctggatggaagataagacccacgtgtcctcttgggaggaggtcccctatcttgggaaacgggaagaccagtggtgcggaagcctgattggcctcacagctagagccacctgggccacaaatatccaggtggctattaaccaagtgcgccggctgatcgggaatgagaactacctggactacatgacgtccatgaagagattcaaaaatgaaagcgatcctgagggcgccctctggtga

SEQ ID NO: 18768 - RNA, 9879 nt, synthetic construct
  misc_feature 1..9879: note = derived and/or modified CDS sequence (opt5) from DENV-1__EU482611__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaactcacagtcgtggtgggagacgccaatggcattctggctcaggggaagaaaatgatcagaccgcaacccatggaacacaagtactcctggaaatcttggggaaaggccaagattatcggcgccgacattcagaacaccacctttatcatcgatgggcctgacacacccgagtgtcctgatggacagcgcgcttggaatatttgggaggtcgaagactatggcttcggcgtttttaccacgaacatctggctgaaacttcgggatagctacacacagatgtgcgaccacagactcatgtccgcggccattaaggatagcaaagctgtgcatgccgacatggggtattggatcgagtctgaaaagaatgagacctggaaactggcccgcgcttccttcattgaagtgaagacatgtacctggcccaagagccacacactgtggtctaacggagtcctcgagtccgagatgatcatcccgaaaatttacggcgggcctatcagccaacataattatcggcccggatacttcacccagacggccggcccttggcacctggggaagcttgaactggattttgacctctgcgagggaaccacagtggttgtggatgaacactgcggcaacagaggcccctctctgcggaccacaaccgtcacggggaaaattatccatgagtggtgttgccgcagctgtacactgcctccccttagattccggggagaggacggctgctggtacgggatggaaattagaccggtgaaggagaaagaagagaatctcgttcgctccatggtgagcgcgggatctggcgaagtcgattcctttagcctggggatcctgtgtgtgtccatcatgattgaggaggttatgcggtctagatggagccgcaagatgctcatgaccggaacactggctgtgttccttctgctcatcatgggccagctgacctggaacgacctgattagactttgcatcatggtcggcgccaatgcctccgaccggatggggatgggaaccacatatctggctctcatggccacgtttaagatgcgccctatgttcgcggtgggcctgctctttagacggctgacctctcgcgaagtgcttctgctcacaattgggctgagcctggtcgcttccgttgagcttcccaactctctggaagagctcggagatggcctggccatggggatcatgatgctcaaactgcttaccgaattccaaccccaccagctgtggacaaccctcctgagcctgacgtttgtgaagacaaccctttccctggactacgcctggaaaaccacagctatggtgctcagcattgtctctctgttccctctctgtctgtccaccacaagccagaagacgacctggcttccggtgctgctgggatcttttggctgcaaacccctcacaatgttcctgatcaccgagaacaagatctggggcagaaagtcctggcctcttaatgaggggattatggccatcggaattgttagcatcctgctctcttccctgctcaaaaacgatgtgcccctggctggccctcttattgccgggggaatgctgatcgcgtgttatgtcatcagcggctccagcgccgacctgtctctcgaaaaggctgccgaggtgagctgggaacaggaggctgaacattccggggcctctcacaatattctggttgaggtgcaagatgacggaacaatgaaaatcaaggatgaggaacgggacgatacccttacgattctgctcaaagccaccctgctcgctgtcagcggcgtgtaccccatgtccatccctgcgacactgtttgtctggtatttctggcagaagaaaaagcagcgctctggcgtgctttgggacacccccagcccgcctgaggttgaaagagccgtgctggatgacgggatttaccggatcctgcagcgcggactcctgggcagatcccaagtcggggtgggagttttccaggatggcgtgtttcatacaatgtggcacgtcacccggggggctgtgcttatgtatcagggaaagagactggagccctcttgggccagcgtgaaaaaggacctcatctcctacggcggcgggtggcgcttccagggaagctggaacacaggcgaggaagttcaagtcattgccgtggagcctgggaaaaatcccaagaacgtgcagacgaccccgggaacatttaaaacccctgaaggcgaggtcggggctatcgccctggacttcaagcccggaacctctggctcccctattgtgaatcgggaaggcaagatcgttgggctctacggaaacggcgtggtcacaacgagcgggacctatgtgtctgcgattgctcaggccaaagcctcccaagagggacccctgcccgagatcgaagatgaggtttttaagaaaagaaatcttacaattatggacctgcaccctggcagcgggaagacccgccggtacctgccggctatcgtgagagaagccatcaaacgcaagctccggacactgattcttgcgcccaccagagtcgtggcttccgagatggccgaagccctgaagggcatgcctatccgctatcagacgacagctgttaaatctgagcataccggacgggagattgtggatctcatgtgccacgccaccttcacaatgagactgctgagccccgtccgggtgcctaactacaatatgatcattatggacgaagctcattttaccgatcccgcctccatcgcggcccgcggctatatcagcacaagagtggggatgggagaggctgccgctattttcatgaccgccacgcctccgggctctgtcgaagcctttccccagtccaacgctgttatccaggacgaggaacgggatattcctgagcgcagctggaattctgggtacgactggatcacagatttccccggaaagaccgtgtggtttgtgcctagcattaaatccggcaacgacatcgcgaattgtctcagaaagaacgggaaacgggtcatccaactttctagaaagacattcgataccgagtatcagaagacgaaaaacaatgactgggactacgtggttaccacagatattagcgaaatgggcgccaacttccgcgctgaccgggtgatcgatcccagacgctgcctgaagccggtcattctgaaagacggacctgagcgggtgatcctcgccggccccatgcccgttaccgtggcctccgctgcccagagacgcgggcggattggaagaaatcagaacaaggaaggcgatcaatacgtctatatggggcagcctctgaataacgacgaggatcacgcgcattggacagaggctaaaatgcttctggacaatatcaacacccccgaaggaattatccctgccctctttgagccggaacgcgagaagtctgccgctatcgatggcgaatacagactgcggggggaggcccgcaagacattcgtggagctgatgagacggggcgacctccccgtctggcttagctataaagtggcgtccgaaggatttcagtacagcgatcgcagatggtgcttcgacggcgagcggaataaccaggttctggaagagaatatggatgtggaaatttggaccaaggagggggagagaaaaaagctgcgccctcggtggctcgacgccagaacgtattctgaccccctggctcttcgcgaatttaaagagttcgccgctggacggagatccgtgagcggcgatctgatcctcgaaattgggaagctgcctcaacacctgacactccgggcccagaacgctcttgacaatctggtcatgctgcacaactccgagcagggaggcaaagcctaccgccatgcgatggaagagctccccgataccatcgagaccctgatgcttctggccctcattgctgttctgacaggcggggtgaccctgtttttcctctctggaaagggccttgggaagacaagcatcggactgctgtgtgtgacggcctcctctgctctcctgtggatggccagcgtcgaaccgcactggatcgccgcttccattatccttgagtttttcctgatggtgctcctgattcctgaacccgacagacagcggacccctcaagataatcagctggcgtatgttgtgatcggcctcctttttatgattctgacagtcgccgctaacgagatggggctgctcgagaccacaaaaaaggacctgggaatcggctacgtggccgccgaaaaccatcagcacgctaccatgcttgatgtcgacctgcaccccgccagcgcgtggacgctctacgccgtggctaccacagttatcacccctatgatgcgccatacaattgagaataccacggccaacatctctctgacagctattgccaatcaagcggccatcctgatgggcctcgataaagggtggcccatttccaagatggacatcggagtgccgcttctggctctgggctgctatagccaggtcaaccctctcaccctgacagccgctgtgcttatgctggttgcccactacgctattatcgggcccggactccaggccaaagcgaccagagaagcccagaagcggaccgctgccggcatcatgaagaatcccacagtggatgggattgtcgctatcgacctggatcctgtggtgtatgacgccaaattcgagaagcaactgggacagattatgctccttatcctgtgtacgtctcagattctgctcatgcgcaccacatgggccctgtgcgaatccatcacccttgcgacaggcccgctgaccacgctctgggagggcagccccgggaaattttggaacacaaccatcgctgtttctatggccaatattttcagaggaagctacctggctggcgccgggctggccttctccctcatgaagtctcttggaggcgggcggcgcggaaccggcgctcagggcgagacactgggggaaaaatggaagagacaactgaaccagctcagcaagtccgagtttaatacctataaacggagcggaatcatggaagtcgacagatccgaggccaaggaaggcctgaaacgcggggagacaacgaagcatgcggtgtctcggggaaccgccaaacttagatggttcgtggagcgcaacctggtcaagcctgaaggcaaggttattgatctcgggtgtggacggggcggctggagctactattgcgctgggctgaaaaaggtgacagaggtgaaaggatacaccaagggcgggcccggacacgaagagcctatccccatggccacatacggctggaatctggtcaaactccattccgggaaggacgtgtttttcatgcctccggaaaaatgtgatacccttctgtgcgacattggagagtctagccccaaccctacgatcgaggaaggcagaaccctgcgcgttctcaagatggtggagccctggctgcggggcaatcagttttgtatcaagattcttaacccttatatgccctccgtcgtggaaacactggagcagatgcaaagaaaacacgggggaatgctcgttcgcaatccgctgtctcggaacagcacccacgagatgtactgggtgtcctgcggcacagggaatatcgtcagcgctgtgaacatgacctctagaatgctgctcaaccgcttcacaatggcccatcggaagcctacctatgaaagagatgtggacctgggagcgggcacgcgccacgtcgccgttgagcccgaagtggctaatcttgatattatcgggcagagaattgagaacatcaaaaatgaacataagtccacatggcactacgacgaggataacccctataaaacctgggcctaccacggaagctatgaggtgaagccttctggctccgctagctctatggtcaatggcgtggttcggctgctcaccaagccctgggacgtgattcctatggtcacacagatcgccatgacggataccacaccgtttgggcaacagcgcgtgttcaaagaaaaggttgacaccagaacaccccgggctaaaagaggaaccacacagatcatggaggtgaccgccaagtggctgtggggctttctttcccggaacaaaaagcctcgcatttgtacgagagaagagttcacccggaaggtccgcagcaatgcggccatcggggctgtgtttgttgacgaaaaccagtggaattccgccaaagaggctgtggaggatgaaagattctgggacctggtccatcgggagcgcgaactccacaagcaaggaaaatgcgccacatgcgtgtacaacatgatgggcaagagagagaaaaagctgggggaatttggcaaggccaaaggaagccgggcgatttggtacatgtggctgggcgctcgcttcctcgagttcgaggccctggggtttatgaatgaagatcattggttctctagagagaacagcctttccggagtcgaaggcgaggggctgcacaagctcggatatatcctgcgggacatttctaaaatccccggcgggaatatgtacgccgatgacaccgctggctgggatacacgcatcaccgaggacgatcttcagaacgaagccaagattacggacatcatggagcctgaacatgctctgctcgccacaagcatttttaaactgacctatcagaataaggtggttagagtgcagcggcccgcgaaaaacggaacagtcatggatgtgatctcccgcagagaccaacggggctctgggcaggtgggaacctacggcctgaacacgttcaccaatatggaggttcagctcattagacagatggaaagcgaggggatctttctgccgtccgagcttgaaacacctaacctggccgagcgcgctctcgattggctggaaaagcacggagccgagcggcttaagagaatggctatctctggcgacgactgtgtggtcaaacccattgatgaccgcttcgccaccgcgctgacagccctcaatgatatggggaaggtgcggaaagacatccctcaatgggaacccagcaagggctggaacgattggcagcaggttcctttttgctcccaccatttccaccagctgattatgaaagacggaagagagatcgtggtcccctgtcgcaatcaagatgagctggtgggccgggctagagtcagccagggggccggatggtctctccgcgaaaccgcttgcctgggcaagtcctatgcccagatgtggcaacttatgtactttcatcggagagacctgcgcctcgctgccaacgcgatttgtagcgccgtgccggttgattgggtgcctacatctcggaccacgtggtccatccacgctcaccatcagtggatgacaaccgaggacatgctgagcgtctggaatagagtgtggatcgaagagaacccctggatggaagataagacccacgtttcctcttgggaggaggtgccctatcttgggaaacgggaagaccagtggtgcggaagcctgattggcctcacagccagagccacctgggctacaaatatccaggtcgccattaaccaagtgcgccggctgatcgggaatgagaactacctggactacatgacgtccatgaagagattcaaaaatgaaagcgatcctgagggcgcgctctggtga

SEQ ID NO: 18769 - RNA, 9879 nt, synthetic construct
  misc_feature 1..9879: note = derived and/or modified CDS sequence (opt5) from DENV-1__FJ639735__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgacagccctgtttctcgcgcatgccatcgggacctctattacccagaagggaatcatcttcattctgcttatgctggtcacacctagcatggctatgagatgcgtgggcatcgggaaccgggattttgttgagggactctccggcgccacgtgggtggacgtcgtgctggagcacgggagctgtgtgaccacaatggctaagaataaacccaccctggatattgaactcctgaagacagaggtcaccaaccctgccgttcttcgcaaactgtgcatcgaagcgaagatttctaatacgacaaccgactccagatgtccgacccaaggagaggccacactcgtggaagagcaggatgctaacttcgtgtgccggcgcacctttgtcgacagaggctggggcaatgggtgtggactgttcggcaaagggagccttctgacatgcgccaagtttaagtgcgtgacgaaactcgagggaaagatcgttcagtacgaaaacctgaaatattctgtgattgtcaccgtgcacacaggcgatcagcatcaagttgggaatgagaccacagaacacggaaccatcgctacgatcaccccccaggcccctacatccgagattcagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggctagcacctcccaagagacatggaatcgccaggatctgctggtgaccttcaaaaccgcgcacgccaagaagcaggaagtcgtggttctcggatctcaagagggcgctatgcacacagccctgacgggggccaccgaaatccagacaagcggaaccacaaccatttttgctggccatcttaaatgcagactgaagatggacaaactcacgctgaaggggacatcctatgtgatgtgtaccggcagcttcaaactggagaaggaagtcgccgagacccagcacggaacagtgcttgttcaggtgaagtacgagggcaccgatgcgccgtgcaaaatccctttctctacacaagacgaaaagggggtcacgcagaacggacggctcattaccgctaatcccatcgtgacagataaagagaagcctgtgaacatcgaaaccgagcccccctttggcgagtcctatattgttgtcggggccggagaaaaagccctgaagctgagctggttcaagaaaggctctagcatcgggaagatgtttgaggctacagccagaggcgctcgccggatggccattctcggagacaccgcgtgggatttcggctccatcgggggagtgtttacgtctgtgggcaaactggtccatcaggtgttcgggaccgcctacggagttctttttagcggcgtgtcctggacaatgaagattgggatcggcatcctgctcacctggctgggactgaatagcagatctacatcccttagcatgacctgtattgctgtcggcatggtgacactctacctgggggttatggtgcaggccgactctggatgcgtcatcaactggaaaggccgcgaactgaagtgtgggtccggaattttcgtgaccaacgaggttcacacgtggacagaacaatataagtttcaggctgatagccctaaacggctctccgccgcgatcggcaaggcctgggaggagggggtgtgcggcattagatctgctacccgcctggaaaatatcatgtggaaacagattagcaacgagcttaatcatatcctgctcgaaaacgacatgaagttcaccgtcgtggtgggagacgccaatggcatcctggctcaggggaaaaagatgattcggccgcaacccatggagcacaaatactcctggaagtcttggggaaaggccaaaatcattggcgccgatatccagaacacaacctttattatcgacgggcctgatacgcccgaatgtcctgacgatcagagagcttggaatatctgggaggtcgaggactatggattcggcatttttacaaccaacatctggctgaagcttcgcgatagctacacacagatgtgcgaccaccggctcatgtccgcggccattaaagatagcaaggctgttcatgccgacatgggctattggatcgaatctgagaaaaatgaaacctggaagctggccagagcttccttcattgaggtgaagacatgtacctggcccaaaagccacacgctgtggtctaacggggtgctcgaatccgagatgatcatcccgaagatttacggaggccctatcagccaacataattatcgccccgggtacttcacccagacagccggaccttggcacctgggcaaacttgagctggattttaacctctgcgaagggaccacagtcgtggttgacgagcactgcggaaatcggggcccctctctgagaaccacgacagtgaccggcaagattatccatgaatggtgttgccggagctgtacactgcctccccttcgcttcagaggggaggatggatgctggtacggcatggagattcggccggtcaaagaaaaggaggaaaacctcgtgagatccatggttagcgcggggtctggagaggtggactcctttagcctgggcatcctgtgtgtctccatcatgattgaagaggtgatgcgctctcggtggagcagaaagatgctcatgaccgggaccctggctgttttccttctgctcatcatgggacagctgacatggaatgacctgattcgcctttgcatcatggtgggcgccaacgcctccgatagaatgggcatggggacgacctatctggctctcatggccacatttaaaatgcggcctatgttcgcggtcggactgctctttcgcagactgacctctcgggaggtgcttctgctcacaattggcctgagcctggtggcttccgtcgaacttcccaactctctggaggaactcggggacggactggccatgggcatcatgatgctcaagctgcttaccgagttccaaccccaccagctgtggacgacactcctgagcctgacctttattaaaaccacactttccctggattacgcctggaagaccacagctatggccctcagcatcgtttctctgttccctctctgtctgtccacgaccagccagaaaacaacctggcttccggtgctgctggggtcttttggatgcaagcccctcacaatgttcctgatcaccgaaaataagatttggggccgcaaatcctggcctcttaacgagggcatcatggctattgggatcgtgagcattctgctctcttccctgctcaagaatgacgtccccctggccggacctcttatcgcgggcgggatgctgatcgcctgttatgtgattagcggatccagcgctgatctgtctctcgagaaagccgctgaagttagctgggagcaggaagccgagcattccggcacgtctcacaacatcctggtggaagtccaagacgatgggaccatgaagattaaagacgaggagaaggatgacacacttaccatcctgctcaaagccacactgctcgctgtgagcggagtttaccccatgtccattcctgcgaccctgtttgtgtggtatttctggcagaagaagaaacagagatctggcgtcctttgggatacacccagcccgcctgaagtggagcgggccgtcctggacgatggcatctaccgcatcctgcagagagggctcctgggacggtcccaagtgggcgttggggtgttccaggacggagtctttcatacgatgtggcacgtgacccgcggcgctgttcttatgtatcaggggaagagactggaaccctcttgggccagcgtgaaaaaggacctcatttcctacggaggcggctggcggttccaggggagctggaatacaggagaggaggtccaagtgatcgccgtggaacctggcaaaaaccccaagaatgttcagaccaccccggggacatttaagacgcctgagggagaagtcggcgctattgccctggatttcaaacccgggacctctggatcccctatcgtgaacagagagggcaagattgtgggcctctacgggaatggagtcgtgacaaccagcggcacatatgtttctgcgatcgctcaggccaaagcctcccaagaagggcccctgcccgagattgaggacgaagtgtttaagaaacgcaaccttaccatcatggatctgcaccctggaagcggcaagacgcggagatacctgccggctatcgtccgcgaggccattaagcggaaactcagaacactgatccttgcgcccacccgcgtggttgcttccgaaatggccgaggccctgaaggggatgcctattcggtatcagaccacagctgtgaaatctgaacataccggcagagagatcgtcgacctcatgtgccacgccacattcaccatgcgcctgctgagccccgtgcgggttcctaattacaacatgattgtgatggatgaggctcattttacggaccccgcctccatcgcggccagaggatatatcagcacacgggtcggcatgggggaagctgccgctattttcatgaccgccacacctccgggatctgtggaggcctttccccagtccaatgctgtgatccaggatgaagagcgcgacattcctgaaagaagctggaactctggctacgattggatcaccgacttccccgggaagacggtctggtttgttcctagcattaaatccggaaatgatatcgcgaactgtctccggaagaacggcaagcgcgtgatccaactttctagaaaaaccttcgacacagagtatcagaagaccaaaaataacgactgggattacgtggtcacaaccgacattagcgagatgggggccaatttccgggctgatagagtgatcgacccccgccggtgcctgaagccggttattctgaaagatggccctgaaagagtgatcctcgccggacccatgcccgtcacagtggcctccgctgcccagcgccggggcagaattgggcgcaaccagaataaggagggagaccaatacgtttatatgggccagcctctgaacaatgatgaagaccacgcgcattggaccgaggctaagatgcttctggataacatcaatacgcccgaggggattatccctgccctctttgaaccggagcgggaaaaatctgccgctatcgacggagagtacagactgcgcggcgaagccagaaagacattcgtggagctgatgcggcgcggggatctccccgtctggcttagctataaagtggcgtccgagggctttcagtacagcgacagacggtggtgcttcgatggagaacgcaacaatcaggtcctggaggaaaacatggacgtggagatttggaccaaggaaggcgagagaaaaaagctgcggcctagatggctcgacgcccgcacctattctgatcccctggctcttcgggagtttaaagaattcgccgctgggagacgctccgttagcggagacctgatcctcgagattggcaagctgcctcaacacctgacactccgggcccagaatgctcttgataacctggtgatgctgcacaattccgaacaggggggaaaggcctacagacatgcgatggaggaactccccgacaccatcgagacactgatgcttctggccctcattgctgtgctgacgggcggcgtcaccctgtttttcctctctgggaaaggacttggcaagacaagcatcgggctgctgtgtgttaccgcctcctctgctctcctgtggatggccagcgtggagccgcactggatcgccgcttccattatccttgaatttttcctgatggtgctcctgattcctgagcccgatcggcagcgcacacctcaagacaaccagctggcgtatgtcgtgatcggactcctttttatgattctgaccgttgccgctaacgaaatgggcctgctcgagacgaccaaaagagatctggggatcggacatgtggccgccgagaatcaccagcacgctacaatgcttgacgtcgatctgcggcccgccagcgcgtggaccctctacgccgtggctacaaccgtcatcacgcctatgatgcgccatacaattgaaaacaccacagccaatatctctctgaccgctattgccaaccaagcggccatcctgatgggcctcgacaagggctggcccatttccaaaatggatatcggggtgccgcttctggctctgggatgctacagccaggttaatcctctcaccctgacagccgctgtgcttatgctggtcgcccactatgctattatcggccccgggctccaggccaaggcgacgagagaggcccagaagcggaccgctgccggaatcatgaaaaaccccacagtggacggcattgttgctatcgatctggaccctgtggtctacgacgccaagttcgaaaaacaactggggcagattatgctccttatcctgtgtacctctcagattctgctcatgcgcacaacctgggccctgtgcgagtccatcacgcttgcgacaggaccgctgaccaccctctgggaaggcagccccggcaagttttggaatacaaccatcgctgtgtctatggccaacattttcagagggagctatctggctggagccggcctggccttctccctcatgaaatctcttgggggaggccggcgcgggacaggagctcagggcgagacgctgggcgagaagtggaagagacaactgaatcagctcagcaaatccgaatttaacacctacaagcggagcgggatcatggaggtggatagatccgaagccaaagagggactgaagcgcggcgaaacaaccaaacatgcggtttctcgggggacagccaagcttagatggttcgtcgagcgcaatctggtgaagcctgagggaaaagtgattgacctcggctgtgggcggggaggctggagctattactgcgctggcctgaagaaagtcaccgaagttaaggggtatacgaaaggaggccccgggcacgaggaacctatccccatggccacctacggatggaacctggtgaagctccattccggcaaagatgtgtttttcatgcctccggagaagtgtgacacacttctgtgcgatattggggaatctagccccaatcctaccatcgaggagggaagaacactgcgcgtcctcaagatggtggaaccctggctgcggggcaaccagttttgtatcaaaattcttaatccttacatgccctccgttgtggagaccctggaacagatgcaaagaaagcacggcgggatgctcgtccgcaacccgctgtctcggaatagcacacacgagatgtattgggtgtcctgcggaaccggcaacatcgttagcgctgtgaacatgacgtctagaatgctgctcaatcgcttcacaatggcccatcggaaacctacctacgagagagacgtcgatctgggggcgggaacccgccacgtggccgtggaacccgaggtcgctaaccttgacattatcggccagagaattgaaaatatcaagaacgagcataaatccacatggcactatgatgaagacaatccctacaagacgtgggcctatcacgggagctacgaggttaagccttctggatccgctagctctatggtgaacggcgtggtccggctgctcaccaaaccctgggatgtgattcctatggttacacagatcgccatgaccgacacaaccccgtttggccaacagcgcgtgttcaaggagaaagtcgacacaagaaccccccgggctaagagagggacgacccagatcatggaagtgacagccaaatggctgtggggatttctttcccggaataagaagcctcgcatttgtaccagagaggaattcacacggaaagttcgcagcaacgcggccatcggcgctgtgtttgtcgatgagaatcagtggaactccgccaaggaagctgtggaggacgagagattctgggatctggttcatcgggaacgcgagctccacaaacaagggaagtgcgccacctgcgtgtataatatgatgggaaaaagagaaaagaagctgggcgagtttgggaaagccaagggcagccgggcgatttggtacatgtggctgggagctcgcttcctcgaattcgaggccctgggctttatgaacgaggaccattggttctctagagaaaatagcctttccggggtcgagggagaaggcctgcacaaactcgggtacatcctgcgggatatttctaagatccccggaggcaacatgtatgccgacgatacggctgggtgggacacacgcatcaccgaggatgaccttcagaatgaggccaaaattacagatatcatggaacctgagcatgctctgctcgccaccagcatttttaagctgacgtaccagaacaaagtggtcagagtgcagcggcccgcgaagaacggcaccgttatggacgtgatctcccgcagagatcaacggggatctggccaggtcgggacatatggactgaataccttcacaaacatggaagtgcagctcattagacagatggagagcgaaggcatctttctgccgtccgagcttgagacccctaatctggccgaacgcgtgctcgactggctggagaagcacggggctgaacggcttaaaagaatggccatctctggagacgattgtgttgtgaagcccattgacgatcgcttcgctacagccctgaccgcgctcaacgacatgggcaaagtccggaaggatatccctcaatgggagcccagcaaagggtggaatgactggcagcaggtgcctttttgctcccaccatttccaccagctgattatgaaggatggcagagaaatcgttgtgccctgtcgcaaccaagacgagctggtcggacgggccagagtgagccagggcgctgggtggtctctccgcgagacggcctgcctgggaaagtcctacgctcagatgtggcaacttatgtattttcatcggagagatctgcgcctcgccgctaatgccatttgtagcgcggtcccggtggactgggttcctacatctcggaccacctggtccatccacgcccaccatcagtggatgacaaccgaagatatgctgagcgtgtggaacagagtctggatcgaggaaaatccctggatggaggacaaaacacacgtgtcctcttgggaagaggttccctaccttggcaagcgggaggaccagtggtgcgggagcctgattggactcacggctagagccacctgggccacaaacatccaggtggctattaatcaagtccgccggctgatcggcaacgaaaattatctggattacatgacctccatgaaaagattcaagaacgagagcgaccctgaaggggccctctggtga

SEQ ID NO: 18770 - RNA, 9879 nt, synthetic construct
  misc_feature 1..9879: note = derived and/or modified CDS sequence (opt5) from DENV-1__FJ639740__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacactggtcgacagaggctggggcaatgggtgtggactttttggcaaagggagcctgctcacctgcgccaagttcaagtgcgtgacaaaactggagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctcacagactacggcgccctgacccttgactgtagcccccggacaggcctggattttaacgaaatggtgctcctgaccatgaaggagaaatcttggcttgtccataagcagtggttcctggacctccctctgccctggacgtccggggctagcacatcccaagagacctggaatcgccaggatctgctcgtgacatttaaaaccgcgcacgccaagaagcaggaagtcgtggttctgggatctcaagagggcgctatgcacaccgcccttacaggggccacggaaattcagaccagcggaacaaccacaatcttcgctggccatctgaaatgcagactcaagatggacaaactgaccctgaaggggatgtcctatgtgatgtgtacgggcagctttaaacttgagaaggaagtcgccgagacacagcacggaaccgtgctcgttcaggtgaagtacgagggcaccgatgcgccgtgcaaaattcctttcgctacacaagacgaaaagggggtcacccagaacggacggctgatcacagccaatcccatcgtgacggataaagagaagcctgtgaacattgaaaccgagccccccttcggcgagtcttatatcgttgtcggggccggagaaaaagctctgaagctctcctggtttaagaaaggcagctctattgggaagatgttcgaggccacagctagaggcgcccgccggatggcgatcctgggagacaccgcctgggattttggcagcattgggggagtgttcacatccgtgggcaaacttgtccatcaggtgtttgggaccgcttacggagttctgttctctggcgtgagctggacgatgaagatcgggatcggcattctcctgacctggctgggacttaattccagaagcacatctctctccatgacctgtatcgccgtcggcatggtgacactgtacctgggggttatggtgcaggctgacagcggatgcgtcattaactggaaaggccgcgaactcaagtgtgggtctggaatctttgtgaccaacgaggttcacacatggaccgaacaatataagttccaggccgattcccctaaacggctgagcgcggccattggcaaggcttgggaggagggggtgtgcggcatcagatccgccacgcgccttgaaaatattatgtggaaacagatctctaacgagctgaatcatatcctcctggaaaacgacatgaagtttacagtcgtggtgggagacgctaatggcattctggcccaggggaaaaagatgatccggccgcaacccatggagcacaaatacagctggaagtcctggggaaaggccaaaattatcggcgctgatattcagaacaccaccttcatcatcgacgggcctgatacacccgaatgtcctgacggacagagagcgtggaatatttgggaggtcgaggattatggctttggcatcttcaccacgaacatttggcttaagctccgcgactcttacacacagatgtgcgatcaccggctgatgagcgccgctatcaaagactccaaggccgttcatgccgatatggggtattggattgaaagcgagaaaaatgaaacctggaagctggctagagcctcttttatcgaggtgaagacatgtacctggcccaaatcccacacactctggagcaacggagtgctggaatctgagatgatcattccgaagatctacggcgggcctatttcccaacataattatcgccccggatacttcacccagacggcgggcccttggcaccttgggaaactggagctcgacttcgatctgtgcgaaggaaccacagtcgtggttgacgagcactgcggcaaccggggccccagcctgagaaccacaaccgtgacggggaagatcattcatgaatggtgttgccggtcttgtacacttcctcccctccgctttagaggagaggatggctgctggtacgggatggagatccggccggtcaaagaaaaggaggaaaatctggtgagaagcatggtttccgctggaagcggcgaggtggactctttctccctggggatcctctgtgtcagcattatgatcgaagaggtgatgcgctcccggtggtctagaaagatgctgatgaccggaacacttgccgtttttctgctcctgattatgggccagctgacctggaacgaccttatccgcctgtgcattatggtgggcgccaatgctagcgatagaatggggatgggaaccacatatctcgccctgatggcgacgttcaaaatgcggcctatgtttgctgtcggcctcctgttccgcagacttacctcccgggaggtgctgctcctgacaatcgggctgtctcttgtggccagcgtcgaactgcccaactccctcgaggaactgggagacggcctcgccatggggattatgatgctgaagcttctgaccgagtttcaaccccaccagctctggacaaccctgctgtctcttacgttcgttaaaacaaccctgagcctcgattacgcttggaagaccacagccatggtgctgtccatcgtgagcctctttcctctgtgtctttctaccacatcccagaaaacgacctggctgccggtcctgctcggaagcttcggctgcaagcccctgacaatgtttcttatcaccgaaaacaagatttggggccgcaaatcttggcctctgaatgaggggatcatggctattggaatcgtgtccattctcctgagctctctcctgaagaacgacgttccccttgccggccctctgatcgcggggggaatgctgatcgcctgttatgtgatttccggcagctccgctgatctcagcctggagaaagccgctgaagtctcttgggagcaggaagccgagcatagcggggcctcccacaatatccttgtggaagttcaagacgatggaacaatgaagattaaagacgaggagagagatgacaccctgacgatcctcctgaaggctaccctcctggcggtgtctggcgtctaccccatgagcattcctgccacacttttcgtgtggtatttttggcagaaaaagaagcagcggtccggcgtcctgtgggataccccctctccgcctgaagtggagcgcgctgttctggacgatgggatctacagaatcctccagcggggactgcttggccgcagccaagtgggggtcggagtgttccaggacggcgttttccatacaatgtggcacgtgaccagaggggccgtcctgatgtatcagggaaaacggctcgaaccctcctgggcctctgtgaagaaagacctgattagctacggcggcgggtggagatttcagggatcctggaacacaggcgaggaggtgcaagttatcgctgtcgaacctgggaagaatcccaaaaacgtgcagacgaccccgggaacattcaagacccctgagggcgaagtgggggccattgcgctcgattttaagcccggaaccagcggctctcctatcgtcaatcgcgagggcaaaattgtggggctgtacggaaacggcgttgtgacaacgtccgggacctatgtcagcgctatcgcccaggccaaggcttctcaagaaggaccccttcccgagattgaggacgaagtgttcaaaaagcggaatctgacaatcatggatctgcaccctggctccgggaaaaccagacgctacctcccggccatcgttcgggaggcgattaagagaaagctgcgcacacttatcctggctcccacccgggtggtcgccagcgaaatggccgaggctctcaaaggcatgcctattagatatcagacgacagccgtgaagtccgaacataccggacgcgagatcgttgacctgatgtgccacgctacctttacaatgcggctgctctctcccgtgagagtccctaactacaatatgattatcatggatgaggcccatttcaccgaccccgcgagcatcgccgctcggggctatatttccacacgcgtggggatgggagaagccgctgccatctttatgaccgccacgcctccgggcagcgtggaggctttcccccagtctaacgcggtcattcaggatgaagagagagacatccctgaacggtcctggaatagcgggtacgattggattacagactttcccggaaaaaccgtttggttcgtgccttctatcaagagcggcaacgatatcgccaattgtcttcgcaaaaacgggaagagagtgattcaactgtcccggaagacatttgacaccgagtatcagaaaacgaagaacaatgactgggattacgtcgtgaccacagacatctctgagatgggcgctaacttcagagccgatcgcgttattgacccccggagatgcctgaaaccggtgatcctcaaggatggacctgaacgcgtcattctggccggccccatgcccgtgaccgttgctagcgccgcgcagcggagagggcgcatcggacggaatcagaacaaagagggcgaccaatacgtgtatatggggcagcctcttaataacgatgaagaccacgctcattggacagaggccaagatgctgctcgataatattaacacccccgagggaatcatccctgccctgttcgaaccggagagagaaaagtccgctgccattgacggcgagtaccgcctgagaggggaagcgcggaaaacatttgtcgagctcatgcgcagaggcgatcttcccgtgtggctgtcttataaggtcgccagcgagggattccagtactccgaccggcgctggtgctttgatggcgaaagaaataaccaggtgctggaggaaaatatggacgttgagatctggaccaaagaaggggagcggaagaaactcagacctcgctggctggacgctcggacgtatagcgatccccttgccctgagagagttcaaggaatttgctgccggacgccggtctgtgtccggcgacctcattctggagatcgggaaactgcctcaacacctcacacttagagctcagaacgccctggataatctggtgatgctccacaacagcgaacagggaggcaaggcgtaccggcatgccatggaggaactgcccgacaccattgagacccttatgctgctcgctctgatcgccgtcctgacaggcggggttaccctcttctttctttccggaaagggcctggggaaaacatctatcggactgctctgtgtgacggctagctccgccctgctttggatggcctctgtggagccgcactggattgctgcgagcatcattctggaattctttctcatggtcctgctgatccctgagcccgatcgccagagaacccctcaagacaatcagctcgcctatgtggttattggccttctgttcatgatcctgacagtggctgccaacgaaatggggctcctggagaccacaaagaaagatcttggaatcggctacgtcgccgctgagaaccatcagcacgccaccatgctggacgtggatctccggcccgcgtccgcctggacgctgtacgctgtcgccaccacagtgattacccctatgatgcgccacacaatcgaaaataccacggctaacattagcctgacagccatcgcgaatcaagccgctattctcatgggccttgacaaggggtggcccatctctaaaatggatattggagttccgctgctggccctcggctgctattcccaggtgaaccctctgacccttacagctgccgtcctgatgctcgtggctcattacgccatcatcgggcccggactgcaggcgaaggccaccagagaggctcagaagcggaccgccgctggcattatgaaaaatcccacagttgacgggatcgtggccattgatctggaccctgtcgtgtatgacgccaagtttgaaaaacaactcggacagatcatgcttctgattctgtgtacgagccagatcctcctgatgcgcaccacatgggcgctttgcgagtctatcaccctggctacaggcccgctcaccacgctgtgggaaggctcccccgggaagttctggaacacaaccattgccgtgagcatggctaatatctttagaggatcttacctggccggcgccgggctcgctttcagccttatgaaatccctgggaggcgggcggcgcggaaccggcgcccagggcgagacactgggggagaagtggaagagacaactcaaccagctgtctaaaagcgaattcaatacctataagcggtccggaattatggaggttgatagaagcgaagcgaaagagggccttaagcgcggggaaacaacgaaacacgccgtctcccggggaaccgctaagctgagatggtttgtggagcgcaacctcgtgaagcctgagggcaaagtcatcgacctggggtgtggacggggcggctggtcttactattgcgccgggctgaagaaagttacagaagtgaagggatacaccaaaggcgggcccggacatgaggaacctattcccatggctacatacggctggaatctcgtgaagcttcacagcgggaaagatgtcttctttatgcctccggagaagtgtgacaccctgctgtgcgatatcggagaatcctctcccaaccctacgatcgaggagggcagaaccctccgcgtgctgaagatggttgaaccctggcttcggggcaatcagttctgtattaaaatcctgaacccttatatgcccagcgtggtcgagacactcgaacagatgcaaagaaagcatgggggaatgctggtgcgcaatccgctgtcccggaactctacccacgagatgtactgggttagctgcggcacagggaatattgtgtccgccgtcaacatgaccagcagaatgctcctgaaccgctttacaatggcgcaccggaaacctacctatgagagagacgtggatcttggagccggcacgcgccatgtggctgtcgaacccgaggaagccaatctggacatcattgggcagagaatcgagaacattaagaatgaacacaaatctacatggcattacgatgaggacaacccctataagacctgggcttaccacggatcctatgaggttaagcctagcggctctgcctccagcatggtgaatggcgtggtccggctcctgaccaaaccctgggatgtgatccctatggttacacagatcgctatgacggacaccacaccgttcgggcaacagcgcgtgtttaaggaaaaagtcgacaccagaacaccccgggccaagagaggaaccacacagattatggaggtgaccgcgaaatggctttggggcttcctgtctcggaacaagaagcctcgcatctgtacgagagaagagtttacccggaaagttcgctccaatgccgctattggggccgtgttcgtcgatgaaaaccagtggaatagcgctaaggaggccgtggaggacgaaagattttgggatctcgttcaccgggagcgcgaactgcataaacaaggaaagtgcgccacatgcgtgtacaacatgatgggcaaaagagagaagaagctgggggaattcggcaaagcgaagggatcccgggctatctggtacatgtggctcggcgcccgctttctggagttcgaggcccttgggttcatgaatgaagaccactggtttagcagagagaactctctgagcggagtcgaaggcgaggggctccataaactgggatatattcttcgggatatctccaagatccccggcgggaatatgtacgctgacgataccgccggctgggacacacgcattaccgaggatgacctgcagaacgaagctaaaatcacggatattatggagcctgaacacgccctcctggcgacatctatcttcaagctgacctatcagaataaagtggtcagagtgcagcggcccgccaagaacggaacagttatggacgtgattagccgcagagatcaacggggctccgggcaggtcggaacctacggcctcaacacgtttaccaatatggaggtgcagctgatcagacagatggaatctgaggggatcttccttccgagcgagctggaaacacctaacctcgctgagcgcgtgctggactggcttgaaaagcatggagccgagcggctgaaaagaatggctatttccggcgacgattgtgttgtgaagcccatcgacgatcgctttgccaccgcgctcacagccctgaatgacatggggaaagtccggaaggatattcctcaatgggaaccctctaaaggctggaacgactggcagcaggtgcctttctgcagccaccactttcatcagctgatcatgaaggatggaagagagattgttgtgccctgtcgcaatcaagacgagctcgtcggccgggctagagtgtcccagggggccggatggagcctgcgcgaaaccgcttgccttggcaagtcttatgcccagatgtggcaactgatgtacttccaccggagagatctccgcctggctgccaacgcgatctgttccgccgtcccggtggactgggttcctacaagccggaccacgtggtctatccatgctcaccaccagtggatgacaaccgaggatatgctttccgtgtggaatagagtctggattgaagagaacccctggatggaagacaaaacccatgtgagctcctgggaggaggttccctatctggggaagcgggaagaccagtggtgcggatctctcatcggcctgacagccagagccacctgggctacaaatattcaggtggccatcaaccaagtccgccggctgattgggaatgagaactacctcgattacatgacgagcatgaaaagatttaagaatgaatccgaccctgagggcgcgctgtggtga

SEQ ID NO: 18771 - RNA, 9879 nt, synthetic construct
  misc_feature 1..9879: note = derived and/or modified CDS sequence (opt5) from DENV-1__FJ639741__SS-prME
  source 1..9879: mol_type = other RNA
agcgtgaccatcctgctcatgctgcttcccacagccctggctttccacctcacgaccagaggcggggagcctcatatgattgtctccaagcaggaacggggaaaatctctgctttttaagacaagcgccggcgttaacatgtgcaccctgatcgcgatggacctcggggagctgtgtgaagatacaatgacctacaaatgcccgcgcattacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagatccagcgggttgaaacatgggctcttcgccaccccggcttcaccgtgattgccctgtttctcgcgcatgccatcgggacatctatcacccagaagggaattatcttcattctgcttatgctggtcacccctagcatggctatgagatgcgtgggcatcgggaaccgggattttgttgagggactctccggcgccacatgggtggacgtcgtgctggagcacgggagctgtgtgacgaccatggctaagaataaacccacactggatattgaactcctgaagaccgaggtcacaaaccctgccgttcttcgcaaactgtgcatcgaagcgaagatttctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagatcgttcagtacgaaaacctgaaatattctgtgatcgtcacggtgcacaccggcgatcagcatcaagttgggaatgagacaaccgaacacggaacaattgctaccatcacgccccaggcccctacctccgagattcagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccgggacaagcacctcccaagagacatggaatcgccaggatctgctggtgaccttcaaaaccgctcacgcgaagaagcaggaagtcgtggttctcggatctcaagagggcgccatgcacacagctctgacgggggccaccgaaatccagacaagcggaaccacaaccatttttgccggccatcttaaatgcagactgaagatggacaaactcacgctgaaggggacatcctatgtgatgtgtaccggcagcttcaaactggagaaggaagtcgctgagacccagcacggaacagtgcttgttcaggtgaagtacgagggcaccgatgccccgtgcaaaatccctttctctacacaagacgaaaagggggtcacgcagaacggacggctcatcaccgcgaatcccattgtgacagataaagagaagcctgtgaacatcgaaaccgagcccccctttggcgagtcctatattgttgtcggggctggagaaaaagccctgaagctgagctggttcaagaaaggctctagcatcgggaagatgtttgaggccacagctagaggcgcccgccggatggctattctcggagacaccgcctgggatttcggctccatcgggggagtgtttacgtctgtgggcaaactggtccatcaggtgttcgggaccgcgtacggagttctttttagcggcgtgtcctggacaatgaagatcgggattggcatcctgctcacctggctgggactgaatagcagatctacatcccttagcatgacctgtattgccgtcggcatggtgacactctacctgggggttatggtgcaggctgactctggatgcgtcatcaactggaaaggccgcgaactgaagtgtgggtccggaattttcgtgaccaacgaggttcacacgtggacagaacaatataagtttcaggccgatagccctaaacggctctccgctgccatcggcaaggcgtgggaggagggggtgtgcggcattagatctgccacccgcctggaaaatatcatgtggaaacagatcagcaacgagcttaatcatattctgctcgaaaacgacatgaagttcaccgtcgtggtgggagacgctaatggcatcctggcccaggggaaaaagatgattcggccgcaacccatggagcacaaatactcctggaagtcttggggaaaggctaaaatcattggcgccgatatccagaacacaacctttatcattgacgggcctgatacgcccgaatgtcctgacgatcagagagcctggaatatctgggaggtcgaggactatggattcggcatttttacaaccaacatctggctgaagcttcgcgatagctacacacagatgtgcgaccaccggctcatgtccgctgcgattaaagatagcaaggccgttcatgctgacatgggctattggatcgaatctgagaaaaatgaaacctggaagctggccaaggcctccttcatcgaggtgaaaacatgtatttggcccaagagccacaccctgtggtctaacggggtgctcgaatccgagatgatcattccgaaaatctacggaggccctattagccaacataattatagacccgggtacttcacgcagaccgctggaccttggcacctgggcaagcttgagctggattttgacctctgcgaagggacaaccgtcgtggttgatgagcactgcggaaaccgcggcccctctctgcggacaaccacggtgacaggcaaaatcatccatgaatggtgttgcagaagctgtaccctgcctccccttcggttccgcggggaggacggatgctggtacggcatggagattagaccggtcaaggaaaaggaggaaaatctcgtgcggtccatggttagcgccgggtctggagaggtggactcctttagcctgggcatcctgtgtgtctccattatgatcgaagaggtgatgagatctcgctggagccggaaaatgctcatgacagggaccctggcggttttccttctgctcattatgggacagctgacctggaacgatctgatcagactttgcattatggtgggcgctaatgcctccgaccgcatgggcatggggacaacgtatctggccctcatggctacctttaagatgagacctatgttcgccgtcggactgctctttcggcgcctgacatctagagaggtgcttctgctcaccatcggcctgagcctggtggcgtccgtcgaacttcccaactctctggaggaactcggggatggactggctatgggcatcatgatgctcaaactgcttacagagttccaaccccaccagctgtggaccacgctcctgagcctgacatttattaagaccaccctttccctggactacgcctggaaaacaaccgccatggttctcagcatcgtgtctctgttccctctctgtctgtccacaacgagccagaagaccacatggcttccggtgctgctggggtcttttggatgcaagcccctcaccatgttcctgattacagaaaacaaaatctggggccggaagtcctggcctcttaatgagggcattatggctatcgggatcgtcagcattctgctctcttccctgctcaaaaacgatgtgcccctggccggacctcttatcgctggcgggatgctgattgcctgttatgttatcagcggatccagcgcggacctgtctctcgagaaggccgctgaagtgagctgggagcaggaagccgagcattccggcacctctcacaatattctggtcgaagtgcaagatgacgggacgatgaaaatcaaggatgaggagcgcgacgatacccttacaatcctgctcaaagctaccctgctcgccgttagcggagtgtaccccatgtccattcctgccacactgtttgtctggtatttctggcagaagaagaaacagagatctggcgtgctttgggacacccccagcccgcctgaagtcgagcgggctgtgctggatgacggcatctaccgcattctgcagagagggctcctgggacggtcccaagttggcgtgggggtcttccaggacggagtgtttcatacaatgtggcacgttacgcgcggcgcggtgcttatgtatcaggggaagagactggaaccctcttgggccagcgtcaaaaaggatctcatctcctacggaggcggctggcggttccaggggagctggaacaccggagaggaggtgcaagtgattgctgttgaacctggcaaaaatcccaagaacgtccagacaaccccggggacctttaagacacctgagggagaagtgggcgccatcgccctggacttcaaacccgggacgtctggatcccctattgtgaatagagagggcaagatcgtcggcctctacgggaacggagtggttaccacaagcggcacctatgtgtctgctatcgcccaggcgaaagcttcccaagaagggcccctgcccgagattgaggatgaagtctttaagaaacgcaatcttacaatcatggacctgcaccctggaagcggcaagacccggagatacctgccggccattgtgcgcgaggccatcaagcggaaactcagaacgctgattcttgctcccacacgcgttgtggcctccgaaatggcggaggctctgaaggggatgcctatccggtatcagaccaccgccgtcaaatctgaacatacaggcagagagatcgtggatctcatgtgccacgccaccttcacaatgcgcctgctgagccccgttcgggtgcctaactacaatatgattatcatggacgaggctcattttaccgatcccgcctccattgctgccagaggatatatcagcacgcgggtcggcatgggggaagcggccgctattttcatgacagccacccctccgggatctgtggaggcttttccccagtccaacgccgtgatccaggacgaagagcgcgatatccctgaaagaagctggaattctggctacgactggattacagatttccccgggaagaccgtctggtttgttcctagcatcaaatccggaaacgacattgccaattgtctccggaagaacggcaagcgcgtgatccaactttctagaaaaacgttcgacaccgagtatcagaagacaaaaaacaatgattgggactacgtggtcaccacagatattagcgagatgggggctaacttccgggcggacagagtgatcgatccccgccggtgcctgaagccggttattctgaaagacggccctgaaagagtgatcctcgccggacccatgcccgtcaccgtggcttccgccgcccagcgccggggcagaatcgggcgcaatcagaacaaggagggagatcaatacgtttatatgggccagcctctgaataacgacgaagatcacgctcattggacagaggccaagatgcttctggacaatattaacacccccgaggggatcattcctgcgctctttgaaccggagcgggaaaaatctgctgccatcgatggagagtacagactgcgcggcgaagccagaaagacgttcgtggagctgatgcggcgcggggacctccccgtctggcttagctataaagtggcttccgagggctttcagtacagcgatagacggtggtgcttcgacggagaacgcaataaccaggtcctggaggaaaatatggacgtggagatttggacaaaggaaggcgagagaaaaaagctgcggcctagatggctcgatgcccgcacctattctgaccccctggcgcttcgggagtttaaagaattcgccgctgggagacgctccgttagcggagatctgatcctcgagatcggcaagctgcctcaacacctgaccctccgggcccagaacgctcttgacaatctggtgatgctgcacaactccgaacaggggggaaaggcctacagacatgctatggaggaactccccgatacaattgagaccctgatgcttctggccctcatcgcggtgctgacaggcggcgtcacgctgtttttcctctctgggaaaggacttggcaagaccagcattgggctgctgtgtgttacagcctcctctgctctcctgtggatggccagcgtggagccgcactggatcgctgcctccattatccttgaatttttcctgatggtgctcctgatccctgagcccgaccggcagcgcacccctcaagataatcagctggcctatgtcgtgattggactcctttttatgatcctgacagttgctgcgaacgaaatgggcctgctcgagaccacgaaaaaggacctggggattggacatgtggccgctgagaaccaccagcacgccaccatgcttgatgtcgacctgagacccgccagcgcttggacactctacgccgtggcgaccacagtcatcacccctatgatgcggcatacgattgaaaatacaaccgccaacatctctctgacagctattgccaatcaagctgccatcctgatgggcctcgataaaggctggcccatctccaagatggacattggggtgccgcttctggcgctgggatgctacagccaggttaaccctctcaccctgaccgccgctgtgcttatgctggtcgcccactatgctatcattggccccgggctccaggccaaggctacacgcgaggcccagaaaagaacggcggccggaatcatgaagaatcccaccgtggatggcattgttgctatcgacctggaccctgtggtctacgatgccaaattcgaaaagcaactggggcagatcatgctccttattctgtgtacatctcagatcctgctcatgcggaccacatgggctctgtgcgagtccattacccttgccacgggaccgctgacaaccctctgggaaggcagccccggcaaattttggaacaccacaatcgccgtgtctatggcgaatattttccgcgggagctatctggctggagccggcctggctttctccctcatgaagtctcttgggggaggcagacgggggaccggagcccagggcgagacactgggcgagaagtggaaacgccaactgaaccagctcagcaagtccgaatttaatacgtacaaaagaagcgggatcatggaggtggaccggtccgaagccaaggagggactgaaaagaggcgaaaccacaaagcatgctgtttctcgcgggaccgccaagcttcggtggttcgtcgagagaaacctggtgaaacctgagggaaaggtgatcgatctcggctgtgggcgcggaggctggagctattactgcgcgggcctgaaaaaggtcacagaagttaaagggtataccaagggaggcctggggcacgaggaacccattcctatggccacgtacggatggaatctcgtgaaacttcattccggcaaggacgtgtttttcatgccccctgagaagtgtgataccctgctgtgcgacatcggggaatctagcccgaaccccacaattgaggagggacggaccctcagagtcctgaaaatggtggaaccttggcttcgcggcaatcagttttgtatcaagattctgaacccctacatgccttccgttgtggagacactcgaacagatgcaacggaaacacggcgggatgctggtcagaaatcccctgtctcgcaacagcacccacgagatgtattgggtgtcctgcggaacaggcaatatcgttagcgctgtgaacatgacctctcggatgctcctgaacagattcacgatggcccatcgcaagccgacatacgagcgggatgtcgaccttggggctggaaccagacacgtggccgtggaacctgaggtcgcgaatctggatattatcggccagcgcatcgaaaacattaaaaatgagcataagtccacctggcactatgacgaagataacccctacaagacatgggcctatcacgggagctacgaggttaaaccctctggatccgctagctctatggtgaatggcgtggtcaagctcctgacgaaaccttgggacgtgatccccatggttacccagattgccatgacagacaccacaccttttggccaacagagagtgttcaaggagaaagtcgatacccggacaccgcgcgctaagagagggaccacgcagatcatggaagtgaccgccaagtggctttggggatttctgtcccggaacaaaaagcccagaatttgtacacgggaggaattcacccgcaaagttagaagcaatgctgccatcggcgcggtgtttgtcgacgagaaccagtggaattccgccaaggaagctgtggaggatgagcggttctggaacctcgttcatcgcgaaagagagctgcacaaacaagggaagtgcgccacatgcgtgtataatatgatgggaaagcgggaaaaaaagctgggcgagtttgggaaagctaagggcagccgcgccatctggtacatgtggctcggagccagattcctggaattcgaggcgcttggctttatgaacgaggaccattggttctctcgggaaaatagcctgtccggggtcgagggagaaggcctccacaaactggggtacattcttcgcgatatctctaagattcctggaggcaacatgtatgctgacgataccgccgggtgggacacgagaatcacagaggatgacctgcagaatgaggccaaaattaccgatatcatggaacccgagcatgctctcctggccacaagcatctttaagctgacctaccagaacaaggtggtccgggtgcagcgccctgctaaaaacggcacggttatggacgtgatttccagacgggatcaacgcggatctggccaggtcgggacctatggactcaatacattcaccaacatggaagtgcagctgatcagacagatggagagcgaaggcatttttcttccctccgagctggagacaccgaatctcgccgaacgggtgctggactggcttgagaagcacggggcggaaagactgaaacgcatggccatctctggagacgattgtgttgtgaagcctattgacgatcggttcgctaccgccctcacagctctgaacgacatgggcaaagtcagaaaggatatcccccaatgggagcctagcaaggggtggaatgactggcagcaggtgcccttttgctcccaccatttccaccagctgatcatgaaagatggccgcgaaattgttgtgccttgtcggaaccaagacgagctcgtcggaagagcccgcgtgagccagggcgcggggtggtctctgcgggagaccgcctgccttggaaagtcctacgctcagatgtggcaactgatgtattttcatagacgcgatctccggctggccgctaatgccatctgtagcgctgtccccgtggactgggttccgacgtctagaacaacctggtccattcacgcccaccatcagtggatgaccacagaagatatgcttagcgtgtggaaccgcgtctggatcgaggaaaatccttggatggaggacaaaacccacgtgtcctcttgggaagaggttccctacctgggcaagcgggaggaccagtggtgcgggagcctcattggactgacagcgagagccacgtgggctaccaacatccaggtggccattaatcaagtccggagactgatcggcaacgaaaattatctcgattacatgacatccatgaaacgcttcaagaacgagagcgaccccgaaggggccctgtggtga

SEQ ID NO: 18772 - RNA, 9879 nt, synthetic construct
  misc_feature 1..9879: note = derived and/or modified CDS sequence (opt5) from DENV-1__FJ639743__SS-prME
  source 1..9879: mol_type = other RNA
agcgtgaccatgctgctcatgctgcttcccaccgctctggctttccacctcacgacccggggcggggagcctcatatgatcgtctccaagcaggaacgggggaagtctctgctttttaagacaagcgctggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgttgccctggctcctcatgtggggctcggactggagacaagaaccgaaacgtggatgagctccgagggcgcctggaaacagattcagcgggttgaaacatgggcccttcgccaccccggcttcaccgtgatggccctgtttctcgcgcatgccatcgggacatctattacccagaagggaatcatcttcattctgcttatgctggtcacccctagcatggctatgagatgcgtgggcatcgggaaccgggattttgttgagggactctccggcgccacatgggtggacgtcgtgctggagcacgggagctgtgtgacgaccatggctaagaataaacccacactggatattgaactcctgaagaccgaggtcacaaaccctgccgttcttcgcaaactgtgcatcgaagcgaagatttctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagatcgttcagtacgaaaacctgaaatattctgtgattgtcacggtgcacaccggcgatcagcatcaagttgggaatgagacaaccgaacacggaacaatcgctaccatcacgccccaggcccctacctccgagattcagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaatccagaccagcggaacaaccacaatttttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgcggtacgagggcaccgatgcgccgtgcaagatccctttctctacacaagacgaaaaaggggtcacccagaacggaagactcattacagctaatcccatcgtgacggataaggagaaacctgtgaacatcgaaaccgagccgccctttggcgagtcctatattgttgtcggggccggagaaaaggccctgaaactgagctggttcaagaagggctctagcatcgggaaaatgtttgaggctacagcccgcggcgctcggagaatggccattctcggagacaccgcgtgggatttcggctccatcgggggagtgtttacatctgtgggcaagctggtccatcaggtgttcgggaccgcctacggagttctttttagcggcgtgtcctggacgatgaaaattgggatcggcatcctgctcacctggctgggactgaatagccgctctacatcccttagcatgacctgtattgctgtcggcatggtgacactctacctgggggttatggtgcaggccgactctggatgcgtcatcaactggaagggccgggaactgaaatgtgggtccggaattttcgtgaccaacgaggttcacacatggaccgaacaatataagtttcaggctgatagccctaagagactctccgccgcgatcggcaaagcctgggaggagggggtgtgcggcattcgctctgctacgcggctggaaaatatcatgtggaagcagattagcaacgagcttaatcatatcctgctcgaaaacgacatgaaattcacagtcgtggtgggagacgccaatggcatcctggctcaggggaagaaaatgattagaccgcaacccatggagcacaagtactcctggaaatcttggggaaaggccaaggtcatcggcgccgatattcagaacaccacctttatcattgacgggcctgatacacccgaatgtcctgacggacagcgcgcttggaatatctgggaggttgaggattatggcttcggcatctttaccacgaacatttggctgaaacttcgggacagctacacacagatgtgcgatcacagactcatgtccgcggccatcaaggacagcaaagctgtgcatgccgatatggggtattggattgaatctgagaagaatgaaacctggaaactggcccgcgcttccttcatcgaggtgaagacatgtacctggcccaagagccacacactgtggtctaacggagtcctcgaatccgagatgattatcccgaaaatctacggcgggcctattagccaacataattatcggcccggatacttcacccagacggccggcccttggcacctggggaaacttgagctggactttgatctctgcgaaggaaccacagtggttgtggacgagcactgcggcaacagaggcccctctctgcggaccacaaccgtcacggggaaaatcattcatgaatggtgttgccgcagctgtacactgcctccccttagattccggggagaggatggctgctggtacgggatggagatcagaccggtgaaggaaaaagaggaaaatctcgttcgctccatggtgagcgcgggatctggcgaggtcgactcctttagcctggggattctgtgtgtgtccatcatgatcgaagaggttatgcggtctagatggagccgcaagatgctcatgaccggaacactggctgtgttccttctgctcgtcatgggccagctgacctggaacgacctgattagactttgcatcatggtgggcgccaatgcctccgatcggatggggatgggaaccacatatctggctctcatggccacgtttaagatgcgccctatgttcgcggtgggcctgctctttagacggctgacctctcgcgaggtccttctgctcacaattgggctgagcctggttgcttccgtggaacttcccaactctctggaggaactcggagacggcctggccatggggatcatgatgctcaaactgcttaccgagttccaaccccaccagctgtggacaaccctcctgagcctgacgtttgtgaagacaaccctttccctggattacgcctggaaaaccacagctatggtcctcagcattgtgtctctgttccctctctgtctgtccaccacaagccagaagacgacctggcttccggttctgctgggatcttttggctgcaaacccctcacaatgttcctgatcaccgaaaacaagatttggggcagaaagtcctggcctcttaatgaggggatcatggccatcggaattgtgagcatcctgctctcttccctgctcaaaaacgacgtccccctggctggccctcttattgccgggggaatgctgatcgcgtgttatgtgattagcggctccagcgccgatctgtctctcgagaaggctgccgaagttagctgggagcaggaagctgagcattccggggcctctcacaatatcctggtggaagtccaagacgatggaacaatgaaaatcaaggacgaggagcgggatgacacccttacgattctgctcaaagccaccctgctcgctgtgagcggcgtctaccccatgtccatccctgcgacactgtttgtgtggtatttctggcagaagaaaaagcagcgctctggcgttctttgggatacccccagcccgcctgaagtggagagagccgtcctggacgatgggatttaccggatcctgcagcgcggactcctgggcagatcccaagtgggggttggagtgttccaggacggcgtctttcatacaatgtggcacgtgaccagaggggctgtgcttatgtatcagggaaagagactggaaccctcttgggccagcgttaaaaaggacctcatttcctacggcggcgggtggcgcttccagggaagctggaacacaggcgaggaggtccaagtgatcgccgtggaacctgggaaaaatcccaagaacgtccagacgaccccgggaacatttaaaacctctgagggcgaagtgggggctatcgccctggatttcaagcctggaacctccggcagccccattgttaatcgggagggcaagatcgtggggctctacggaaacggcgtcgtgacaacgtctgggacctatgtttccgcgattgctcaggccaaagccagccaagaaggacctctgcccgagatcgaggacgaagtgtttaagaaaagaaatcttacaattatggatctgcaccccggctccgggaagacccgccggtacctgcctgctatcgtcagagaggccattaaacgcaagctccggacactgatccttgcgccgaccagagtggttgcttctgaaatggccgaggccctgaagggcatgcccatccgctatcagacgacagctgtgaaaagcgaacataccggacgggagattgtcgacctcatgtgccacgccaccttcacaatgagactgctgtcccctgtgcgggtgcccaactacaatatgatcattatggatgaggctcattttaccgaccctgccagcatcgcggcccgcggctatatttctacaagagtcgggatgggagaagctgccgctatcttcatgaccgccacgccccctggctccgttgaggcctttccgcagagcaacgctgtgatccaggatgaagaacgggacattcccgaacgctcttggaatagcgggtacgattggatcacagacttccctggaagaaccgtgtggtttgtcccctccattaagtctggcaacgatatcgcgaattgtctccggaaaaacgggaagagagtgattcaacttagccgcaaaacattcgacaccgagtatcagaagacgaagaacaatgactgggattacgttgtgaccacagacatctccgagatgggcgccaacttccgggctgatagagtcatcgaccctcgccggtgcctgaaacccgtgattctgaaggatggaccggaaagagttatcctcgccggccctatgcccgtgaccgtcgcctctgctgcccagcgccgggggagaattggacgcaatcagaacaaagagggcgaccaatacgtgtatatggggcagcccctgaataacgatgaagaccacgcgcattggacagaggctaagatgcttctggataatatcaacacccctgagggaattatccccgccctctttgaacctgagagagaaaagagcgccgctattgacggcgagtaccggctgcgcggggaggccagaaagacattcgtcgagctgatgcggcgcggcgatctcccggtgtggctttcctataaggttgcgagcgagggatttcagtactctgacagacggtggtgcttcgatggcgaaagaaataaccaggtgctggaggaaaatatggacgtggagatctggaccaaagaaggggagcgcaagaaactgcggcccagatggctcgacgcccgcacgtattccgatcctctggcccttcgggagtttaaggagttcgccgctggaagacggagcgtctccggcgacctgatcctcgagattgggaaactgccccaacacctgacactccgcgcccagaacgctcttgataatctggttatgctgcacaactctgaacagggaggcaaggcctacagacatgcgatggaggaactccctgacaccatcgagaccctgatgcttctggccctcattgctgtgctgacaggcggggtgaccctgtttttcctcagcggaaaaggccttgggaagacatccatcggactgctgtgtgtcacggcctctagcgctctcctgtggatggcctccgtggagccccactggattgccgctagcatcatccttgaatttttcctgatggttctcctgattccggagcctgatcggcagcgcacaccccaggacaatcagctggcgtatgtggtcatcggcctcctttttatgattctgacagtggccgctaacgaaatggggctgctcgagaccacaaagaaagatctgggaatcggctacgtcgccgccgagaaccatcagcacgctaccatgcttgacgtggatctgagacctgcctctgcgtggacgctctacgccgttgctaccacagtgattacccccatgatgcggcacacaatcgaaaataccacggccaacatctccctgacagctattgccaatcaagcggccatcctgatgggcctcgacaaggggtggcctattagcaaaatggatatcggagtcccccttctggctctgggctgctattctcaggtgaacccgctcaccctgacagccgctgttcttatgctggtggcccattacgctattatcgggcctggactccaggccaaggcgacccgcgaggcccagaaaagaaccgctgccggcattatgaagaatcccacagtcgacgggatcgtggctatcgatctggaccccgtggtttatgacgccaagttcgaaaaacaactgggacagattatgctccttatcctgtgtacgtcccagattctgctcatgcggaccacatgggccctgtgcgagagcatcacccttgcgacaggccctctgaccacgctctgggaaggctctccggggaagttttggaacacaaccattgctgtcagcatggccaatatcttccgcggatcctacctggctggcgccgggctggccttctctctcatgaaaagccttggaggcgggagacggggaaccggcgctcagggcgagacactgggggagaagtggaaaagacaactgaaccagctctccaagagcgaatttaatacctataagcgctccggaatcatggaggtggatcggtctgaagccaaagagggcctgaagagaggggaaacaacgaaacacgcggtgagccgcggaaccgccaaacttcggtggttcgtcgagagaaacctggttaaacccgagggcaaggtgattgacctcgggtgtggacgcggcggctggtcctactattgcgctgggctgaagaaagtgacagaagtcaagggatacaccaaaggcgggcctggacatgaggaacccatccctatggccacatacggctggaatctggtgaagctccactctgggaaagatgtctttttcatgagccccgagaagtgtgacacccttctgtgcgatattggagaatcctctcctaacccgacgatcgaggagggccggaccctgagagtgctcaaaatggtcgaaccctggctgcgcggcaatcagttttgtattaagatccttaacccttatatgcccagcgtggttgagacactggaacagatgcaacggaagcatgggggaatgctcgtgagaaatcctctgtcccgcaacagcacccacgagatgtactgggtctcttgcggcacagggaatatcgtgtccgctgtgaacatgaccagccggatgctgctcaacagattcacaatggcccaccgcaaacccacctatgagagagacgtcgatctgggagcgggcacgcggcatgttgccgtggaaccggaggaagctaatcttgacattatcgggcagcgcattgagaacatcagaaatgaacacaagtctacatggcattacgatgaggacaacccttataaaacctgggcctaccacggatcctatgaggtgaagcccagcggctctgcttccagcatggtcaatggcgtggttcggctgctcaccaaaccctgggatgtgattcctatggtcacacagatcgccatgacggacaccacaccctttgggcaacagagagtgttcaaggaaaaggttgacacccggacacctcgcgctaaaagaggaaccacacagattatggaggtgaccgccaagtggctgtggggctttctttcccggaacaaaaagccgcgcatctgtacgagagaagagttcacccggaaagtccgcagcaatgcggccatcggggctgtgtttgttgatgaaaaccagtggaactctgccaaggaggctgtggaggacgaaagattctgggatctggtccaccgggagcgcgaactccataagcaaggaaaatgcgccacatgcgtgtacaacatgatgggcaagagagagaaaaagctgggggaatttggcaaagccaagggaagccgggcgatttggtacatgtggctgggcgctcgcttcctcgagttcgaggccctggggtttatgaatgaagaccactggttctccagagagaactctcttagcggagtcgaaggcgaggggctgcataagctcggatatatcctgcgggatatttccaaaatccccggcgggaatatgtacgccgacgataccgctggctgggacacacgcattaccgaggatgaccttcagaacgaagccaagatcacggatatcatggagcctgaacacgctctgctcgccacatctatttttaaactgacctatcagaataaggtggttagagtgcagcggcccgcgaaaaacggaacagtcatggacgtgatcagcagacgcgatcaacggggctccggacaggtgggaacctacggcctgaacacgttcaccaatatggaggttcagctcattagacagatggaatctgaggggatctttctgcctagcgagcttgaaacacccaacctggccgagcgcgtgctcgactggctggaaaagcatggagctgagcggcttaaaagaatggccatttccggcgacgattgtgtcgtgaagccgatcgacgatcgcttcgctaccgccctgacagcgctcaatgacatggggaaggttcggaaagatatccctcaatgggaacccagcaagggctggaacgactggcaacaggtgcctttttgctctcaccacttccatcagctgattatgaaagatggaagagagatcgtcgtgccctgtcgcaatcaagacgagctggtcggccgggccagagtgtcccagggggctggatggagcctccgcgaaaccgcctgcctgggcaagtcttatgctcagatgtggcaacttatgtactttcaccggagagatctgcggctcgccgctaacgccatttgttccgcggttcctgtggactgggtccccacaagcagaaccacgtggtccatccatgcccaccaccagtggatgacaaccgaggatatgctgtctgtgtggaatcgcgtttggattgaagagaacccgtggatggaagacaaaacccatgtgagctcctgggaggaggtcccttatcttgggaagcgggaagaccagtggtgcggaagcctgatcggcctcacagctagagccacctgggccacaaatatccaggtggctattaaccaagtgcgcagactgatcgggaatgagaactacctggattacatgacgtctatgaagcggttcaaaaatgaatccgaccccgagggcgccctctggtga

SEQ ID NO: 18773 - RNA, 9879 nt, synthetic construct
  misc_feature 1..9879: note = derived and/or modified CDS sequence (opt5) from DENV-1__FJ639794__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgtcgtgggcatggttacactctacctgggggtgatggtccaggctgactctggatgcgtgattaactggaaaggccgcgaactgaagtgtgggtccggaatcttcgttaccaacgaggtgcacacatggaccgaacaatataagtttcaggccgatagccctaaacggctctccgctgccattggcaaggcgtgggaggagggggtctgcggcatcagatctgccacgcgcctggaaaatattatgtggaaacagatcagcaacgagcttaatcatatcctgctcgaaaacgacatgaagttcacagtggtggtcggagacgctaatggcattctggcccaggggaaaaagatgatccggccgcaacccatggagcacaaatactcctggaagtcttggggaaaggctaaaattatcggcgccgatattcagaacaccacctttatcatcgacgggcctgatacacccgaatgtcctgacggacagagagcctggaatatttgggaggttgaggattatggcttcggcatctttaccacgaacatttggctgaagcttcgcgacagctacacacagatgtgcgatcaccggctcatgtccgctgcgatcaaagacagcaaggccgtgcatgctgatatggggtattggattgaatctgagaaaaatgaaacctggaagctggccagagcctccttcatcgaggtgaagacatgtacctggcccaaaagccacacactgtggtctaacggagtcctcgaatccgagatgatcattccgaagatctacggcgggcctattagccaacataattatcgccccggatacttcacccagacggctggcccttggcacctggggaaacttgagctggactttgatctctgcgaaggaaccacagtggttgtggacgagcactgcggcaaccggggcccctctctgagaaccacaaccgtcacggggaagatcattcatgaatggtgttgccggagctgtacactgcctccccttcgcttcagaggagaggatggctgctggtacgggatggagatccggccggtgaaagaaaaggaggaaaatctcgttagatccatggtgagcgccggatctggcgaggtcgactcctttagcctggggatcctgtgtgtgtccattatgatcgaagaggttatgcgctctcggtggagcagaaagatgctcatgaccggaacactggcggtgttccttctgctcattatgggccagctgacctggaacgacctgatccgcctttgcattatggtcggcgctaatgcctccgatagaatggggatgggaaccacatatctggccctcatggctacgtttaaaatgcggcctatgttcgccgtgggcctgctctttcgcagactgacctctcgggaggtgcttctgctcacaatcgggctgagcctggtcgcgtccgttgaacttcccaactctctggaggaactcggagacggcctggctatggggattatgatgctcaagctgcttaccgagttccaaccccaccagctgtggacaaccctcctgagcctgacgtttgtgaaaacaaccctttccctggattacgcctggaagaccacagccatggtgctcagcatcgtctctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggctattggaatcgttagcattctgctctcttccctgctcaagaacgacgtgcccctggccggccctcttatcgctgggggaatgctgatcgcctgttatgtcattagcggctccagcgcggatctgtctctcgagaaagccgctgaagtgagctgggagcaggaagccgagcattccggggcttctcacaatatcctggttgaagtgcaagacgatggaacaatgaagattaaagacgaggagagagatgacacccttacgatcctgctcaaggccaccctgctcgccgtcagcggcgtgtaccccatgtccattcctgctacactgtttgtctggtatttctggcagaaaaagaagcagcggtctggcgtgctttgggatacccccagcccgcctgaagttgagcgcgcggtgctggacgatgggatctacagaatcctgcagcggggactcctgggccgctcccaagtcggggtgggagttttccaggacggcgtgtttcatacaatgtggcacgtcaccagaggggccgtgcttatgtatcagggaaaacggctggaaccctcttgggctagcgtgaagaaagacctcatttcctacggcggcgggtggagattccagggaagctggaacacaggcgaggaggttcaagtcatcgccgtggaacctgggaagaatcccaaaaacgtgcagacgaccccgggaacatttaagacccctgagggcgaagtcggggccattgctctggatttcaagcccggaacctctggctcccctatcgtgaatcgcgagggcaaaattgttgggctctacggaaacggcgtggtcacaacgagcgggacctatgtgtctgccatcgcgcaggctaaggcctcccaagaaggacccctgcccgagattgaggacgaagtttttaaaaagcggaatcttacaatcatggatctgcaccctggcagcgggaaaaccagacgctacctgccggccatcgtgcgggaggctattaagagaaagctccgcacactgatccttgcccccacccgggtcgtggcgtccgaaatggctgaggccctgaaaggcatgcctattagatatcagacgacagccgttaagtctgaacataccggacgcgagatcgtggacctcatgtgccacgctaccttcacaatgcggctgctgagccccgtcagagtgcctaactacaatatgattatcatggatgaggcccattttaccgaccccgcttccatcgccgcgcggggctatattagcacacgcgtggggatgggagaagccgctgccatcttcatgaccgctacgcctccgggctctgtcgaggcctttccccagtccaacgccgttattcaggatgaagagagagacatccctgaacggagctggaatctcgggtacgattggattacagacttccccggaaaaaccgtgtggtttgtgccttctatcaagagcggcaacgatatcgctaattgtcttcgcaaaaacgggaagagagtcattcaactgtcccggaagacattcgacaccgagtatcagaaaacgaagaacaatgactgggattacgtggttaccacagacatctctgagatgggcgcgaacttcagagccgatcgcgtgattgacccccggagatgcctgaaaccggtcatcctcaaggatggacctgaacgcgtgattctggctggccccatgcccgttaccgtggccagcgccgctcagcggagagggcgcatcggacggaatcagaacaaagagggcgaccaatacgtctatatggggcagcctcttaataacgatgaagaccacgcccattggacagaggcgaagatgctgctcgataatattaacacccccgagggaatcatccctgctctgtttgaaccggagagagaaaagtccgccgccattgacggcgagtaccgcctgagaggggaagctcggaaaacattcgtggagctcatgcgcagaggcgatcttcccgtctggctgtcttataaggtggccagcgagggatttcagtactccgaccggcgctggtgcttcgatggcgaaagaaataaccaggttctggaggaaaatatggacgtggagatctggaccaaagaaggggagcggaagaaactcagacctcgctggctggacgcgcggacgtatagcgatccccttgccctgagagagtttaaggaattcgctgccggacgccggtctgtgtccggcgacctcattctggagatcgggaaactgcctcaacacctcacacttagagctcagaacgccctggataatctggtcatgctccacaacagcgaacagggaggcaaggcttaccggcatgccatggaggaactgcccgacaccattgagacccttatgctgctcgcgctgatcgccgttctgacaggcggggtgaccctctttttcctttccggaaagggcctggggaaaacatctatcggactgctctgtgtgacggctagctccgccctgctttggatggcttctgtcgagccgcactggattgccgccagcatcattctggaatttttcctcatggtgctgctgatccctgagcccgatcgccagagaacccctcaagacaatcagctcgcttatgttgtgattggccttctgtttatgatcctgacagtcgcggccaacgaaatggggctcctggagaccacaaagaaagatcttggaatcggctacgtggctgccgagaaccatcagcacgccaccatgctggacgtcgatctccggcccgcttccgcctggacgctgtacgcggtggccaccacagttattacccctatgatgcgccacacaatcgaaaataccacggctaacattagcctgacagccatcgctaatcaagccgcgattctcatgggccttgacaaggggtggcccatctctaaaatggatattggagtgccgctgctggccctcggctgctattcccaggtcaaccctctgacccttacagctgccgtgctgatgctcgttgctcattacgccatcatcgggcccggactgcaggctaaggccaccagagaggcgcagaagcggaccgccgctggcattatgaaaaatcccacagtggacgggatcgtcgccattgatctggaccctgtggtgtatgacgctaagttcgaaaaacaactcggacagatcatgcttctgattctgtgtacgagccagatcctcctgatgcgcaccacatgggccctttgcgagtctatcaccctggccacaggcccgctcaccacgctgtgggaaggctcccccgggaagttttggaacacaaccattgcggttagcatggctaatatcttcagaggatcttacctggccggcgctgggctcgccttcagccttatgaaatccctgggaggcgggcggcgcggaaccggcgcccagggcgagacactgggggagaagtggaagagacaactcaaccagctgtctaaaagcgaatttaatacctataagcggtccggaattatggaggtcgatagaagcgaagctaaagagggccttaagcgcggggaaacaacgaaacacgccgtgtcccggggaaccgcgaagctgagatggttcgtggagcgcaacctcgtcaagcctgagggcaaagttatcgacctggggtgtggacggggcggctggtcttactattgcgccgggctgaagaaagtgacagaagtgaagggatacaccaaaggcgggcccggacatgaggaacctattcccatggctacatacggctggaatctcgtcaagcttcacagcgggaaagatgtgtttttcatgcctccggagaagtgtgacaccctgctgtgcgatatcggagaatcctctcccaaccctacgatcgaggagggcagaaccctccgcgttctgaagatggtggaaccctggcttaaaggcaatcagttttgtattaagatcctgaacccttatatgcccagcgtcgtggagacactcgaacagatgcaacggaaacatgggggaatgctggttagaaatccgctgtcccgcaactctacccacgagatgtactgggtgagctgcggcacagggaatattgtctccgccgtgaacatgaccagccggatgctcctgaacagattcacaatggtgcaccgcaagcctacctatgagcgggacgtcgatcttggagctggcacgagacatgttgccgtggaacccgaggtggcgaatctggacatcattgggcagcgcatcgaaaacattaaaaatgagcacaagtctacatggcattacgatgaagacaacccctataagacctgggcctaccacggatcctatgaggtcaaacctagcggctctgcttccagcatggtgaatggcgttgtgagactcctgaccaagccctgggatgtcatccctatggtgacacagatcgccatgacggacaccacaccgtttgggcaacagcgggttttcaaagagaaggtggacacccgcacacccagagctaaacggggaaccacacagattatggaagtcaccgccaagtggctttggggctttctgtctagaaacaagaaacctcggatctgtacgcgcgaggaattcaccagaaaggtgcggtccaatgctgccattggggcggtttttgtggatgagaaccagtggaatagcgccaaagaagctgtcgaggacgagcgcttctgggatctcgtgcacagagaacgggagctgcataagcaaggaaaatgcgccacatgcgtctacaacatgatgggcaagcgcgaaaagaaactgggggagtttggcaaggctaaaggatccagagccatctggtacatgtggctcggcgcccggttcctggaattcgaggcgcttgggtttatgaatgaggaccactggttcagccgcgaaaactctctgagcggagtggagggcgaagggctccataagctgggatatattcttagagatatctccaaaatccccggcgggaatatgtacgctgacgataccgccggctgggacacacggattaccgaggatgacctgcagaacgaggccaagatcacggatattatggaacctgagcacgctctcctggccacatctatctttaaactgacctatcagaataaggttgtgcgcgtccagagacccgctaagaacggaacagtgatggacgtgattagccggcgcgatcaaagaggctccgggcaggttggaacctacggcctcaacacgttcaccaatatggaagtgcagctgatccggcagatggagtctgaagggatctttcttccgagcgagctggagacacctaacctcgccgaaagagtcctggactggcttgagaaacatggagcggaacgcctgaagcggatggccatttccggcgacgattgtgtggttaaacccatcgacgatagattcgctaccgccctcacagctctgaatgacatggggaaggtgcgcaaagatattcctcaatgggagccctctaagggctggaacgactggcagcaggtccctttttgcagccaccacttccatcagctggtgatgaaggatggacgggaaatcgtcgtgccctgtagaaatcaagacgagctcgttggccgcgcccgggtgtcccagggggcgggatggagcctgagagagaccgcctgccttggcaaatcttatgctcagatgtggcaactgatgtactttcaccgccgggatctcagactggccgctaacgccatttgttccgctgtcccggtggactgggttcctacaagccgcaccacgtggtctatccatgcccaccaccagtggatgacaaccgaagatatgctttccgtgtggaatcgggtctggatcgaggaaaacccctggatggaggacaagacccatgtgagctcctgggaagaggtgccctatctggggaaaagagaggaccagtggtgcggatctctcattggcctgacagcgcgggccacctgggctacaaatatccaggttgccattaaccaagtcagacgcctgatcgggaatgaaaactacctcgattacatgacgagcatgaagcggttcaaaaatgagtccgaccctgaaggcgccctgtggtga

SEQ ID NO: 18774 - RNA, 9879 nt, synthetic construct
  misc_feature 1..9879: note = derived and/or modified CDS sequence (opt5) from DENV-1__FJ639796__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatacgtgtatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacacctgacactcagagcccagaacgctcttgataatctggtgatgctgcacaactccgaacagggaggcaaggcctaccggcatgcgatggaggaactccccgacaccattgagaccctgatgcttctggccctcatcgctgtcctgacaggcggggttaccctgtttttcctctctggaaagggccttgggaaaacaagcatcggactgctgtgtgtgacggcctcctctgctctcctgtggatggccagcgtggagccgcactggattgccgcttccatcattcttgaatttttcctgatggtcctcctgatccctgagcccgatcgccagagaacccctcaagacaatcagctggcgtatgtggttattggcctcctttttatgatcctgacagtggccgctaacgaaatggggctgctcgagaccacaaagaaagatctgggaatcggctacgtcgccgccgagaaccatcagcacgctaccatgcttgacgtggatctgcggcccgccagcgcgtggacgctctacgccgtcgctaccacagtgattacccctatgatgcgccacacaatcgaaaataccacggccaacatttctctgacagctatcgccaatcaagcggccattctgatgggcctcgacaaggggtggcccatctccaaaatggatattggagttccgcttctggctctgggctgctatagccaggtgaaccctctcaccctgacagccgctgtccttatgctggtggcccattacgctatcatcgggcccggactccaggccaaggcgaccagagaggcccagaagcggaccgctgccggcattatgaaaaatcccacagttgacgggatcgtggctattgatctggaccctgtcgtgtatgacgccaagttcgaaaaacaactgggacagatcatgctccttattctgtgtacgtctcagatcctgctcatgcgcaccacatgggccctgtgcgagtccatcacccttgcgacaggcccgctgaccacgctctgggaaggcagccccgggaagttttggaacacaaccattgctgtgtctatggccaatatcttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaattatggaggttgatagatccgaagccaaagagggcctgaagcgcggggaaacaacgaaacacgcggtctctcggggaaccgccaagcttagatggttcgtggagcgcaacctggtgaagcctgagggcaaagtcatcgacctcgggtgtggacggggcggctggagctactattgcgctgggctgaagaaagttacagaagtgaagggatacaccaaaggcgggcccggacatgaggaacctattcccatggccacatacggctggaatctggtgaagctccactccgggaaagatgtctttttcatgcctccggagaagtgtgacacccttctgtgcgatatcggagaatctagccccaaccctacgatcgaggagggcagaaccctgcgcgtgctcaagatggttgaaccctggctgaaaggcaatcagttttgtattaagatccttaacccttatatgccctccgtggtcgagacactggaacagatgcaacggaaacatgggggaatgctcgtgagaaatccgctgtctcgcaacagcacccacgagatgtactgggtttcctgcggcacagggaatattgtgagcgctgtcaacatgacctctcggatgctgctcaacagattcacaatggcccaccgcaagcctacctatgagcgggacgtggatctgggagcgggcacgagacatgtggccgtcgaacccgaggttgctaatcttgacatcattgggcagcgcatcgaaaacattaaaaatgagcacaagtccacatggcattacgatgaagacaacccctataagacctgggcctaccacggaagctatgaggtgaaaccttctggctccgctagctctatggtgaatggcgtcgtgagactgctcaccaagccctgggatgttatccctatggtgacacagatcgccatgacggacaccacaccgtttgggcaacagcgggtcttcaaagagaaggtggacacccgcacacccagagctaaacggggaaccacacagattatggaagttaccgccaagtggctgtggggctttctttccagaaacaagaaacctcggatctgtacgcgcgaggaattcaccagaaaggtgcggagcaatgcggccattggggctgtctttgtggatgagaaccagtggaattccgccaaagaagctgttgaggacgagcgcttctgggatctggtgcacagagaacgggagctccataagcaaggaaaatgcgccacatgcgtctacaacatgatgggcaagcgcgaaaagaaactgggggagtttggcaaggccaaaggaagcagagcgatctggtacatgtggctgggcgctcggttcctcgaattcgaggccctggggtttatgaatgaggaccactggttctctcgcgaaaacagcctttccggagtggagggcgaagggctgcataagctcggatatattctgagagatatctctaaaatccccggcgggaatatgtacgccgacgataccgctggctgggacacacggattaccgaggatgaccttcagaacgaggccaagatcacggatattatggaacctgagcacgctctgctcgccacaagcatctttaaactgacctatcagaataaggtcgtgcgcgttcagagacccgcgaagaacggaacagtgatggacgtcatttcccggcgcgatcaaagaggctctgggcaggtgggaacctacggcctgaacacgttcaccaatatggaagtgcagctcatccggcagatggagagcgaagggatctttctgccgtccgagcttgagacacctaacctggccgaaagagttctcgactggctggagaaacatggagctgaacgccttaagcggatggccatttctggcgacgattgtgtggtcaaacccatcgacgatagattcgctaccgccctgacagcgctcaatgacatggggaaggtgcgcaaagatattcctcaatgggagcccagcaagggctggaacgactggcagcaggttcctttttgctcccaccacttccatcagctgatcatgaaggatggacgggaaattgtggtcccctgtagaaatcaagacgagctggtgggccgcgcccgggtcagccagggggctggatggtctctcagagagaccgcctgcctgggcaaatcctatgctcagatgtggcaacttatgtactttcaccgccgggatctgagactcgccgctaacgccatctgtagcgcggtgccggttgactgggtgcctacatctcgcaccacgtggtccatccatgcccaccaccagtggatgacaaccgaagatatgctgagcgtctggaatcgggtgtggattgaggaaaacccctggatggaggacaagacccatgtttcctcttgggaagaggtgccctatcttgggaaaagagaggaccagtggtgcggaagcctgatcggcctcacagctcgggccacctgggccacaaatattcaggtcgctatcaaccaagtgagacgcctgattgggaatgaaaactacctggattacatgacgtccatgaagcggttcaaaaatgagagcgaccctgaaggcgccctctggtga

SEQ ID NO: 18775 - RNA, 9879 nt, synthetic construct
  misc_feature 1..9879: note = derived and/or modified CDS sequence (opt5) from DENV-1__FJ639797__SS-prME
  source 1..9879: mol_type = other RNA
agcgtgaccatgctgctcatgctgcttcccaccgctctggctttccacctcacgacccggggcggggaacctcatatgatcgtctccaagcaggaacgggggaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacacggaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcagagcctgggaggagggggtgtgcggcatccgctctgctacgcggctggaaaatattatgtggaagcagatcagcaacgagcttaatcatatcctgctcgaaaacgacatgaaattcacagtcgtggtgggagacgccaatggcattctggctcaggggaagaaaatgatcagaccgcaacccatggagcacaagtactcctggaaatcttggggaaaggccaagattatcggcgccgatattcagaacaccacctttatcatcgacgggcctgatacacccgaatgtcctgacggacagcgcgcttggaatatttgggaggtcgaggattatggcttcggcatctttaccacgaacatttggctgaaacttcgggacagctacacacagatgtgcgatcacagactcatgtccgcggccatcaaggacagcaaagctgttcatgccgatatggggtattggattgaatctgagaagaatgaaacctggaaactggcccgcgcttccttcatcgaggtgaagacatgtatctggcccaagagccacaccctgtggtctaacggagtgctcgaatccgagatgattatcccgaaaatttacggcgggcctatcagccaacataattatcggcccggatacttcacacagaccgccggcccttggcacctggggaaacttgagctggactttgatctctgcgaaggaacgaccgtcgtggttgacgagcactgcggcaacagaggcccctctctgcggacaaccacagtgaccgggaaaattatccatgaatggtgttgccgcagctgtacgctgcctccccttagattccggggagaggatggctgctggtacgggatggagatcagaccggtcaaggaaaaagaggaaaatctcgtgcgctccatggttagcgcgggatctggcgaggtggactcctttagcctggggattctgtgtgtctccatcatgattgaagaggtgatgcggtctagatggagccgcaagatgctcatgacaggaaccctggctgttttccttctgctcatcatgggccagctgacatggaacgacctgattagactttgcatcatggtgggcgccaatgcctccgatcggatggggatgggaaccacctatctggctctcatggccacatttaagatgcgccctatgttcgcggtcggcctgctctttagacggctgacgtctcgcgaggtgcttctgctcaccattgggctgagcctggtggcttccgtcgaacttcccaactctctggaggaactcggagacggcctggccatggggatcatgatgctcaaactgcttacagagttccaaccccaccagctgtggaccacactcctgagcctgacctttgttaagacgacactttccctggattacgcctggaaaaccaccgctatggtgctcagcatcgtgtctctgttccctctctgtctgtccacaaccagccagaagacaacgtggcttccggtcctgctgggatcttttggctgcaaacccctcaccatgttcctgattacagaaaacaagatctggggcagaaagtcctggcctcttaatgaggggattatggccatcggaattgtgagcatcctgctctcttccctgctcaaaaacgacgttcccctggctggccctcttatcgccgggggaatgctgattgcgtgttatgtgatcagcggctccagcgccgatctgtctctcgagaaggctgccgaagtcagctgggagcaggaagctgagcattccggggcctctcacaatattctggtggaagttcaagacgatggaaccatgaaaatcaaggacgaggagcgggatgacacacttaccattctgctcaaagccacgctgctcgctgtgagcggcgtctaccccatgtccatccctgcgaccctgtttgtgtggtatttctggcagaagaaaaagcagcgctctggcgtcctttgggatacacccagcccgcctgaagtggagagagccgttctggacgatgggatctaccggattctgcagcgcggactcctgggcagatcccaagtgggggtcggagtgttccaggacggcgtttttcataccatgtggcacgtgacaagaggggctgtccttatgtatcagggaaagagactggaaccctcttgggccagcgtgaaaaaggacctcatctcctacggcggcgggtggcgcttccagggaagctggaacaccggcgaggaggtgcaagttattgccgtcgaacctgggaaaaatcccaagaacgtgcagacaacgccgggaacctttaaaacacctgagggcgaagtgggggctatcgccctggatttcaagcccggaacctctggctcccctattgtcaatcgggagggcaagatcgtggggctctacggaaacggcgttgtgaccacaagcgggacgtatgtctctgcgattgctcaggccaaagcctcccaagaaggacccctgcccgagatcgaggacgaagtgtttaagaaaagaaatcttaccatcatggatctgcaccctggcagcgggaagacacgccggtacctgccggctattgttagagaggccatcaaacgcaagctccggaccctgattcttgcgcccacaagagtggtcgcttccgaaatggccgaggccctgaagggcatgcctatccgctatcagaccacggctgtgaaatctgaacatacaggacgggagattgttgacctcatgtgccacgccaccttcaccatgagactgctgagccccgtgcgggtccctaactacaatatgatcatcatggatgaggctcattttacagaccccgcctccattgcggcccgcggctatatcagcaccagagtggggatgggagaagctgccgctattttcatgacagccacccctccgggctctgtggaggcctttccccagtccaacgctgtcatccaggatgaagaacgggacattcctgaacgcagctggaactctgggtacgattggatcacggacttccccggaaagacagtttggtttgtgcctagcatcaaatccggcaacgatattgcgaattgtctcagaaagaacgggaaacgggtgatccaactttctagaaagaccttcgacacagagtatcagaagaccaaaaacaatgactgggattacgtcgtgacgaccgacattagcgagatgggcgccaacttccgcgctgatcgggttatcgaccccagacgctgcctgaagccggtgattctgaaagatggacctgaacgggtcatcctcgccggccccatgcccgtgacagttgcctccgctgcccagagacgcgggcggattggaagaaatcagaacaaggagggcgaccaatacgtgtatatggggcagcctctgaataacgatgaagaccacgcgcattggaccgaggctaaaatgcttctggataatatcaacacacccgagggaatcattcctgccctctttgaaccggagcgcgaaaagtctgccgctatcgacggcgagtacagactgagaggggaagcccgcaagaccttcgtcgagctgatgagacggggcgatctccccgtgtggcttagctataaagtcgcgtccgagggatttcagtacagcgaccgcagatggtgcttcgatggcgaacggaataaccaggtgctggaggaaaatatggacgttgagatttggacaaaggaaggggagcgcaagaagctgcgccctcggtggctcgacgccagaacctattctgatcccctggcccttcgcgagtttaaagagttcgccgctggacggagatccgtgagcggcgacctgatcctcgagattgggaagctgcctcaacacctgacgctccgggcccagaacgctcttgataatctggtgatgctgcacaactccgaacagggaggcaaagcctaccgccatgcgatggaggaactccccgacacaatcgagaccctgatgcttctggccctcatcgctgtcctgaccggcggggttacactgtttttcctctctggaaagggccttgggaagaccagcattggactgctgtgtgtgacagcctcctctgctctcctgtggatggccagcgtggagccgcactggatcgccgcttccattatccttgaatttttcctgatggtcctcctgattcctgagcccgatagacagcggacgcctcaagacaatcagctggcgtatgtggttatcggcctcctttttatgatcctgaccgtggccgctaacgaaatggggctgctcgagacaaccaaaaaggatctgggaattggctacgtcgccgccgagaaccatcagcacgctacaatgcttgacgtggatctgcgccccgccagcgcgtggaccctctacgccgtcgctacgaccgtgatcacacctatgatgagacacaccattgaaaatacaaccgccaacatctctctgacggctattgccaatcaagcggccatcctgatgggcctcgacaaagggtggcccatttccaagatggatatcggagttccgcttctggctctgggctgctatagccaggtgaaccctctcacactgaccgccgctgtccttatgctggtggcccattacgctatcattgggcccggactccaggccaaagcgacacgggaggcccagaagcgcaccgctgccggcatcatgaagaatcccaccgttgacgggattgtggctatcgatctggaccctgtcgtgtatgacgccaaattcgaaaagcaactgggacagattatgctccttatcctgtgtacatctcagatcctgctcatgagaacgacctgggccctgtgcgagtccattacacttgcgaccggcccgctgacaaccctctgggaaggcagccccgggaaattttggaacacgacaatcgctgtgtctatggccaatattttccggggaagctacctggctggcgccgggctggccttctccctcatgaagtctcttggaggcgggcgcagaggaaccggcgctcagggcgagaccctgggggagaaatggaagcggcaactgaaccagctcagcaagtccgaatttaatacatataaaagaagcggaatcatggaggttgatcgctccgaagccaaggagggcctgaaaagaggggaaaccacaaagcacgcggtctctagaggaacggccaaacttcgctggttcgtggagcggaacctggtgaagcctgagggcaaggtcattgacctcgggtgtggaagaggcggctggagctactattgcgctgggctgaaaaaggttaccgaagtgaaaggatacacaaagggcgggcccggacatgaggaacctatccccatggccacctacggctggaatctggtgaaactccactccgggaaggatgtctttttcatgcctccggagaaatgtgacacacttctgtgcgatatcggagaatctagccccaaccctaccattgaggagggccgcacgctgcgggtgctcaagatggttgaaccctggctgaagggcaatcagttttgtatcaaaattcttaacccttatatgccctccgtggtcgagaccctggaacagatgcaaagaaagcatgggggaatgctcgtgcgcaatccgctgtctcggaacagcacacacgagatgtactgggtttcctgcggcaccgggaatatcgtgagcgctgtcaacatgacatctagaatgctgctcaaccgcttcaccatggcccaccggaaacctacatatgagagagacgtggatctgggagcgggcacccgccatgtggccgtcgaacccgaggttgctaatcttgacattatcgggcagagaattgaaaacatcaagaatgagcacaaatccacgtggcattacgatgaagacaacccctataagacatgggcctaccacggaagctatgaggtgaagccttctggctccgctagctctatggtgaatggcgtcgtgcggctgctcaccaaaccctgggatgttatccctatggtgacccagattgccatgacagacacgaccccgtttgggcaacagcgcgtcttcaaggagaaagtggacacaagaacaccccgggctaagagaggaacaacccagatcatggaagttacagccaaatggctgtggggctttctttcccggaacaagaagcctcgcatttgtaccagagaggagttcacgcggaaagtgcgcagcaatgcggccatcggggctgtctttgtggatgagaaccagtggaactccgccaaggaagctgttgaggacgagagattctgggatctggtgcaccgggaacgcgagctccataaacaaggaaagtgcgcgacctgcgtctacaacatgatgggcaaaagagaaaagaagctgggggagtttggcaaagccaagggaagccgggccatttggtacatgtggctgggcgctcgcttcctcgagttcgaggccctggggtttatgaatgaggaccactggttctctagagaaaacagcctttccggagtggagggcgaagggctgcataaactcggatatatcctgcgggatatctctaagattcccggcgggaatatgtacgccgacgatacagctggctgggacacccgcatcacagaggatgaccttcagaacgaggccaaaattaccgatatcatggaacctgagcacgctctgctcgccacgagcatttttaagctgacatatcagaataaagtcgtgagagttcagcggcccgcgaagaacggaaccgtgatggacgtcatctcccgcagagatcaacggggctctggacaggtgggaacatacggcctgaacaccttcacgaatatggaagtgcagctcatcagacagatggagagcgaagggatttttctgccgtccgagcttgagacccctaacctggccgaacgcgttctcgactggctggagaagcatggagctgaacggcttaaaagaatggccatctctggcgacgattgtgtggtcaagcccattgacgatcgcttcgctacagccctgaccgcgctcaatgacatggggaaagtgcggaaggatatccctcaatgggagcccagcaaaggctggaacgactggcagcaggttcctttttgctcccaccacttccatcagctgattatgaaggatggaagagaaatcgtggtcccctgtcgcaatcaagacgagctggtgggccgggccagagtcagccagggggctggatggtctctccgcgagacagcctgcctgggcaagtcctatgctcagatgtggcaacttatgtactttcaccggagagatctgcgcctcgccgctaacgccatctgtagcgcggtgccggttgactgggtgcctacctctcggacaacctggtccattcatgcccaccaccagtggatgacgacagaagatatgctgagcgtctggaatagagtgtggatcgaggaaaacccctggatggaggacaaaacccatgtttcctcttgggaagaggtgccctatcttgggaagcgggaggaccagtggtgcggaagcctgattggcctcaccgctagagccacatgggccaccaatatccaggtcgctattaaccaagtgcgccggctgatcgggaatgaaaactacctggattacatgacatccatgaaaagattcaagaatgagagcgaccctgaaggcgccctctggtga

SEQ ID NO: 18776 - RNA, 9879 nt, synthetic construct
  misc_feature 1..9879: note = derived and/or modified CDS sequence (opt5) from DENV-1__FJ639802__SS-prME
  source 1..9879: mol_type = other RNA
agcgtgaccatgctgctcatgctgcttcccaccgctctggctttccacctcacgacccggggcggggaacctcatatgatcgtctccaagcaggaacgggggaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacacggaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatatcggtttcaggctgatagccctaagagactctccgccgcgattggcaaagcctgggaggagggggtgtgcggcatccgctctgctacgcggctggaaaatattatgtggaagcagatcagcaacgagcttaatcatatcctgctcgaaaacgacatgaaattcacagtcgtggtgggagacgccaatggcattctggctcaggggaagaaaatgatcagaccgcaacccatggagcacaagtactcctggaaatcttggggaaaggccaagattatcggcgccgatattcagaacaccacctttatcatcgacgggcctgatacacccgaatgtcctgacggacagcgcgcttggaatatttgggaggtcgaggattatggcttcggcatctttaccacgaacatttggctgaaacttcgggacagctacacacagatgtgcgatcacagactcatgtccgcggccatcaaggacagcaaagctgttcatgccgatatggggtattggattgaatctgagaagaatgaaacctggaaactggcccgcgcttccttcatcgaggtgaagacatgtatctggcccaagagccacaccctgtggtctaacggagtgctcgaatccgagatgattatcccgaaaatttacggcgggcctatcagccaacataattatcggcccggatacttcacacagaccgccggcccttggcacctggggaaacttgagctggactttgatctctgcgaaggaacgaccgtcgtggttgacgagcactgcggcaacagaggcccctctctgcggacaaccacagtgaccgggaaaattatccatgaatggtgttgccgcagctgtacgctgcctccccttagattccggggagaggatggctgctggtacgggatggagatcagaccggtcaaggaaaaagaggaaaatctcgtgcgctccatggttagcgcgggatctggcgaggtggactcctttagcctggggattctgtgtgtctccatcatgattgaagaggtgatgcggtctagatggagccgcaagatgctcatgacaggaaccctggctgttttccttctgctcatcatgggccagctgacatggaacgacctgattagactttgcatcatggtgggcgccaatgcctccgatcggatggggatgggaaccacctatctggctctcatggccacatttaagatgcgccctatgttcgcggtcggcctgctctttagacggctgacgtctcgcgaggtgcttctgctcaccattgggctgagcctggtggcttccgtcgaacttcccaactctctggaggaactcggagacggcctggccatggggatcatgatgctcaaactgcttacagagttccaaccccaccagctgtggaccacactcctgagcctgacctttgttaagacgacactttccctggattacgcctggaaaaccaccgctatggtgctcagcatcgtgtctctgttccctctctgtctgtccacaaccagccagaagacaacgtggcttccggtcctgctgggatcttttggctgcaaacccctcaccatgttcctgattacagaaaacaagatctggggcagaaagtcctggcctcttaatgaggggattatggccatcggaattgtgagcatcctgctctcttccctgctcaaaaacgacgttcccctggctggccctcttatcgccgggggaatgctgattgcgtgttatgtgatcagcggctccagcgccgatctgtctctcgagaaggctgccgaagtcagctgggagcaggaagctgagcattccggggcctctcacaatattctggtggaagttcaagacgatggaaccatgaaaatcaaggacgaggagcgggatgacacacttaccattctgctcaaagccacgctgctcgctgtgagcggcgtctaccccatgtccatccctgcgaccctgtttgtgtggtatttctggcagaagaaaaagcagcgctctggcgtcctttgggatacacccagcccgcctgaagtggagagagccgttctggacgatgggatctaccggattctgcagcgcggactcctgggcagatcccaagtgggggtcggagtgttccaggacggcgtttttcataccatgtggcacgtgacaagaggggctgtccttatgtatcagggaaagagactggaaccctcttgggccagcgtgaaaaaggacctcatctcctacggcggcgggtggcgcttccagggaagctggaacaccggcgaggaggtgcaagttattgccgtcgaacctgggaaaaatcccaagaacgtgcagacaacgccgggaacctttaaaacacctgagggcgaagtgggggctatcgccctggatttcaagcccggaacctctggctcccctattgtcaatcgggagggcaagatcgtggggctctacggaaacggcgttgtgaccacaagcgggacgtatgtctctgcgattgctcaggccaaagcctcccaagaaggacccctgcccgagatcgaggacgaagtgtttaagaaaagaaatcttaccatcatggatctgcaccctggcagcgggaagacacgccggtacctgccggctattgttagagaggccatcaaacgcaagctccggaccctgattcttgcgcccacaagagtggtcgcttccgaaatggccgaggccctgaagggcatgcctatccgctatcagaccacggctgtgaaatctgaacatacaggacgggagattgttgacctcatgtgccacgccaccttcaccatgagactgctgagccccgtgcgggtccctaactacaatatgatcatcatggatgaggctcattttacagaccccgcctccattgcggcccgcggctatatcagcaccagagtggggatgggagaagctgccgctattttcatgacagccacccctccgggctctgtggaggcctttccccagtccaacgctgtcatccaggatgaagaacgggacattcctgaacgcagctggaactctgggtacgattggatcacggacttccccggaaagacagtttggtttgtgcctagcatcaaatccggcaacgatattgcgaattgtctcagaaagaacgggaaacgggtgatccaactttctagaaagaccttcgacacagagtatcagaagaccaaaaacaatgactgggattacgtcgtgacgaccgacattagcgagatgggcgccaacttccgcgctgatcgggttatcgaccccagacgctgcctgaagccggtgattctgaaagatggacctgaacgggtcatcctcgccggccccatgcccgtgacagttgcctccgctgcccagagacgcgggcggattggaagaaatcagaacaaggagggcgaccaatacgtgtatatggggcagcctctgaataacgatgaagaccacgcgcattggaccgaggctaaaatgcttctggataatatcaacacacccgagggaatcattcctgccctctttgaaccggagcgcgaaaagtctgccgctatcgacggcgagtacagactgagaggggaagcccgcaagaccttcgtcgagctgatgagacggggcgatctccccgtgtggcttagctataaagtcgcgtccgagggatttcagtacagcgaccgcagatggtgcttcgatggcgaacggaataaccaggtgctggaggaaaatatggacgttgagatttggacaaaggaaggggagcgcaagaagctgcgccctcggtggctcgacgccagaacctattctgatcccctggcccttcgcgagtttaaagagttcgccgctggacggagatccgtgagcggcgacctgatcctcgagattgggaagctgcctcaacacctgacgctccgggcccagaacgctcttgataatctggtgatgctgcacaactccgaacagggaggcaaagcctaccgccatgcgatggaggaactccccgacacaatcgagaccctgatgcttctggccctcatcgctgtcctgaccggcggggttacactgtttttcctctctggaaagggccttgggaagaccagcattggactgctgtgtgtgacagcctcctctgctctcctgtggatggccagcgtggagccgcactggatcgccgcttccattatccttgaatttttcctgatggtcctcctgattcctgagcccgatagacagcggacgcctcaagacaatcagctggcgtatgtggttatcggcctcctttttatgatcctgaccgtggccgctaacgaaatggggctgctcgagacaaccaaaaaggatctgggaattggctacgtcgccgccgagaaccatcagcacgctacaatgcttgacgtggatctgcgccccgccagcgcgtggaccctctacgccgtcgctacgaccgtgatcacacctatgatgagacacaccattgaaaatacaaccgccaacatctctctgacggctattgccaatcaagcggccatcctgatgggcctcgacaaagggtggcccatttccaagatggatatcggagttccgcttctggctctgggctgctatagccaggtgaaccctctcacactgaccgccgctgtccttatgctggtggcccattacgctatcattgggcccggactccaggccaaagcgacacgggaggcccagaagcgcaccgctgccggcatcatgaagaatcccaccgttgacgggattgtggctatcgatctggaccctgtcgtgtatgacgccaaattcgaaaagcaactgggacagattatgctccttatcctgtgtacatctcagatcctgctcatgagaacgacctgggccctgtgcgagtccattacacttgcgaccggcccgctgacaaccctctgggaaggcagccccgggaaattttggaacacgacaatcgctgtgtctatggccaatattttccggggaagctacctggctggcgccgggctggccttctccctcatgaagtctcttggaggcgggcgcagaggaaccggcgctcagggcgagaccctgggggagaaatggaagcggcaactgaaccagctcagcaagtccgaatttaatacatataaaagaagcggaatcatggaggttgatcgctccgaagccaaggagggcctgaaaagaggggaaaccacaaagcacgcggtctctagaggaacggccaaacttcgctggttcgtggagcggaacctggtgaagcctgagggcaaggtcattgacctcgggtgtggaagaggcggctggagctactattgcgctgggctgaaaaaggttaccgaagtgaaaggatacacaaagggcgggcccggacatgaggaacctatccccatggccacctacggctggaatctggtgaaactccactccgggaaggatgtctttttcatgcctccggagaaatgtgacacacttctgtgcgatatcggagaatctagccccaaccctaccattgaggagggccgcacgctgcgggtgctcaagatggttgaaccctggctgaagggcaatcagttttgtatcaaaattcttaacccttatatgccctccgtggtcgagaccctggaacagatgcaaagaaagcatgggggaatgctcgtgcgcaatccgctgtctcggaacagcacacacgagatgtactgggtttcctgcggcaccgggaatatcgtgagcgctgtcaacatgacatctagaatgctgctcaaccgcttcaccatggcccaccggaaacctacatatgagagagacgtggatctgggagcgggcacccgccatgtggccgtcgaacccgaggttgctaatcttgacattatcgggcagagaattgaaaacatcaagaatgagcacaaatccacgtggcattacgatgaagacaacccctataagacatgggcctaccacggaagctatgaggtgaagccttctggctccgctagctctatggtgaatggcgtcgtgcggctgctcaccaaaccctgggatgttatccctatggtgacccagattgccatgacagacacgaccccgtttgggcaacagcgcgtcttcaaggagaaagtggacacaagaacaccccgggctaagagaggaacaacccagatcatggaagttacagccaaatggctgtggggctttctttcccggaacaagaagcctcgcatttgtaccagagaggagttcacgcggaaagtgcgcagcaatgcggccatcggggctgtctttgtggatgagaaccagtggaactccgccaaggaagctgttgaggacgagagattctgggatctggtgcaccgggaacgcgagctccataaacaaggaaagtgcgcgacctgcgtctacaacatgatgggcaaaagagaaaagaagctgggggagtttggcaaagccaagggaagccgggccatttggtacatgtggctgggcgctcgcttcctcgagttcgaggccctggggtttatgaatgaggaccactggttctctagagaaaacagcctttccggagtggagggcgaagggctgcataaactcggatatatcctgcgggatatctctaagattcccggcgggaatatgtacgccgacgatacagctggctgggacacccgcatcacagaggatgaccttcagaacgaggccaaaattaccgatatcatggaacctgagcacgctctgctcgccacgagcatttttaagctgacatatcagaataaagtcgtgagagttcagcggcccgcgaagaacggaaccgtgatggacgtcatctcccgcagagatcaacggggctctggacaggtgggaacatacggcctgaacaccttcacgaatatggaagtgcagctcatcagacagatggagagcgaagggatttttctgccgtccgagcttgagacccctaacctggccgaacgcgttctcgactggctggagaagcatggagctgaacggcttaaaagaatggccatctctggcgacgattgtgtggtcaagcccattgacgatcgcttcgctacagccctgaccgcgctcaatgacatggggaaagtgcggaaggatatccctcaatgggagcccagcaaaggctggaacgactggcagcaggttcctttttgctcccaccacttccatcagctgattatgaaggatggaagagaaatcgtggtcccctgtcgcaatcaagacgagctggtgggccgggccagagtcagccagggggctggatggtctctccgcgagacagcctgcctgggcaagtcctatgctcagatgtggcaacttatgtactttcaccggagagatctgcgcctcgccgctaacgccatctgtagcgcggtgccggttgactgggtgcctacctctcggacaacctggtccattcatgcccaccaccagtggatgacgacagaagatatgctgagcgtctggaatagagtgtggatcgaggaaaacccctggatggaggacaaaacccatgtttcctcttgggaagaggtgccctatcttgggaagcgggaggaccagtggtgcggaagcctgattggcctcaccgctagagccacatgggccaccaatatccaggtcgctattaaccaagtgcgccggctgatcgggaatgaaaactacctggattacatgacatccatgaaaagattcaagaatgagagcgaccctgaaggcgccctctggtga

SEQ ID NO: 18777 - RNA, 9879 nt, synthetic construct
  misc_feature 1..9879: note = derived and/or modified CDS sequence (opt5) from DENV-1__JN819410__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacactcgtcgatagaggctggggcaatgggtgtggactgttcggcaaagggaaccttctgacctgcgccaagtttaagtgcgtgacaaaactcgaaggaaagattgttcagtacgagaatctgaaatatagcgtgatcgtcacggtgcacaccggcgaccagcatcaagttgggaacgaaacaaccgagcacggaacaatcgctaccattacgccccaggcccctacctctgaaatccagctgacagattacggcgccctcaccctggactgttccccccggacaggccttgacttcaatgagatggtgctgctcaccatgaaggagaaaagctggctggtccataagcagtggtttcttgatctgcctctcccctggacgtctggggcttccacaagccaagaaacctggaaccgccaggacctgctggtgacattcaaaaccgcgcacgccaagaagcaggaggtcgtggttctcggatcccaagaaggcgctatgcacaccgccctgacaggggccacggagattcagacctctggaacaaccacaatctttgctggccatcttaaatgcagactgaagatggataaactcaccctgaaggggatgagctatgtgatgtgtacgggctccttcaaactggaaaaggaggtcgccgagacacagcacggaaccgtgcttgttcaggtgaagtacgaaggcaccgacgcgccgtgcaaaattcctttcagcacacaagatgagaagggggtcacccagaatggacggctcatcacagctaaccccatcgtgacggacaaagaaaagcctgtgaatattgagaccgagcccccctttggcgaatcttatatcgttgtcggggccggagagaaagccctgaagctgtcctggttcaagagaggcagctctattgggaaaatgtttgaagctacagcccgcggcgctcggagaatggccatcctcggagataccgcgtgggacttcggcagcattgggggagtgtttacatccgtgggcaagctggtccatcaggtgttcgggaccgcctacggagttcttttttctggcgtgagctggacgatgaaaatcgggatcggcattctgctcacctggctgggactgaactcccgcagcacatctctttccatgacctgtatcgctgtcggcatggtgacactctacctgggggttatggtgcaggccgatagcggatgcgtcattaactggaagggccgggagctgaaatgtgggtctggaatcttcgtgaccaatgaagttcacacatggaccgagcaatataagtttcaggctgactcccctaagagactcagcgccgcgattggcaaagcctgggaggaaggggtgtgcggcatccgctccgctacgcggctggagaacattatgtggaagcagatctctaatgaacttaaccatatcctgctcgagaatgatatgaaattcacagtcgtggtgggagacgccaacggcattctggctcaggggaagaaaatgatcagaccgcaacccatggaacacaagtacagctggaaatcctggggaaaggccaagattatcggcgccgacattcagaataccacctttatcatcgatgggcctgacacacccgagtgtcctgatggacagcgcgcttggaacatttgggaggtcgaagactatggcttcggcgtttttaccacgaatatctggctgaaacttcgggattcttacacacagatgtgcgaccacagactcatgagcgcggccattaaggattccaaagctgtgcatgccgacatggggtattggatcgagagcgaaaagaacgagacctggaaactggcccgcgcttctttcattgaagtgaagacatgtacctggcccaagtcccacacactgtggagcaatggagtcctcgagtctgagatgatcatcccgaaaatttacggcgggcctatctcccaacataactatcggcccggatacttcacccagacggccggcccttggcacctggggaagcttgaactggattttgacctctgcgagggaaccacagtggttgtggatgaacactgcggcaatagaggccccagcctgcggaccacaaccgtcacggggaaaattatccatgagtggtgttgccgctcttgtacactgcctccccttagattccggggagaggacggctgctggtacgggatggaaattagaccggtgaaggagaaagaagagaacctcgttcgcagcatggtgtccgcgggaagcggcgaagtcgattctttttccctggggatcctgtgtgtgagcatcatgattgaggaggttatgcggtccagatggtctcgcaagatgctcatgaccggaacactggctgtgttccttctgctcatcatgggccagctgacctggaatgacctgattagactttgcatcatggtcggcgccaacgccagcgaccggatggggatgggaaccacatatctggctctcatggccacgtttaagatgcgccctatgttcgcggtgggcctgctctttagacggctgacctcccgcgaagtgcttctgctcacaattgggctgtctctggtcgctagcgttgagcttcccaactccctggaagagctcggagatggcctggccatggggatcatgatgctcaaactgcttaccgaattccaaccccaccagctgtggacaaccctcctgtctctgacgtttattaagacaacccttagcctggactacgcctggaaaaccacagctatggtgctctccatcgtgagcctgttccctctctgtctgtctaccacatcccagaagacgacctggcttccggtcctgctgggaagctttggctgcaaacccctcacaatgttcctgatcaccgagaataagatttggggcagaaagtcttggcctcttaacgaggggatcatggccattggaatcgtgtccattctgctcagctctctgctcaaaaatgatgttcccctggctggccctcttatcgccgggggaatgctgatcgcgtgttatgtgatttccggcagctccgccgacctgagcctcgaaaaggctgccgaggtctcttgggaacaggaggctgaacatagcggggcctcccacaacatcctggtggaggttcaagatgacggaacaatgaaaattaaggatgaggaacgggacgatacccttacgatcctgctcaaagccaccctgctcgctgtgtctggcgtctaccccatgagcattcctgcgacactgtttgtgtggtatttctggcagaagaaaaagcagcgctccggcgtcctttgggacaccccctctccgcctgaggtggaaagagccgttctggatgacgggatctaccggatcctgcagcgcggactcctgggcagaagccaagtgggggtcggagtgttccaggatggcgtttttcatacaatgtggcacgtgacccggggggctgtccttatgtatcagggaaagagactggagccctcctgggcctctgtgaaaaaggacctcattagctacggcggcgggtggcgcttccagggatcctggaatacaggcgaggaagtgcaagttatcgccgtcgagcctgggaaaaaccccaagaatgtgcagacgaccccgggaacatttaaaacccctgaaggcgaggtgggggctattgccctggacttcaagcccggaaccagcggctctcctatcgtcaaccgggaaggcaagattgtggggctctacggaaatggcgttgtgacaacgtccgggacctatgtcagcgcgatcgctcaggccaaagcctctcaagagggacccctgcccgagattgaagatgaggtgtttaagaaaagaaaccttacaatcatggacctgcaccctggctccgggaagacccgccggtacctgccggctatcgttagagaagccattaaacgcaagctccggacactgatccttgcgcccaccagagtggtcgctagcgagatggccgaagccctgaagggcatgcctattcgctatcagacgacagctgtgaaatccgagcataccggacgggagatcgttgatctcatgtgccacgccaccttcacaatgagactgctgtctcccgtgcgggtccctaattacaacatgattatcatggacgaagctcattttaccgatcccgccagcatcgcggcccgcggctatatttccacaagagtggggatgggagaggctgccgctatcttcatgaccgccacgcctccgggcagcgtggaagcctttccccagtctaatgctgtcattcaggacgaggaacgggatatccctgagcgctcctggaacagcgggtacgactggattacagatttccccggaaagaccgtttggtttgtgccttctatcaaaagcggcaatgacatcgcgaactgtctcagaaagaacgggaaacgggtgattcaactttccagaaagacattcgataccgagtatcagaagacgaaaaataacgactgggactacgtcgtgaccacagatatctctgaaatgggcgccaatttccgcgctgaccgggttattgatcccagacgctgcctgaagccggtgatcctgaaagacggacctgagcgggtcattctcgccggccccatgcccgtgaccgttgccagcgctgcccagagacgcgggcggatcggaagaaaccagaataaggaaggcgatcaatacgtgtatatggggcagcctctgaacaatgacgaggatcacgcgcattggacagaggctaaaatgcttctggacaacattaatacccccgaaggaatcatccctgccctctttgagccggaacgcgagaagtccgccgctattgatggcgaatacagactgcggggggaggcccgcaagacattcgtcgagctgatgagacggggcgacctccccgtgtggctttcttataaagtcgcgagcgaaggatttcagtactccgatcgcagatggtgcttcgacggcgagcggaacaatcaggtgctggaagagaacatggatgttgaaatctggaccaaggagggggagagaaaaaagctgcgccctcggtggctcgacgccagaacgtatagcgaccccctggctcttcgcgaatttaaagagttcgccgctggacggagatctgtgtccggcgatctgattctcgaaatcgggaagctgcctcaacacctgacactccgggcccagaatgctcttgacaacctggtgatgctgcacaatagcgagcagggaggcaaagcctaccgccatgcgatggaagagctccccgataccattgagaccctgatgcttctggccctcatcgctgtcctgacaggcggggttaccctgtttttcctctccggaaagggccttgggaagacatctatcggactgctgtgtgtgacggccagctccgctctcctgtggatggcctctgtggaaccgcactggattgccgctagcatcattcttgagtttttcctgatggtcctcctgatccctgaacccgacagacagcggacccctcaagataaccagctggcgtatgtggttattggcctcctttttatgatcctgacagtggccgctaacgagatggggctgctcgagaccacaaaaaaggacctgggaatcggctacgtcgccgccgaaaatcatcagcacgctaccatgcttgatgtggacctgcaccccgcctccgcgtggacgctctacgccgtcgctaccacagtgattacccctatgatgcgccatacaatcgagaacaccacggccaatattagcctgacagctatcgccaaccaagcggccattctgatgggcctcgataaagggtggcccatctctaagatggacattggagttccgcttctggctctgggctgctattcccaggtgaatcctctcaccctgacagccgctgtccttatgctggtggcccactacgctatcatcgggcccggactccaggccaaagcgaccagagaagcccagaagcggaccgctgccggcattatgaagaaccccacagttgatgggatcgtggctattgacctggatcctgtcgtgtatgacgccaaattcgagaagcaactgggacagatcatgctccttattctgtgtacgagccagatcctgctcatgcgcaccacatgggccctgtgcgaatctatcacccttgcgacaggcccgctgaccacgctctgggagggctcccccgggaaattttggaatacaaccattgctgtgagcatggccaacatcttcagaggatcttacctggctggcgccgggctggccttcagcctcatgaagtcccttggaggcgggcggcgcggaaccggcgctcagggcgagacactgggggaaaaatggaagagacaactgaatcagctctctaagagcgagtttaacacctataaacggtccggaattatggaagttgacagaagcgaggccaaggaaggcctgaaacgcggggagacaacgaagcatgcggtctcccggggaaccgccaaacttagatggttcgtggagcgcaatctggtgaagcctgaaggcaaggtcatcgatctcgggtgtggacggggcggctggtcttactattgcgctgggctgaaaaaggttacagaggtgaaaggatacaccaagggcgggcccggacacgaagagcctattcccatggccacatacggctggaacctggtgaaactccatagcgggaaggacgtctttttcatgcctccggaaaaatgtgatacccttctgtgcgacatcggagagtcctctcccaatcctacgatcgaggaaggcagaaccctgcgcgtgctcaagatggttgagccctggctgcggggcaaccagttttgtattaagatccttaatccttatatgcccagcgtggtcgaaacactggagcagatgcaaagaaaacacgggggaatgctcgtgcgcaacccgctgtcccggaattctacccacgagatgtactgggttagctgcggcacagggaacattgtgtccgctgtcaacatgaccagcagaatgctgctcaatcgcttcacaatggcccatcggaagcctacctatgaaagagatgtggacctgggagcgggcacgcgccacgtggccgtcgagcccgaagttgctaaccttgatatcattgggcagagaatcgagaatattaaaaacgaacataagtctacatggcactacgacgaggataatccctataaaacctgggcctaccacggatcctatgaggtgaagcctagcggctctgcttccagcatggtgaacggcgtcgtgcggctgctcaccaagccctgggacgttatccctatggtgacacagatcgccatgacggataccacaccgtttgggcaacagcgcgtcttcaaagaaaaggtggacaccagaacaccccgggctaaaagaggaaccacacagattatggaggttaccgccaagtggctgtggggctttctttctcggaataaaaagcctcgcatctgtacgagagaagagttcacccggaaggtgcgctccaacgcggccattggggctgtctttgtggacgaaaatcagtggaacagcgccaaagaggctgttgaggatgaaagattctgggacctggtgcatcgggagcgcgaactccacaagcaaggaaaatgcgccacatgcgtctacaatatgatgggcaagagagagaaaaagctgggggaatttggcaaggccaaaggatcccgggcgatctggtacatgtggctgggcgctcgcttcctcgagttcgaggccctggggtttatgaacgaagatcattggttcagcagagagaattctcttagcggagtggaaggcgaggggctgcacaagctcggatatattctgcgggacatctccaaaatccccggcgggaacatgtacgccgatgacaccgctggctgggatacacgcattaccgaggacgatcttcagaatgaagccaagatcacggacattatggagcctgaacatgctctgctcgccacatctatctttaaactgacctatcagaacaaggtcgtgagagttcagcggcccgcgaaaaacggaacagtgatggatgtcattagccgcagagaccaacggggctccgggcaggtgggaacctacggcctgaatacgttcaccaacatggaggtgcagctcatcagacagatggaatctgaggggatctttctgccgagcgagcttgaaacacctaatctggccgagcgcgctctcgattggctggaaaagcacggagccgagcggcttaagagaatggctatttccggcgacgactgtgttgtgaaacccatcgatgaccgcttcgccaccgcgctgacagccctcaacgatatggggaaggtccggaaagacattcctcaatgggaaccctctaagggctggaatgattggcagcaggtgcctttttgcagccaccatttccaccagctgatcatgaaagacggaagagagattgttgtgccctgtcgcaaccaagatgagctggtcggccgggctagagtgtcccagggggccggatggagcctccgcgaaaccgcttgcctgggcaagtcttatgcccagatgtggcaacttatgtactttcatcggagagacctgcgcctcgctgccaatgcgatctgttccgccgtcccggtggattgggttcctacaagccggaccacgtggtctatccacgctcaccatcagtggatgacaaccgaggacatgctgtccgtgtggaacagagtctggattgaagagaatccctggatggaagataagacccacgtgagctcctgggaggaggttccctatcttgggaaacgggaagaccagtggtgcggatctctgatcggcctcacagccagagccacctgggctacaaacattcaggtggccatcaatcaagtccgccggctgattgggaacgagaattacctggactacatgacgagcatgaagagattcaaaaacgaatccgatcctgagggcgcgctctggtga

SEQ ID NO: 18778 - RNA, 9879 nt, synthetic construct
  misc_feature 1..9879: note = derived and/or modified CDS sequence (opt5) from DENV-1__FJ639806__SS-prME
  source 1..9879: mol_type = other RNA
agcgtgaccatgctgctcatgctgcttcccaccgctctggctttccacctcacgacccggggcggggaacctcatatgatcgtctccaagcaggaacgggggaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcaccggcgggacaagcgctctgtcgccctggctcctcatgtggggctcggactggagacacggaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcagagcctgggaggagggggtgtgcggcatccgctctgctacgcggctggaaaatattatgtggaagcagatcagcaacgagcttaatcatatcctgctcgaaaacgacatgaaattcacagtcgtggtgggagacgccaatggcattctggctcaggggaagaaaatgatcagaccgcaacccatggagcacaagtactcctggaaatcttggggaaaggccaagattatcggcgccgatattcagaacaccacctttatcatcgacgggcctgatacacccgaatgtcctgacggacagcgcgcttggaatatttgggaggtcgaggattatggcttcggcatctttaccacgaacatttggctgaaacttcgggacagctacacacagatgtgcgatcacagactcatgtccgcggccatcaaggacagcaaagctgttcatgccgatatggggtattggattgaatctgagaagaatgaaacctggaaactggcccgcgcttccttcatcgaggtgaagacatgtatctggcccaagagccacaccctgtggtctaacggagtgctcgaatccgagatgattatcccgaaaatttacggcgggcctatcagccaacataattatcggcccggatacttcacacagaccgccggcccttggcacctggggaaacttgagctggactttgatctctgcgaaggaacgaccgtcgtggttgacgagcactgcggcaacagaggcccctctctgcggacaaccacagtgaccgggaaaattatccatgaatggtgttgccgcagctgtacgctgcctccccttagattccggggagaggatggctgctggtacgggatggagatcagaccggtcaaggaaaaagaggaaaatctcgtgcgctccatggttagcgcgggatctggcgaggtggactcctttagcctggggattctgtgtgtctccatcatgattgaagaggtgatgcggtctagatggagccgcaagatgctcatgacaggaaccctggctgttttccttctgctcatcatgggccagctgacatggaacgacctgattagactttgcatcatggtgggcgccaatgcctccgatcggatggggatgggaaccacctatctggctctcatggccacatttaagatgcgccctatgttcgcggtcggcctgctctttagacggctgacgtctcgcgaggtgcttctgctcaccattgggctgagcctggtggcttccgtcgaacttcccaactctctggaggaactcggagacggcctggccatggggatcatgatgctcaaactgcttacagagttccaaccccaccagctgtggaccacactcctgagcctgacctttgttaagacgacactttccctggattacgcctggaaaaccaccgctatggtgctcagcatcgtgtctctgttccctctctgtctgtccacaaccagccagaagacaacgtggcttccggtcctgctgggatcttttggctgcaaacccctcaccatgttcctgattacagaaaacaagatctggggcagaaagtcctggcctcttaatgaggggattatggccatcggaattgtgagcatcctgctctcttccctgctcaaaaacgacgttcccctggctggccctcttatcgccgggggaatgctgattgcgtgttatgtgatcagcggctccagcgccgatctgtctctcgagaaggctgccgaagtcagctgggagcaggaagctgagcattccggggcctctcacaatattctggtggaagttcaagacgatggaaccatgaaaatcaaggacgaggagcgggatgacacacttaccattctgctcaaagccacgctgctcgctgtgagcggcgtctaccccatgtccatccctgcgaccctgtttgtgtggtatttctggcagaagaaaaagcagcgctctggcgtcctttgggatacacccagcccgcctgaagtggagagagccgttctggacgatgggatctaccggattctgcagcgcggactcctgggcagatcccaagtgggggtcggagtgttccaggacggcgtttttcataccatgtggcacgtgacaagaggggctgtccttatgtatcagggaaagagactggaaccctcttgggccagcgtgaaaaaggacctcatctcctacggcggcgggtggcgcttccagggaagctggaacaccggcgaggaggtgcaagttattgccgtcgaacctgggaaaaatcccaagaacgtgcagacaacgccgggaacctttaaaacacctgagggcgaagtgggggctatcgccctggatttcaagcccggaacctctggctcccctattgtcaatcgggagggcaagatcgtggggctctacggaaacggcgttgtgaccacaagcgggacgtatgtctctgcgattgctcaggccaaagcctcccaagaaggacccctgcccgagatcgaggacgaagtgtttaagaaaagaaatcttaccatcatggatctgcaccctggcagcgggaagacacgccggtacctgccggctattgttagagaggccatcaaacgcaagctccggaccctgattcttgcgcccacaagagtggtcgcttccgaaatggccgaggccctgaagggcatgcctatccgctatcagaccacggctgtgaaatctgaacatacaggacgggagattgttgacctcatgtgccacgccaccttcaccatgagactgctgagccccgtgcgggtccctaactacaatatgatcatcatggatgaggctcattttacagaccccgcctccattgcggcccgcggctatatcagcaccagagtggggatgggagaagctgccgctattttcatgacagccacccctccgggctctgtggaggcctttccccagtccaacgctgtcatccaggatgaagaacgggacattcctgaacgcagctggaactctgggtacgattggatcacggacttccccggaaagacagtttggtttgtgcctagcatcaaatccggcaacgatattgcgaattgtctcagaaagaacgggaaacgggtgatccaactttctagaaagaccttcgacacagagtatcagaagaccaaaaacaatgactgggattacgtcgtgacgaccgacattagcgagatgggcgccaacttccgcgctgatcgggttatcgaccccagacgctgcctgaagccggtgattctgaaagatggacctgaacgggtcatcctcgccggccccatgcccgtgacagttgcctccgctgcccagagacgcgggcggattggaagaaatcagaacaaggagggcgaccaatacgtgtatatggggcagcctctgaataacgatgaagaccacgcgcattggaccgaggctaaaatgcttctggataatatcaacacacccgagggaatcattcctgccctctttgaaccggagcgcgaaaagtctgccgctatcgacggcgagtacagactgagaggggaagcccgcaagaccttcgtcgagctgatgagacggggcgatctccccgtgtggcttagctataaagtcgcgtccgagggatttcagtacagcgaccgcagatggtgcttcgatggcgaacggaataaccaggtgctggaggaaaatatggacgttgagatttggacaaaggaaggggagcgcaagaagctgcgccctcggtggctcgacgccagaacctattctgatcccctggcccttcgcgagtttaaagagttcgccgctggacggagatccgtgagcggcgacctgatcctcgagattgggaagctgcctcaacacctgacgctccgggcccagaacgctcttgataatctggtgatgctgcacaactccgaacagggaggcaaagcctaccgccatgcgatggaggaactccccgacacaatcgagaccctgatgcttctggccctcatcgctgtcctgaccggcggggttacactgtttttcctctctggaaagggccttgggaagaccagcattggactgctgtgtgtgacagcctcctctgctctcctgtggatggccagcgtggagccgcactggatcgccgcttccattatccttgaatttttcctgatggtcctcctgattcctgagcccgatagacagcggacgcctcaagacaatcagctggcgtatgtggttatcggcctcctttttatgatcctgaccgtggccgctaacgaaatggggctgctcgagacaaccaaaaaggatctgggaattggctacgtcgccgccgagaaccatcagcacgctacaatgcttgacgtggatctgcgccccgccagcgcgtggaccctctacgccgtcgctacgaccgtgatcacacctatgatgagacacaccattgaaaatacaaccgccaacatctctctgacggctattgccaatcaagcggccatcctgatgggcctcgacaaagggtggcccatttccaagatggatatcggagttccgcttctggctctgggctgctatagccaggtgaaccctctcacactgaccgccgctgtccttatgctggtggcccattacgctatcattgggcccggactccaggccaaagcgacacgggaggcccagaagcgcaccgctgccggcatcatgaagaatcccaccgttgacgggattgtggctatcgatctggaccctgtcgtgtatgacgccaaattcgaaaagcaactgggacagattatgctccttatcctgtgtacatctcagatcctgctcatgagaacgacctgggccctgtgcgagtccattacacttgcgaccggcccgctgacaaccctctgggaaggcagccccgggaaattttggaacacgacaatcgctgtgtctatggccaatattttccggggaagctacctggctggcgccgggctggccttctccctcatgaagtctcttggaggcgggcgcagaggaaccggcgctcagggcgagaccctgggggagaaatggaagcggcaactgaaccagctcagcaagtccgaatttaatacatataaaagaagcggaatcatggaggttgatcgctccgaagccaaggagggcctgaaaagaggggaaaccacaaagcacgcggtctctagaggaacggccaaacttcgctggttcgtggagcggaacctggtgaagcctgagggcaaggtcattgacctcgggtgtggaagaggcggctggagctactattgcgctgggctgaaaaaggttaccgaagtgaaaggatacacaaagggcgggcccggacatgaggaacctatccccatggccacctacggctggaatctggtgaaactccactccgggaaggatgtctttttcatgcctccggagaaatgtgacacacttctgtgcgatatcggagaatctagccccaaccctaccattgaggagggccgcacgctgcgggtgctcaagatggttgaaccctggctgaagggcaatcagttttgtatcaaaattcttaacccttatatgccctccgtggtcgagaccctggaacagatgcaaagaaagcatgggggaatgctcgtgcgcaatccgctgtctcggaacagcacacacgagatgtactgggtttcctgcggcaccgggaatatcgtgagcgctgtcaacatgacatctagaatgctgctcaaccgcttcaccatggcccaccggaaacctacatatgagagagacgtggatctgggagcgggcacccgccatgtggccgtcgaacccgaggttgctaatcttgacattatcgggcagagaattgaaaacatcaagaatgagcacaaatccacgtggcattacgatgaagacaacccctataagacatgggcctaccacggaagctatgaggtgaagccttctggctccgctagctctatggtgaatggcgtcgtgcggctgctcaccaaaccctgggatgttatccctatggtgacccagattgccatgacagacacgaccccgtttgggcaacagcgcgtcttcaaggagaaagtggacacaagaacaccccgggctaagagaggaacaacccagatcatggaagttacagccaaatggctgtggggctttctttcccggaacaagaagcctcgcatttgtaccagagaggagttcacgcggaaagtgcgcagcaatgcggccatcggggctgtctttgtggatgagaaccagtggaactccgccaaggaagctgttgaggacgagagattctgggatctggtgcaccgggaacgcgagctccataaacaaggaaagtgcgcgacctgcgtctacaacatgatgggcaaaagagaaaagaagctgggggagtttggcaaagccaagggaagccgggccatttggtacatgtggctgggcgctcgcttcctcgagttcgaggccctggggtttatgaatgaggaccactggttctctagagaaaacagcctttccggagtggagggcgaagggctgcataaactcggatatatcctgcgggatatctctaagattcccggcgggaatatgtacgccgacgatacagctggctgggacacccgcatcacagaggatgaccttcagaacgaggccaaaattaccgatatcatggaacctgagcacgctctgctcgccacgagcatttttaagctgacatatcagaataaagtcgtgagagttcagcggcccgcgaagaacggaaccgtgatggacgtcatctcccgcagagatcaacggggctctggacaggtgggaacatacggcctgaacaccttcacgaatatggaagtgcagctcatcagacagatggagagcgaagggatttttctgccgtccgagcttgagacccctaacctggccgaacgcgttctcgactggctgaagaaacatggagctgagcggcttaagagaatggccatctctggcgacgattgtgtggtcaaacccattgacgatcgcttcgctacagccctgaccgcgctcaatgacatggggaaggtgcggaaagatatccctcaatgggaacccagcaagggctggaacgactggcagcaggttcctttttgctcccaccacttccatcagctgattatgaaggatggaagagagatcgtggtcccctgtcgcaatcaagacgaactggtgggccgggccagagtcagccagggggctggatggtctctccgcgagacagcctgcctgggcaaatcctatgctcagatgtggcaacttatgtactttcaccggagagatctgcgcctcgccgctaacgccatctgtagcgcggtgccggttgactgggtgcctacctctcggacaacctggtccattcatgcccaccaccagtggatgacgacagaggatatgctgagcgtctggaatagagtgtggatcgaagagaacccctggatggaagacaagacccatgtttcctcttgggaggaagtgccctatcttgggaaacgggaggaccagtggtgcggaagcctgattggcctcaccgctagagccacatgggccaccaatatccaggtcgctattaaccaagtgcgccggctgatcgggaatgagaactacctggattacatgacatccatgaagagattcaaaaatgaaagcgaccctgagggcgccctctggtga

SEQ ID NO: 18779 - RNA, 9879 nt, synthetic construct
  misc_feature 1..9879: note = derived and/or modified CDS sequence (opt5) from DENV-1__JN819411__SS-prME
  source 1..9879: mol_type = other RNA
agcgtgaccatgctgctcatgctgcttcccacagctctggctttccacctcacgaccagaggcggggaacctcatatgatcgtctccaagcaggaacggggaaagtctctgctttttaagacaagcgccggcgttaatatgtgcaccctgattgcgatggacctcggggaactgtgtgaagatacaatgacctacaagtgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggcccttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaaacttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattgtgggccagctgacctggaacgacctgatccgcctttgcattatggtcggcgccaatgcctccgatagaatggggatgggaaccacatatctggctctcatggccacgtttaaaatgcggcctatgttcgcggtgggcctgctctttcgcagactgacctctcgggaggtgcttctgctcacaatcgggctgagcctggtcgcttccgttgaacttcccaactctctggaggaactcggagacggcctggccatggggattatgatgctcaagctgcttaccgagttccaaccccaccagctgtggacaaccctcctgagcctgacgtttgtgaaaacaaccctttccctggattacgcctggaagaccacagctatggtgctcagcatcgtctctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggccattggaatcgttagcattctgctctcttccctgctcaagaacgacgtgcccctggctggccctcttatcgccgggggaatgctgatcgcgtgttatgtcattagcggctccagcgccgatctgtctctcgagaaagctgccgaagtgagctgggagcaggaagctgagcattccggggcctctcacaatatcctggttgaagtgcaagacgatggaacaatgaagattaaagacgaggagagagatgacacccttacgatcctgctcaaggccaccctgctcgctgtcagcggcgtgtaccccatgtccattcctgcgacactgtttgtctggtatttctggcagaaaaagaagcagcggtctggcgtgctttgggatacccccagcccgcctgaagttgagcgcgccgtgctggacgatgggatctacagaatcctgcagcggggactcctgggccgctcccaagtcggggtgggagttttccaggacggcgtgtttcatacaatgtggcacgtcaccagaggggctgtgcttatgtatcagggaaaacggctggaaccctcttgggccagcgtgaagaaagacctcatttcctacggcggcgggtggagattccagggaagctggaacacaggcgaggaggttcaagtcatcgccgtggaacctgggaagaatcccaaaaacgtgcagacgaccccgggaacatttaagacccctgagggcgaagtcggggctattgccctggatttcaagcccggaacctctggctcccctatcgtgaatcgcgagggcaaaattgttgggctctacggaaacggcgtggtcacaacgagcgggacctatgtgtctgcgatcgctcaggccaaggcctcccaagaaggacccctgcccgagattgaggacgaagtttttaaaaagcggaatcttacaatcatggatctgcaccctggcagcgggaaaaccagacgctacctgccggctatcgtgcgggaggccattaagagaaagctccgcacactgatccttgcgcccacccgggtcgtggcttccgaaatggccgaggccctgaaaggcatgcctattagatatcagacgacagctgttaagtctgaacataccggacgcgagatcgtggacctcatgtgccacgccaccttcacaatgcggctgctgagccccgtcagagtgcctaactacaatatgattatcatggatgaggctcattttaccgaccccgcctccatcgcggcccggggctatattagcacacgcgtggggatgggagaagctgccgctatcttcatgaccgccacgcctccgggctctgtcgaggcctttccccagtccaacgctgttattcaggatgaagagagagacatccctgaacggagctggaactctgggtacgattggattacagacttccccggaaaaaccgtgtggtttgtgcctagcatcaagtccggcaacgatatcgcgaattgtctccgcaaaaacgggaagagagtcattcaactttctcggaagacattcgacaccgagtatcagaaaacgaagaacaatgactgggattacgtggttaccacagacatcagcgagatgggcgccaacttcagagctgatcgcgtgattgacccccggagatgcctgaaaccggtcatcctgaaggatggacctgaacgcgtgattctcgccggccccatgcccgttaccgtggcctccgctgcccagcggagagggcgcatcggacggaatcagaacaaagagggcgaccaatacgtctatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtggagctgatgcgcagaggcgatctccccgtctggcttagctataaggtggcgtccgagggatttcagtacagcgaccggcgctggtgcttcgatggcgaaagaaataaccaggttctggaggaaaatatggacgtggagatctggaccaaagaaggggagcggaagaaactgagacctcgctggctcgacgcccggacgtattctgatcccctggctcttagagagtttaaggagttcgccgctggacgccggtccgtgagcggcgacctgattctcgagatcgggaaactgcctcaacacctgacactcagagcccagaacgctcttgataatctggtcatgctgcacaactccgaacagggaggcaaggcctaccggcatgcgatggaggaactccccgacaccattgagaccctgatgcttctggccctcatcgctgttctgacaggcggggtgaccctgtttttcctctctggaaagggccttgggaaaacaagcatcggactgctgtgtgtgacggcctcctctgctctcctgtggatggccagcgtcgagccgcactggattgccgcttccatcattcttgaatttttcctgatggtgctcctgatccctgagcccgatcgccagagaacccctcaagacaatcagctggcgtatgttgtgattggcctcctttttatgatcctgacagtcgccgctaacgaaatggggctgctcgagaccacaaagaaagatctgggaatcggctacgtggccgccgagaaccatcagcacgctaccatgcttgacgtcgatctgcggcccgccagcgcgtggacgctctacgccgtggctaccacagttattacccctatgatgcgccacacaatcgaaaataccacggccaacatttctctgacagctatcgccaatcaagcggccattctgatgggcctcgacaaggggtggcccatctccaaaatggatattggagtgccgcttctggctctgggctgctatagccaggtcaaccctctcaccctgacagccgctgtgcttatgctggttgcccattacgctatcatcgggcccggactccaggccaaggcgaccagagaggcccagaagcggaccgctgccggcattatgaaaaatcccacagtggacgggatcgtcgctattgatctggaccctgtggtgtatgacgccaagttcgaaaaacaactgggacagatcatgctccttattctgtgtacgtctcagatcctgctcatgcgcaccacatgggccctgtgcgagtccatcacccttgcgacaggcccgctgaccacgctctgggaaggcagccccgggaagttttggaacacaaccattgctgtttctatggccaatatcttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaattatggaggtcgatagatccgaagccaaagagggcctgaagcgcggggaaacaacgaaacacgcggtgtctcggggaaccgccaaacttagatggttcgtggagcgcaacctggtcaagcctgagggcaaagttatcgacctcgggtgtggacggggcggctggagctactattgcgctgggctgaagaaagtgacagaagtgaagggatacaccaaaggcgggcccggacatgaggaacctgtccccatggccacatacggctggaatctggtgaagctccactccgggaaagatgtgtttttcatgcctccggagaagtgtgacacccttctgtgcgatattggagaatctagccccaaccctacgatcgaggagggcagaaccctgcgcgttctcaagatggtcgaaccctggctgaaaggcaatcagttttgtatcaagattcttaacccttatatgccctccgtggttgagacactggaacagatgcaacggaaacatgggggaatgctcgtgagaaatccgctgtctcgcaacagcacccacgagatgtactgggtctcctgcggcacagggaatatcgtgagcgctgtgaacatgacctctcggatgctgctcaacagattcacaatggcccaccgcaagcctacctatgagcgggacgtcgatctgggagcgggcacgagacatgttgccgtggaacccgaggtggctaatcttgacattatcgggcagcgcattgaaaacatcaaaaatgagcacaagctgacatggcattacgatgaagacaacccctataagacctgggcctaccacggatcctatgaggtcaaacctagcggctctgcttccagcatggtgaatggcgttgtgagactcctgaccaagccctgggatgtcattcctatggtgacacagatcgccatgacggacaccacaccgtttgggcaacagcgggttttcaaagagaaggtggacacccgcacacccagagctaaacggggaaccacacagatcatggaagtcaccgccaagtggctttggggctttctgtctagaaacaagaaacctcggatttgtacgcgcgaggagttcaccagaaaggtgcggtccaatgcggccatcggggctgtttttgtggatgagaaccagtggaatagcgccaaagaagctgtcgaggacgagcgcttctgggatctcgtgcacagagaacgggagctgcataagcaaggaaaatgcgccacatgcgtctacaacatgatgggcaagcgcgaaaagaaactgggggagtttggcaaggccaaaggatccagagcgatttggtacatgtggctcggcgctcggttcctggagttcgaggcccttgggtttatgaatgaggaccactggttcagccgcgaaaactctctgagcggagtggagggcgaagggctccataagctgggatatatccttagagatatttccaaaatccccggcgggaatatgtacgccgacgataccgctggctgggacacacggatcaccgaggatgacctgcagaacgaggccaagattacggatatcatggaacctgagcacgctctcctggccacatctatttttaaactgacctatcagaataaggttgtgcgcgtccagagacccgcgaagaacggaacagtgatggacgtgatcagccggcgcgatcaaagaggctccgggcaggttggaacctacggcctcaacacgttcaccaatatggaagtgcagctgattcggcagatggagtctgaagggatctttagcccgtccgagcttgagacacctaacctggccgaaagagtcctcgactggctggagaaacatggagctgaacgccttaagcggatggccatctctggcgacgattgtgtggttaaacccattgacgatagattcgctaccgccctgacagcgctcaatgacatggggaaggtgcgcaaagatatccctcaatgggagcccagcaagggctggaacgactggcagcaggtccctttttgctcccaccacttccatcagctgattatgaaggatggacgggaaatcgtggtcccctgtagaaatcaagacgagctggtgggccgcgcccgggttagccagggggctggatggtctctcagagagaccgcctgcctgggcaaatcctatgctcagatgtggcaacttatgtactttcaccgccgggatctgagactcgccgctaacgccatttgtagcgcggtgccggtcgactgggtgcctacatctcgcaccacgtggtccatccatgcccaccaccagtggatgacaaccgaagatatgctgagcgtttggaatcgggtgtggatcgaggaaaacccctggatggaggacaagacccatgtctcctcttgggaagaggtgccctatcttgggaaaagagaggaccagtggtgcggaagcctgattggcctcacagctcgggccacctgggccacaaatatccaggtggctattaaccaagttagacgcctgatcgggaatgaaaactacctggattacatgacgtccatgaagcggttcaaaaatgagagcgaccctgaaggcgccctctggtga

SEQ ID NO: 18780 - RNA, 9879 nt, synthetic construct
  misc_feature 1..9879: note = derived and/or modified CDS sequence (opt5) from DENV-1__FJ639812__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatgatgctgctcaccatgaaggagaaatcttggctggtgcataagcagtggtttcttgacctgcctctcccctggacgtccggggctagcacatcccaagagacctggaatcgccaggatctgctggtcacattcaaaaccgcgcacgccaagaagcaggaagtggtcgtgctcggatctcaagagggcgctatgcacaccgccctgacaggggccacggaaattcagaccagcggaacaaccacaatctttgctggccatcttaaatgcagactgaagatggacaaactcaccctgaaggggatgtcctatgttatgtgtacgggcagcttcaaactggagaaggaagtggccgagacacagcacggaaccgtccttgtgcaggttaagtacgagggcaccgatgcgccgtgcaaaattcctttctctacacaagacgaaaagggggtgacccagaacggacggctcatcacagctaatcccatcgtcacggataaagagaagcctgtgaacattgaaaccgagcccccctttggcgagtcctatatcgtggttggggccggagaaaaagccctgaagctgagctggttcaagaaaggctctagcattgggaagatgtttgaggctacagccagaggcgctcgccggatggccatcctcggagacaccgcgtgggatttcggctccattgggggagtctttacatctgtgggcaaactggtgcatcaggtcttcgggaccgcctacggagtgctttttagcggcgtttcctggacgatgaagatcgggatcggcattctgctcacctggctgggactgaatagcagatctacatcccttagcatgacctgtatcgctgtgggcatggtcacactctacctgggggtgatggttcaggccgactctggatgcgtgattaactggaaaggccgcgaactgaagtgtgggtccggaatcttcgtcaccaacgaggtgcacacatggaccgaacaatataagtttcaggctgatagccctaaacggctctccgccgcgattggcaaggcctgggaggagggggtttgcggcatcagatctgctacgcgcctggaaaatattatgtggaaacagatcagcaacgagcttaatcatatcctgctcgaaaacgacatgaagttcacagtggtcgtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtggaggattatggcttcggcatctttaccacgaacatttggctgaagcttcgcgacagctacacacagatgtgcgatcaccggctcatgtccgcggccatcaaagacagcaaggctgtccatgccgatatggggtattggattgaatctgagaaaaatgaaacctggaagctggccagagcttccttcatcgaggttaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtggtcgtggacgagcactgcggcaaccggggcccctctctgagaaccacaaccgttacggggaagatcattcatgaatggtgttgccggagctgtacactgcctccccttcgcttcagaggagaggatggctgctggtacgggatggagatccggccggtgaaagaaaaggaggaaaatctcgtcagatccatggtgagcgcgggatctggcgaggttgactcctttagcctggggatcctgtgtgtgtccattatgatcgaagaggtcatgcgctctcggtggagcagaaagatgctcatgaccggaacactggctgtgttccttctgctcattatgggccagctgacctggaacgacctgatccgcctttgcattatggttggcgccaatgcctccgatagaatggggatgggaaccacatatctggctctcatggccacgtttaaaatgcggcctatgttcgcggtgggcctgctctttcgcagactgacctctcgggaggtccttctgctcacaatcgggctgagcctggtggcttccgtggaacttcccaactctctggaggaactcggagacggcctggccatggggattatgatgctcaagctgcttaccgagttccaaccccaccagctgtggacaaccctcctgagcctgacgtttgtcaaaacaaccctttccctggattacgcctggaagaccacagctatggttctcagcatcgtgtctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggccattggaatcgtcagcattctgctctcttccctgctcaagaacgacgtgcccctggctggccctcttatcgccgggggaatgctgatcgcgtgttatgttattagcggctccagcgccgatctgctcctggagaaagctgccgaagtgtcttgggagcaggaagctgagcatagcggggcctcccacaatatccttgtcgaagtgcaagacgatggaacaatgaagattaaagacgaggagagagatgacaccctgacgatcctcctgaaggccaccctcctggctgtttctggcgtgtaccccatgagcattcctgcgacactttttgtctggtatttctggcagaaaaagaagcagcggtccggcgtgctgtgggataccccctctccgcctgaagtcgagcgcgccgtgctggacgatgggatctacagaatcctccagcggggactgcttggccgcagccaagttggggtgggagtcttccaggacggcgtgtttcatacaatgtggcacgttaccagaggggctgtgctgatgtatcagggaaaacggctcgaaccctcctgggcctctgtcaagaaagacctgattagctacggcggcgggtggagattccagggatcctggaacacaggcgaggaggtgcaagtgatcgccgttgaacctgggaagaatcccaaaaacgtccagacgaccccgggaacatttaagacccctgagggcgaagtgggggctattgccctcgatttcaagcccggaaccagcggctctcctatcgtgaatcgcgagggcaaaattgtcgggctgtacggaaacggcgtggttacaacgtccgggacctatgtgagcgcgatcgctcaggccaaggcctctcaagaaggaccccttcccgagattgaggacgaagtctttaaaaagcggaatctgacaatcatggatctgcaccctggctccgggaaaaccagacgctacctcccggctatcgtgcgggaggccattaagagaaagctgcgcacacttatcctggcgcccacccgggttgtggctagcgaaatggccgaggccctcaaaggcatgcctattagatatcagacgacagctgtcaagtccgaacataccggacgcgagatcgtggacctgatgtgccacgccaccttcacaatgcggctgctctctcccgttagagtgcctaactacaatatgattatcatggatgaggctcattttaccgaccccgccagcatcgcggcccggggctatatttccacacgcgtcgggatgggagaagctgccgctatcttcatgaccgccacgcctccgggcagcgtggaggcctttccccagtctaacgctgtgattcaggatgaagagagagacatccctgaacggtcctggaatagcgggtacgattggattacagacttccccggaaaaaccgtctggtttgttccttctatcaagagcggcaacgatatcgcgaattgtcttcgcaaaaacgggaagagagtgattcaactgtcccggaagacattcgacaccgagtatcagaaaacgaagaacaatgactgggattacgtggtcaccacagacatctctgagatgggcgccaacttcagagctgatcgcgtgattgacccccggagatgcctgaaaccggttatcctcaaggatggacctgaacgcgtgattctggccggccccatgcccgtcaccgtggccagcgctgcccagcggagagggcgcatcggacggaatcagaacaaagagggcgaccaatacgtttatatggggcagcctcttaataacgatgaagaccacgcgcattggacagaggctaagatgctgctcgataatattaacacccccgagggaatcatccctgccctgtttgaaccggagagagaaaagtccgccgctattgacggcgagtaccgcctgagaggggaagcccggaaaacattcgtggagctcatgcgcagaggcgatcttcccgtctggctgtcttataaggtggcgagcgagggatttcagtactccgaccggcgctggtgcttcgatggcgaaagaaataaccaggtcctggaggaaaatatggacgtggagatctggaccaaagaaggggagcggaagaaactcagacctcgctggctggacgcccggacgtatagcgatccccttgctctgagagagtttaaggaattcgccgctggacgccggtctgtttccggcgacctcattctggagatcgggaaactgcctcaacacctcacacttagagcccagaacgctctggataatctggtgatgctccacaacagcgaacagggaggcaaggcctaccggcatgcgatggaggaactgcccgacaccattgagacccttatgctgctcgccctgatcgctgtgctgacaggcggggtcaccctctttttcctttccggaaagggcctggggaaaacatctatcggactgctctgtgttacggccagctccgctctgctttggatggcctctgtggagccgcactggattgccgctagcatcattctggaatttttcctcatggtgctgctgatccctgagcccgatcgccagagaacccctcaagacaatcagctcgcgtatgtcgtgattggccttctgtttatgatcctgacagttgccgctaacgaaatggggctcctggagaccacaaagaaagatcttggaatcggctacgtggccgccgagaaccatcagcacgctaccatgctggacgtcgatctccggcccgcctccgcgtggacgctgtacgccgtggctaccacagtcattacccctatgatgcgccacacaatcgaaaataccacggccaacattagcctgacagctatcgccaatcaagcggccattctcatgggccttgacaaggggtggcccatctctaaaatggatattggagtgccgctgctggctctcggctgctattcccaggttaaccctctgacccttacagccgctgtgctgatgctcgtcgcccattacgctatcatcgggcccggactgcaggccaaggcgaccagagaggcccagaagcggaccgctgccggcattatgaaaaatcccacagtggacgggatcgttgctattgatctggaccctgtggtctatgacgccaagttcgaaaaacaactcggacagatcatgcttctgattctgtgtacgagccagatcctcctgatgcgcaccacatgggccctttgcgagtctatcaccctggcgacaggcccgctcaccacgctgtgggaaggctcccccgggaagttttggaacacaaccattgctgtgagcatggccaatatcttcagaggatcttacctggctggcgccgggctcgccttcagccttatgaaatccctgggaggcgggcggcgcggaaccggcgctcagggcgagacactgggggagaagtggaagagacaactcaaccagctgtctaaaagcgaatttaatacctataagcggtccggaattatggaggtggatagaagcgaagccaaagagggccttaagcgcggggaaacaacgaaacacgcggtttcccggggaaccgccaagctgagatggttcgtcgagcgcaacctcgtgaagcctgagggcaaagtgatcgacctggggtgtggacggggcggctggtcttactattgcgctgggctgaagaaagtcacagaagttaagggatacaccaaaggcgggcccggacatgaggaacctattcccatggccacatacggctggaatctcgtgaagcttcacagcgggaaagatgtgtttttcatgcctccggagaagtgtgacaccctgctgtgcgatatcggagaatcctctcccaaccctacgatcgaggagggcagaaccctccgcgtcctgaagatggtggaaccctggcttaaaggcaatcagttttgtattaagatcctgaacccttatatgcccagcgttgtggagacactcgaacagatgcaacggaaacatgggggaatgctggtcagaaatccgctgtcccgcaactctacccacgagatgtactgggtgagctgcggcacagggaatattgtttccgctgtgaacatgaccagccggatgctcctgaacagattcacaatggcccaccgcaagcctacctatgagcgggacgtcgatcttggagcgggcacgagacatgtggccgtggaacccgaggtcgctaatctggacatcattgggcagcgcatcgaaaacattaaaaatgagcacaagtctacatggcattacgatgaagacaacccctataagacctgggcctaccacggatcctatgaggttaaacctagcggctctgcttccagcatggtgaatggcgtggtcagactcctgaccaagccctgggatgtgatccctatggttacacagatcgccatgacggacaccacaccgtttgggcaacagcgggtgttcaaagagaaggtcgacacccgcacacccagagctaaacggggaaccacacagattatggaagtgaccgccaagtggctttggggctttctgtctagaaacaagaaacctcggatctgtacgcgcgaggaattcaccagaaaggttcggtccaatgcggccattggggctgtgtttgtcgatgagaaccagtggaatagcgccaaagaagctgtggaggacgagcgcttctgggatctcgttcacagagaacgggagctgcataagcaaggaaaatgcgccacatgcgtgtacaacatgatgggcaagcgcgaaaagaaactgggggagtttggcaaggccaaaggatccagagcgatctggtacatgtggctcggcgctcggttcctggaattcgaggcccttgggtttatgaatgaggaccactggttcagccgcgaaaactctctgagcggagtcgagggcgaagggctccataagctgggatatattcttagagatatctccaaaatccccggcgggaatatgtacgccgacgataccgctggctgggacacacggattaccgaggatgacctgcagaacgaggccaagatcacggatattatggaacctgagcacgctctcctggccacatctatctttaaactgacctatcagaataaggtggtccgcgtgcagagacccgcgaagaacggaacagttatggacgtgattagccggcgcgatcaaagaggctccgggcaggtcggaacctacggcctcaacacgttcaccaatatggaagtgcagctgatccggcagatggagtctgaagggatctttcttccgagcgagctggagacacctaacctcgccgaaagagtgctggactggcttgagaaacatggagctgaacgcctgaagcggatggccatttccggcgacgattgtgttgtgaaacccatcgacgatagattcgctaccgccctcacagcgctgaatgacatggggaaggtccgcaaagatattcctcaatgggagccctctaagggctggaacgactggcagcaggtgcctttttgcagccaccacttccatcagctgatcatgaaggatggacgggaaattgttgtgccctgtagaaatcaagacgagctcgtcggccgcgcccgggtgtcccagggggctggatggagcctgagagagaccgcctgccttggcaaatcttatgctcagatgtggcaactgatgtactttcaccgccgggatctcagactggccgctaacgccatctgttccgcggtcccggtggactgggttcctacaagccgcaccacgtggtctatccatgcccaccaccagtggatgacaaccgaagatatgctttccgtgtggaatcgggtctggattgaggaaaacccctggatggaggacaagacccatgtgagctcctgggaagaggttccctatctggggaaaagagaggaccagtggtgcggatctctcatcggcctgacagctcgggccacctgggccacaaatattcaggtggctatcaaccaagtcagacgcctgattgggaatgaaaactacctcgattacatgacgagcatgaagcggttcaaaaatgagtccgaccctgaaggcgccctgtggtga

SEQ ID NO: 18781 - RNA, 9879 nt, synthetic construct
  misc_feature 1..9879: note = derived and/or modified CDS sequence (opt5) from DENV-1__FJ639813__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcatgaaccctgccgttcttcgcaaactgtgcattgaagcgaagatctctaatacaaccacggactccagatgtccgacacaaggagaggccaccctcgtggaagagcaggatgctaacttcgtgtgccggcgcacctttgtcgacagaggctggggcaatgggtgtggactgttcggcaaagggagccttctgacatgcgccaagtttaagtgcgtgaccaaactcgagggaaagattgttcagtacgaaaacctgaaatattctgtgatcgtcacagtgcacacgggcgatcagcatcaagttgggaatgagaccacagaacacggaaccatcgctacaattaccccccaggcccctacgtccgagatccagctgaccgactacggcgccctcacactggactgtagcccccggaccggccttgatttcaacgaaatggtgctgctcacaatgaaggagaaatcttggctggtccataagcagtggtttcttgacctgcctctcccctggacctccggggctagcacgtcccaagagacatggaatcgccaggatctgctggtgaccttcaaaacagcgcacgccaagaagcaggaagtcgtggttctcggatctcaagagggcgctatgcacaccgccctgaccggggccacagaaattcagacgagcggaaccacaaccatctttgctggccatcttaaatgcagactgaagatggacaaactcacactgaaggggatgtcctatgtgatgtgtaccggcagcttcaaactggagaaggaagtcgccgagacgcagcacggaacagtgcttgttcaggtgaagtacgagggcaccgatgcgccgtgcaaaattcctttctctacccaagacgaaaagggggtcacacagaacggacggctcatcaccgctaatcccatcgtgacagataaagagaagcctgtgaacattgaaacggagcccccctttggcgagtcctatatcgttgtcggggccggagaaaaagccctgaagctgagctggttcaagaaaggctctagcattgggaagatgtttgaggctaccgccagaggcgctcgccggatggccatcctcggagacacagcgtgggatttcggctccattgggggagtgtttacctctgtgggcaaactggtccatcaggtgttcgggacagcctacggagttctttttagcggcgtgtcctggaccatgaagatcgggatcggcattctgctcacgtggctgggactgaatagcagatctacctccttcagcatgacatgtatcgctgtcggcatggtgaccctttacctcggggttatggtgcaggccgactctggatgcgtcattaactggaaaggccgcgaactgaagtgtgggtccggaatctttgtgacaaacgaggttcacacctggacagaacaatataagttccaggctgatagccctaaacggctgtccgccgcgattggcaaggcctgggaggagggggtgtgcggcatcagatctgctacccgcctcgaaaatattatgtggaaacagatcagcaacgagctgaatcatatccttctggaaaacgacatgaagtttacggtcgtggtgggagacgccaatggcattctcgctcaggggaaaaagatgatccggccgcaacccatggagcacaaatactcctggaagtcttggggaaaggccaaaattatcggcgccgatattcagaacacaaccttcatcatcgacgggcctgatacccccgaatgtcctgacggacagagagcttggaatatttgggaggtcgaggattatggctttggcatcttcacaaccaacatttggctgaagctgcgcgacagctacacgcagatgtgcgatcaccggcttatgtccgcggccatcaaagacagcaaggctgttcatgccgatatggggtattggattgaatctgagaaaaatgaaacatggaagctcgccagagcttccttcatcgaggtgaagacctgtacatggcccaaaagccacaccctgtggtctaacggagtgctggaatccgagatgatcattccgaagatctacggcgggcctattagccaacataattatcgccccggatactttacacagaccgccggcccttggcacctcgggaaactggagcttgacttcgatctgtgcgaaggaacgaccgtcgtggttgacgagcactgcggcaaccggggcccctctctcagaacaaccacagtgaccgggaagatcattcatgaatggtgttgccggagctgtacgctgcctcccctgcgctttagaggagaggatggctgctggtacgggatggagatccggccggtcaaagaaaaggaggaaaatcttgtgagatccatggttagcgcgggatctggcgaggtggactccttcagcctcgggatcctgtgtgtctccattatgatcgaagaggtgatgcgctctcggtggagcagaaagatgctgatgacaggaaccctcgctgtttttctgcttctgattatgggccagctcacatggaacgacctgatccgcctgtgcattatggtgggcgccaatgcctccgatagaatggggatgggaaccacctatcttgctctgatggccacattcaaaatgcggcctatgtttgcggtcggcctcctgttccgcagactcacgtctcgggaggtgctgcttctgaccatcgggctcagcctggtggcttccgtcgaactgcccaactctcttgaggaactgggagacggcctcgccatggggattatgatgctgaagctcctgacagagtttcaaccccaccagctttggaccacactgctcagcctgaccttcgttaaaacgacactgtcccttgattacgcctggaagaccaccgctatggtgctgagcatcgtgtctctctttcctctgtgtctctccacaaccagccagaaaacaacgtggctgccggtccttctgggatctttcggctgcaagcccctgaccatgtttctcatcacagaaaacaagatttggggccgcaaatcctggcctctgaatgaggggatcatggccattggaatcgtgagcattcttctgtcttccctcctgaagaacgacgttcccctcgctggccctctgatcgccgggggaatgcttatcgcgtgttatgtgattagcggctccagcgccgatctgtctctggagaaagctgccgaagtcagctgggagcaggaagctgagcattccggggcctctcacaatatcctcgtggaagttcaagacgatggaaccatgaagattaaagacgaggagagagatgacacactgaccatccttctgaaggccacgctcctggctgtgagcggcgtctaccccatgtccattcctgcgaccctcttcgtgtggtatttctggcagaaaaagaagcagcggtctggcgtcctgtgggatacacccagcccgcctgaagtggagcgcgccgttcttgacgatgggatctacagaatcctgcagcggggactgctcggccgctcccaagtgggggtcggagtgtttcaggacggcgttttccataccatgtggcacgtgacaagaggggctgtcctgatgtatcagggaaaacggcttgaaccctcttgggccagcgtgaagaaagacctgatttcctacggcggcgggtggagatttcagggaagctggaacaccggcgaggaggtgcaagttatcgccgtcgaacctgggaagaatcccaaaaacgtgcagacaacgccgggaaccttcaagacacctgagggcgaagtgggggctattgccctcgattttaagcccggaacctctggctcccctatcgtcaatcgcgagggcaaaattgtggggctgtacggaaacggcgttgtgaccacaagcgggacgtatgtctctgcgatcgctcaggccaaggcctcccaagaaggacccctccccgagattgaggacgaagtgttcaaaaagcggaatctgaccatcatggatcttcaccctggcagcgggaaaacaagacgctacctgccggctatcgttcgggaggccattaagagaaagctgcgcaccctcatcctggcgcccacacgggtggtcgcttccgaaatggccgaggcccttaaaggcatgcctattagatatcagaccacggctgtgaagtctgaacatacaggacgcgagatcgttgacctgatgtgccacgccacctttaccatgcggctcctgagccccgtgagagtccctaactacaatatgattatcatggatgaggctcatttcacagaccccgcctccatcgcggcccggggctatattagcacccgcgtggggatgggagaagctgccgctatctttatgacagccacccctccgggctctgtggaggccttcccccagtccaacgctgtcattcaggatgaagagagagacatccctgaacggagctggaattctgggtacgattggattacggactttcccggaaaaacagtttggttcgtgcctagcatcaagtccggcaacgatatcgcgaattgtctgcgcaaaaacgggaagagagtgattcaactctctcggaagaccttcgacacagagtatcagaaaaccaagaacaatgactgggattacgtcgtgacgaccgacatcagcgagatgggcgccaactttagagctgatcgcgttattgacccccggagatgccttaaaccggtgatcctgaaggatggacctgaacgcgtcattctggccggccccatgcccgtgacagttgcctccgctgcccagcggagagggcgcatcggacggaatcagaacaaagagggcgaccaatacgtgtatatggggcagcctctcaataacgatgaagaccacgcgcattggaccgaggctaagatgctgcttgataatattaacacacccgagggaatcatccctgccctgttcgaaccggagagagaaaagtctgccgctattgacggcgagtaccgcctcagaggggaagcccggaaaacctttgtcgagctgatgcgcagaggcgatctgcccgtgtggctcagctataaggtcgcgtccgagggattccagtacagcgaccggcgctggtgctttgatggcgaaagaaataaccaggtgcttgaggaaaatatggacgttgagatctggacaaaagaaggggagcggaagaaactgagacctcgctggctggacgcccggacctattctgatcccctcgctctgagagagttcaaggaatttgccgctggacgccggtccgtgagcggcgaccttattctggagatcgggaaactccctcaacacctgacgctgagagcccagaacgctctcgataatcttgtgatgctgcacaactccgaacagggaggcaaggcctaccggcatgcgatggaggaactgcccgacacaattgagaccctcatgctgcttgccctgatcgctgtcctcaccggcggggttacactgttctttctgtctggaaagggcctcgggaaaaccagcatcggacttctgtgtgtgacagcctcctctgctctgctctggatggccagcgtggagccgcactggattgccgcttccatcattctggaattctttcttatggtcctgctcatccctgagcccgatcgccagagaacgcctcaagacaatcagctggcgtatgtggttattggcctgctcttcatgatccttaccgtggccgctaacgaaatggggctgctggagacaaccaagaaagatctcggaatcggctacgtcgccgccgagaaccatcagcacgctacaatgctggacgtggatcttcggcccgccagcgcgtggaccctgtacgccgtcgctacgaccgtgattacacctatgatgcgccacaccatcgaaaatacaaccgccaacatttctctcacggctatcgccaatcaagcggccattctgatgggcctggacaaggggtggcccatctccaaaatggatattggagttccgctccttgctctgggctgctatagccaggtgaaccctctgacactcaccgccgctgtcctgatgcttgtggcccattacgctatcatcgggcccggactgcaggccaaggcgacaagagaggcccagaagcggaccgctgccggcattatgaaaaatcccaccgttgacgggatcgtggctattgatctcgaccctgtcgtgtatgacgccaagtttgaaaaacaactgggacagatcatgctgctcattctttgtacatctcagatcctgctgatgcgcacgacctgggccctctgcgagtccatcacactggcgaccggcccgcttacaaccctgtgggaaggcagccccgggaagttctggaacacgacaattgctgtgtctatggccaatatcttcagaggaagctacctcgctggcgccgggctggccttttccctgatgaaatctctcggaggcgggcggcgcggaaccggcgctcagggcgagacccttggggagaagtggaagagacaactgaaccagctgagcaaatccgaattcaatacatataagcggagcggaattatggaggttgatagatccgaagccaaagagggcctcaagcgcggggaaaccacaaaacacgcggtctctcggggaacggccaagctgagatggtttgtggagcgcaaccttgtgaagcctgagggcaaagtcatcgacctggggtgtggacggggcggctggagctactattgcgctgggctcaagaaagttaccgaagtgaagggatacacaaaaggcgggcccggacatgaggaacctatgcccatggccacctacggctggaatctggtgaagctgcactccgggaaagatgtcttctttatgcctccggagaagtgtgacacactcctttgcgatattggagaatctagccccaaccctaccatcgaggagggcagaacgctgcgcgtgctgaagatggttgaaccctggctcaaaggcaatcagttctgtatcaagattctgaacccttatatgccctccgtggtcgagacccttgaacagatgcaacggaaacatgggggaatgctggtgagaaatccgctctctcgcaacagcacacacgagatgtactgggtttcctgcggcaccgggaatatcgtgagcgctgtcaacatgacatctcggatgctgctgaacagatttaccatggcccaccgcaagcctacatatgagcgggacgtggatctcggagcgggcaccagacatgtggccgtcgaacccgaggttgctaatctggacattatcgggcagcgcattgaaaacatcaaaaatgagcacaagtccacgtggcattacgatgaagacaacccctataagacatgggcctaccacggaagctatgaggtgaaaccttctggctccgctagctctatggtgaatggcgtcgtgagacttctgaccaagccctgggatgttattcctatggtgacccagatcgccatgacagacacgaccccgttcgggcaacagcgggtctttaaagagaaggtggacacacgcacccccagagctaaacggggaacaacccagatcatggaagttacagccaagtggctctggggcttcctgtccagaaacaagaaacctcggatttgtacccgcgaggaatttacgagaaaggtgcggagcaattccgcgatcggggccgtcttcgtggatgagaaccagtggaatagcgctaaagaagccgttgaggacgagcgcttttgggatcttgtgcacagagaacgggagctgcataagcaaggaaaatgcgctacctgcgtctacaacatgatgggcaagcgcgaaaagaaactcggggagttcggcaaggccaaaggatctagagccatttggtacatgtggctgggcgcgcggttcctggaatttgaggctctcgggttcatgaatgaggaccactggtttagccgcgaaaactccctgtctggagtggagggcgaagggcttcataagctgggatatatcctcagagatattagcaaaatccccggcgggaatatgtacgccgacgatacagccggctgggacacccggatcacagaggatgacctgcagaacgaggctaagattaccgatatcatggaacctgagcacgcccttctggctacgtccattttcaaactcacatatcagaataaggtcgtgcgcgttcagagacccgccaagaacggaaccgtgatggacgtcatctctcggcgcgatcaaagaggcagcgggcaggtgggaacatacggcctgaacacctttacgaatatggaagtgcagctgattcggcagatggagtccgaagggatcttctctccgagcgagctcgagacccctaacctggcggaaagagttcttgactggctggagaaacatggagccgaacgcctcaagcggatggctatctccggcgacgattgtgtggtcaaacccattgacgatagatttgccacagctctgaccgcccttaatgacatggggaaggtgcgcaaagatatccctcaatgggagcccagcaagggctggaacgactggcagcaggttcctttctgctctcaccactttcatcagctgattatgaaggatggacgggaaatcgtggtcccctgtagaaatcaagacgagctcgtgggccgcgcgcgggtctcccagggggccggatggagcctgagagagacagcttgcctgggcaaatcttatgcccagatgtggcaactcatgtacttccaccgccgggatctgagacttgctgccaacgctatttgttccgccgtgccggttgactgggtgcctaccagccgcacaacctggtccatccatgcgcaccaccagtggatgacgacagaagatatgctgtctgtctggaatcgggtgtggatcgaggaaaacccctggatggaggacaagacccatgttagctcctgggaagaggtgccctatctcgggaaaagagaggaccagtggtgcggaagcctgattggccttaccgcccgggctacatgggccaccaatatccaggtcgccattaaccaagtgagacgcctgatcgggaatgaaaactacctcgattacatgacatctatgaagcggtttaaaaatgagtccgaccctgaaggcgctctgtggtga

SEQ ID NO: 18782 - RNA, 9879 nt, synthetic construct
  misc_feature 1..9879: note = derived and/or modified CDS sequence (opt5) from DENV-1__JN819412__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgctcctggagaaagctgccgaagtctcttgggagcaggaagctgagcatagcggggcctcccacaatatccttgtggaagttcaagacgatggaacaatgaagattaaagacgaggagagagatgacaccctgacgatcctcctgaaggccaccctcctggctgtgtctggcgtctaccccatgagcattcctgcgacactttttgtgtggtatttctggcagaaaaagaagcagcggtccggcgtcctgtgggataccccctctccgcctgaagtggagcgcgccgttctggacgatgggatctacagaatcctccagcggggactgcttggccgcagccaagtgggggtcggagtgttccaggacggcgtttttcatacaatgtggcacgtgaccagaggggctgtcctgatgtatcagggaaaacggctcgaaccctcctgggcctctgtgaagaaagacctgattagctacggcggcgggtggagattccagggatcctggaacacaggcgaggaggtgcaagttatcgccgtcgaacctgggaagaatcccaaaaacgtgcagacgaccccgggaacatttaagacccctgagggcgaagtgggggctattgccctcgatttcaagcccggaaccagcggctctcctatcgtcaatcgcgagggcaaaattgtggggctgtacggaaacggcgttgtgacaacgtccgggacctatgtcagcgcgatcgctcaggccaaggcctctcaagaaggaccccttcccgagattgaggacgaagtgtttaaaaagcggaatctgacaatcatggatctgcaccctggctccgggaaaaccagacgctacctcccggctatcgttcgggaggccattaagagaaagctgcgcacacttatcctggcgcccacccgggtggtcgctagcgaaatggccgaggccctcaaaggcatgcctattagatatcagacgacagctgtgaagtccgaacataccggacgcgagatcgttgacctgatgtgccacgccaccttcacaatgcggctgctctctcccgtgagagtccctaactacaatatgattatcatggatgaggctcattttaccgaccccgccagcatcgcggcccggggctatatttccacacgcgtggggatgggagaagctgccgctatcttcatgaccgccacgcctccgggcagcgtggaggcctttccccagtctaacgctgtcattcaggatgaagagagagacatccctgaacggtcctggaatagcgggtacgattggattacagacttccccggaaaaaccgtttggtttgtgccttctatcaagagcggcaacgatatcgcgaattgtcttcgcaaaaacgggaagagagtgattcaactgtcccggaagacattcgacaccgagtatcagaaaacgaagaacaatgactgggattacgtcgtgaccacagacatctctgagatgggcgccaacttcagagctgatcgcgttattgacccccggagatgcctgaaaccggtgatcctcaaggatggacctgaacgcgtcattctggccggccccatgcccgtgaccgttgccagcgctgcccagcggagagggcgcatcggacggaatcagaacaaagagggcgaccaatacgtgtatatggggcagcctcttaataacgatgaagaccacgcgcattggacagaggctaagatgctgctcgataatattaacacccccgagggaatcatccctgccctgtttgaaccggagagagaaaagtccgccgctattgacggcgagtaccgcctgagaggggaagcccggaaaacattcgtcgagctcatgcgcagaggcgatcttcccgtgtggctgtcttataaggtcgcgagcgagggatttcagtactccgaccggcgctggtgcttcgatggcgaaagaaataaccaggtgctggaggaaaatatggacgttgagatctggaccaaagaaggggagcggaagaaactcagacctcgctggctggacgcccggacgtatagcgatccccttgctctgagagagtttaaggaattcgccgctggacgccggtctgtgtccggcgacctcattctggagatcgggaaactgcctcaacacctcacacttagagcccagaacgctctggataatctggtgatgctccacaacagcgaacagggaggcaaggcctaccggcatgcgatggaggaactgcccgacaccattgagacccttatgctgctcgccctgatcgctgtcctgacaggcggggttaccctctttttcctttccggaaagggcctggggaaaacatctatcggactgctctgtgtgacggccagctccgctctgctttggatggcctctgtggagccgcactggattgccgctagcatcattctggaatttttcctcatggtcctgctgatccctgagcccgatcgccagagaacccctcaagacaatcagctcgcgtatgtggttattggccttctgtttatgatcctgacagtggccgctaacgaaatggggctcctggagaccacaaagaaagatcttggaatcggctacgtcgccgccgagaaccatcagcacgctaccatgctggacgtggatctccggcccgcctccgcgtggacgctgtacgccgtcgctaccacagtgattacccctatgatgcgccacacaatcgaaaataccacggccaacattagcctgacagctatcgccaatcaagcggccattctcatgggccttgacaaggggtggcccatctctaaaatggatattggagttccgctgctggctctcggctgctattcccaggtgaaccctctgacccttacagccgctgtcctgatgctcgtggcccattacgctatcatcgggcccggactgcaggccaaggcgaccagagaggcccagaagcggaccgctgccggcattatgaaaaatcccacagttgacgggatcgtggctattgatctggaccctgtcgtgtatgacgccaagttcgaaaaacaactcggacagatcatgcttctgattctgtgtacgagccagatcctcctgatgcgcaccacatgggccctttgcgagtctatcaccctggcgacaggcccgctcaccacgctgtgggaaggctcccccgggaagttttggaacacaaccattgctgtgagcatggccaatatcttcagaggatcttacctggctggcgccgggctcgccttcagccttatgaaatccctgggaggcgggcggcgcggaaccggcgctcagggcgagacactgggggagaagtggaagagacaactcaaccagctgtctaaaagcgaatttaatacctataagcggtccggaattatggaggttgatagaagcgaagccaaagagggccttaagcgcggggaaacaacgaaacacgcggtctcccggggaaccgccaagctgagatggttcgtggagcgcaacctcgtgaagcctgagggcaaagtcatcgacctggggtgtggacggggcggctggtcttactattgcgctgggctgaagaaagttacagaagtgaagggatacaccaaaggcgggcccggacatgaggaacctattcccatggccacatacggctggaatctcgtgaagcttcacagcgggaaagatgtctttttcatgcctccggagaagtgtgacaccctgctgtgcgatatcggagaatcctctcccaaccctacgatcgaggagggcagaaccctccgcgtgctgaagatggttgaaccctggcttaaaggcaatcagttttgtattaagatcctgaacccttatatgcccagcgtggtcgagacactcgaacagatgcaacggaaacatgggggaatgctggtgagaaatccgctgtcccgcaactctacccacgagatgtactgggttagctgcggcacagggaatattgtgtccgctgtcaacatgaccagccggatgctcctgaacagattcacaatggcccaccgcaagcctacctatgagcgggacgtggatcttggagcgggcacgagacatgtggccgtcgaacccgaggttgctaatctggacatcattgggcagcgcatcgaaaacattaaaaatgagcacaagtctacatggcattacgatgaagacaacccctataagacctgggcctaccacggatcctatgaggtgaaacctagcggctctgcttccagcatggtgaatggcgtcgtgagactcctgaccaagccctgggatgttatccctatggtgacacagatcgccatgacggacaccacaccgtttgggcaacagcgggtcttcaaagagaaggtggacacccgcacacccagagctaaacggggaaccacacagattatggaagttaccgccaagtggctttggggctttctgtctagaaacaagaaacctcggatctgtacgcgcgaggaattcaccagaaaggtgcggtccaatgcggccattggggctgtctttgtggatgagaaccagtggaatagcgccaaagaagctgttgaggacgagcgcttctgggatctcgtgcacagagaacgggagctgcataagcaaggaaaatgcgccacatgcgtctacaacatgatgggcaagcgcgaaaagaaactgggggagtttggcaaggccaaaggatccagagcgatctggtacatgtggctcggcgctcggttcctggaattcgaggcccttgggtttatgaatgaggaccactggttcagccgcgaaaactctctgagcggagtggagggcgaagggctccataagctgggatatattcttagagatatctccaaaatccccggcgggaatatgtacgccgacgataccgctggctgggacacacggattaccgaggatgacctgcagaacgaggccaagatcacggatattatggaacctgagcacgctctcctggccacatctatctttaaactgacctatcagaataaggtcgtgcgcgttcagagacccgcgaagaacggaacagtgatggacgtcattagccggcgcgatcaaagaggctccgggcaggtgggaacctacggcctcaacacgttcaccaatatggaagtgcagctgatccggcagatggagtctgaagggatctttcttccgagcgagctggagacacctaacctcgccgaaagagttctggactggcttgagaaacatggagctgaacgcctgaagcggatggccatttccggcgacgattgtgtggtcaaacccatcgacgatagattcgctaccgccctcacagcgctgaatgacatggggaaggtgcgcaaagatattcctcaatgggagccctctaagggctggaacgactggcagcaggttcctttttgcagccaccacttccatcagctgatcatgaaggatggacgggaaattgtggtcccctgtagaaatcaagacgagctcgtgggccgcgcccgggtctcccagggggctggatggagcctgagagagaccgcctgccttggcaaatcttatgctcagatgtggcaactgatgtactttcaccgccgggatctcagactggccgctaacgccatctgttccgcggtgccggttgactgggtgcctacaagccgcaccacgtggtctatccatgcccaccaccagtggatgacaaccgaagatatgctttccgtctggaatcgggtgtggattgaggaaaacccctggatggaggacaagacccatgttagctcctgggaagaggtgccctatctggggaaaagagaggaccagtggtgcggatctctcatcggcctgacagctcgggccacctgggccacaaatattcaggtcgctatcaaccaagtgagacgcctgattgggaatgaaaactacctcgattacatgacgagcatgaagcggttcaaaaatgagtccgaccctgaaggcgccctgtggtga

SEQ ID NO: 18783 - RNA, 9879 nt, synthetic construct
  misc_feature 1..9879: note = derived and/or modified CDS sequence (opt5) from DENV-1__FJ810415__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggagtcatctttattctcctgatgcttgtgacccctagcatggctatgagatgcgttggcatcgggaaccgggacttcgtggagggactgtccggcgccacatgggtcgatgtggtgctcgaacacgggagctgtgtcacgaccatggctaagaataaacccacactggacattgagctgctcaagaccgaagttacaaaccctgccgtgctgcgcaaactttgcatcgaggcgaagatttctaataccacgacagattccagatgtccgacccaaggagaagccaccctggtggaggagcaggacgctaactttgtctgccggcgcacattcgtggatagaggctggggcaatgggtgtggactctttggcaaagggagcctgcttacctgcgccaagttcaagtgcgttacaaaactggaaggaaagatcgtgcagtacgagaacctcaaatattctgtcattgtgacggttcacaccggcgaccagcatcaagtggggaatgaaacaaccgagcacggaacaatcgctaccatcacgccccaggcccctacctccgaaattcagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggctagcacatcccaagaaacctggaatcgccaggacctcctggtcacatttaaaaccgcgcacgccaagaagcaggaggtggttgtgctgggatctcaagaaggcgctatgcacaccgccctcacaggggccacggagatccagaccagcggaacaaccacaattttcgctggccatctgaaatgcagacttaagatggataaactgaccctcaaggggatgtcctatgtcatgtgtacgggcagcttcaaactggaaaaggaggtggccgagacacagcacggaaccgttctggtgcaggtcaagtacgaaggcaccgacgcgccgtgcaaaatccctttttctacacaagatgagaagggggtgacccagaacggacggcttattacagctaatcccatcgtgacggacaaagaaaagcctgttaacatcgagaccgagccccccttcggcgaatcctatattgtcgtgggggccggagagaaagccctcaagctgaattggtttaagagaggcagctctatcgggaaaatgttcgaagctacagcccgcggcgctcggagaatggccattctgggagataccgcgtgggactttggcagcatcgggggagtgttcacatccgtcggcaagctcgtgcatcaggtttttgggaccgcctacggagtgctgttctctggcgtcagctggacgatgaaaattgggatcggcatccttctgacctggctcggactgaactcccgcagcacatctctgtccatgacctgtattgctgtgggcatggttacactttacctcggggtgatggtccaggccgatagcggatgcgtgatcaactggaagggccgggagctgaaatgtgggtctggaatttttgttaccaatgaagtgcacacatggaccgagcaatataagttccaggctgactcccctaagagactgagcgccgcgatcggcaaagcctgggaggaaggggtctgcggcattcgctccgctacgcggctcgagaacatcatgtggaagcagatttctaatgaactgaaccatatccttctggagaatgatatgaaatttacagtggtggtcggagacgccaacggcatcctcgctcaggggaagaaaatgattagaccgcaacccatggaacacaagtacagctggaaatcctggggaaaggccaagatcattggcgccgacatccagaataccaccttcattatcgatgggcctgacacacccgagtgtcctgatggacagcgcgcttggaacatctgggaggttgaagactatggctttggcgtgttcaccacgaatatttggctgaaactgcgggattcttacacacagatgtgcgaccacagacttatgagcgcggccatcaaggattccaaagctgtgcatgccgacatggggtattggattgagagcgaaaagaacgagacctggaaactcgcccgcgcttctttcatcgaagtcaagacatgtacctggcccaagtcccacacactgtggagcaatggagtgctggagtctgagatgattatcccgaaaatctacggcgggcctatttcccaacataactatcggcccggatactttacccagacggccggcccttggcacctcgggaagctggaacttgatttcgacctgtgcgagggaaccacagttgtggtcgatgaacactgcggcaatagaggccccagcctccggaccacaaccgtgacggggaaaatcattcatgagtggtgttgccgctcttgtacactgcctcccctgagatttcggggagaggacggctgctggtacgggatggaaatcagaccggttaaggagaaagaagagaaccttgtgcgcagcatggtctccgcgggaagcggcgaagtggattctttctccctcgggattctgtgtgttagcatcatgatcgaggaggtgatgcggtccagatggtctcgcaagatgctgatgaccggaacactcgctgtctttctgcttctgattatgggccagctcacctggaatgacctgatcagactgtgcattatggtgggcgccaacgccagcgaccggatggggatgggaaccacatatcttgctctgatggccacgttcaagatgcgccctatgtttgcggtgggcctcctgttcagacggctcacctcccgcgaagtcctgcttctgacaatcgggctctctctggttgctagcgtggagctgcccaactcccttgaagagctgggagatggcctcgccatggggattatgatgctgaaactcctgaccgaatttcaaccccaccagctttggacaaccctgctctctctgacgttcgtgaagacaaccctgagccttgactacgcctggaaaaccacagctatggtcctgtccatcgtgagcctctttcctctgtgtctctctaccacatcccagaagacgacctggctgccggttcttctgggaagcttcggctgcaaacccctgacaatgtttctcattaccgagaataagatctggggcagaaagtcttggcctctgaacgaggggatcatggccattggaatcgtgtccattcttctgagctctctcctgaaaaatgatgtccccctcgctggccctctgatcgccgggggaatgcttattgcgtgttatgtgatctccggcagctccgccgacctgagcctggaaaaggctgccgaggtttcttgggaacaggaggctgaacatagcggggcctcccacaacatcctcgtggaggtccaagatgacggaacaatgaaaattaaggatgaggaacgggacgataccctgacgatccttctgaaagccaccctcctggctgtgtctggcgtctaccccatgagcattcctgcgacactcttcgtgtggtatttctggcagaagaaaaagcagcgctccggcgttctgtgggacaccccctctccgcctgaggtggaaagagccgtccttgatgacgggatctaccggattctgcagcgcggactgctcggcagaagccaagtgggggttggagtgtttcaggatggcgtcttccatacaatgtggcacgtgacccggggggctgtgctgatgtatcagggaaagagacttgagccctcctgggcctctgttaaaaaggacctgatcagctacggcggcgggtggcgctttcagggatcctggaatacaggcgaggaagtccaagtgatcgccgtggagcctgggaaaaaccccaagaatgtccagacgaccccgggaacattcaaaacccctgaaggcgaggtgggggctattgccctcgactttaagcccggaaccagcggctctcctatcgttaaccgggaaggcaagattgtggggctgtacggaaatggcgtcgtgacaacgtccgggacctatgttagcgcgatcgctcaggccaaagcctctcaagagggacccctccccgagattgaagatgaggtgttcaagaaaagaaacctgacaatcatggaccttcaccctggctccgggaagacccgccggtacctgccggctattgtcagagaagccatcaaacgcaagctgcggacactcatcctggcgcccaccagagtggttgctagcgagatggccgaagcccttaagggcatgcctattcgctatcagacgacagctgtgaaatccgagcataccggacgggagatcgtcgatctgatgtgccacgccacctttacaatgagactcctgtctcccgtgcgggtgcctaattacaacatgattatcatggacgaagctcatttcaccgatcccgccagcattgcggcccgcggctatatctccacaagagtcgggatgggagaggctgccgctatctttatgaccgccacgcctccgggcagcgttgaagccttcccccagtctaatgctgtgattcaggacgaggaacgggatatccctgagcgctcctggaacagcgggtacgactggattacagattttcccggaaagaccgtgtggttcgtcccttctatcaaaagcggcaatgacattgcgaactgtctgagaaagaacgggaaacgggtgatccaactctccagaaagacattcgataccgagtatcagaagacgaaaaataacgactgggactacgttgtgaccacagatatctctgaaatgggcgccaattttcgcgctgaccgggtcattgatcccagacgctgccttaagccggtgatcctgaaagacggacctgagcgggttattctggccggccccatgcccgtgaccgtcgccagcgctgcccagagacgcgggcggatcggaagaaaccagaataaggaaggcgatcaatacgtgtatatggggcagcctctcaacaatgacgaggatcacgcgcattggacagaggctaaaatgctgcttgacaacattaatacccccgaaggaatcattcctgccctgttcgagccggaacgcgagaagtccgccgctatcgatggcgaatacagactccggggggaggcccgcaagacatttgtcgagctgatgagacggggcgacctgcccgtgtggctctcttataaagttgcgagcgaaggattccagtactccgatcgcagatggtgctttgacggcgagcggaacaatcaggtgcttgaagagaacatggatgtggaaatctggaccaaggagggggagagaaaaaagctgcgccctcggtggctggacgccagaacgtatagcgaccccctcgctctgcgcgaattcaaagagtttgccgctggacggagatctgtctccggcgatcttattctggaaatcgggaagctccctcaacacctgacactgcgggcccagaatgctctcgacaaccttgttatgctgcacaatagcgagcagggaggcaaagcctaccgccatgcgatggaagagctgcccgataccattgagaccctcatgctgcttgccctgatcgctgtgctcacaggcggggtgaccctgttctttctgtccggaaagggcctcgggaagacatctattggacttctgtgtgtcacggccagctccgctctgctctggatggcctctgtggaaccgcactggatcgccgctagcatcattctggagttctttcttatggttctgctcatccctgaacccgacagacagcggacccctcaagataaccagctggcgtatgtggtcattggcctgctcttcatgatccttacagtggccgctaacgagatggggctgctggagaccacaaaaaaggacctcggaattggctacgtcgccgccgaaaatcatcagcacgctaccatgctggatgtggaccttcaccccgcctccgcgtggacgctgtacgccgttgctaccacagtgatcacccctatgatgcgccatacaatcgagaacaccacggccaatattagcctcacagctatcgccaaccaagcggccattctgatgggcctggataaagggtggcccatctctaagatggacattggagtcccgctccttgctctgggctgctattcccaggtgaatcctctgaccctcacagccgctgttctgatgcttgtggcccactacgctatcattgggcccggactgcaggccaaagcgaccagagaagcccagaagcggaccgctgccggcatcatgaagaaccccacagtcgatgggatcgtggctattgacctcgatcctgtggtttatgacgccaaatttgagaagcaactgggacagatcatgctgctcattctttgtacgagccagatcctgctgatgcgcaccacatgggccctctgcgaatctattaccctggcgacaggcccgcttaccacgctgtgggagggctcccccgggaaattctggaatacaaccatcgctgtcagcatggccaacatcttcagaggatcttacctcgctggcgccgggctggcctttagcctgatgaagtccctcggaggcgggcggcgcggaaccggcgctcagggcgagacacttggggaaaaatggaagagacaactgaatcagctgtctaagagcgagttcaacacctataaacggtccggaattatggaagtggacagaagcgaggccaaggaaggcctcaaacgcggggagacaacgaagcatgcggtgtcccggggaaccgccaaactgagatggtttgtcgagcgcaatcttgttaagcctgaaggcaaggtgatcgatctggggtgtggacggggcggctggtcttactattgcgctgggctcaaaaaggtgacagaggtcaaaggatacaccaagggcgggcccggacacgaagagcctattcccatggccacatacggctggaacctggtgaaactgcatagcgggaaggacgttttctttatgcctccggaaaaatgtgataccctcctttgcgacatcggagagtcctctcccaatcctacgattgaggaaggcagaaccctgcgcgtgctgaagatggtcgagccctggctccggggcaaccagttctgtatcaagatcctgaatccttatatgcccagcgtggttgaaacacttgagcagatgcaaagaaaacacgggggaatgctggtgcgcaacccgctctcccggaattctacccacgagatgtactgggtcagctgcggcacagggaacattgtgtccgctgtgaacatgaccagcagaatgctgctgaatcgctttacaatggcccatcggaagcctacctatgaaagagatgtcgacctcggagcgggcacgcgccacgttgccgtggagcccgaagtggctaacctggatatcattgggcagagaatcgagaatattaaaaacgaacataagtctacatggcactacgacgaggataatccctataaaacctgggcctaccacggatcctatgaggtcaagcctagcggctctgcttccagcatggtgaacggcgttgtgcggcttctgaccaagccctgggacgtcatccctatggtgacacagattgccatgacggataccacaccgttcgggcaacagcgcgtttttaaagaaaaggtggacaccagaacaccccgggctaaaagaggaaccacacagatcatggaggtcaccgccaagtggctctggggcttcctgtctcggaataaaaagcctcgcatctgtacgagagaagagtttacccggaaggtgcgctccaacgcggccattggggctgttttcgtggacgaaaatcagtggaacagcgccaaagaggctgtcgaggatgaaagattttgggaccttgtgcatcgggagcgcgaactgcacaagcaaggaaaatgcgccacatgcgtctacaatatgatgggcaagagagagaaaaagctcggggaattcggcaaggccaaaggatcccgggcgatctggtacatgtggctgggcgctcgcttcctggagtttgaggccctcgggttcatgaacgaagatcattggtttagcagagagaattctctgagcggagtggaaggcgaggggcttcacaagctgggatatattctccgggacatctccaaaattcccggcgggaacatgtacgccgatgacaccgctggctgggatacacgcatcaccgaggacgatctgcagaatgaagccaagatcacggacattatggagcctgaacatgctcttctggccacatctatcttcaaactcacctatcagaacaaggttgtgagagtccagcggcccgcgaaaaacggaacagtgatggatgtgattagccgcagagaccaacggggctccgggcaggttggaacctacggcctgaatacgtttaccaacatggaggtgcagctgatcagacagatggaatctgaggggattttcctcccgagcgagctggaaacacctaatcttgccgagcgcgctctggattggctcgaaaagcacggagccgagcggctgaagagaatggctatctccggcgacgactgtgtcgtgaaacccatcgatgaccgctttgccaccgcgcttacagccctgaacgatatggggaaggttcggaaagacattcctcaatgggaaccctctaagggctggaatgattggcagcaggtgcctttctgcagccaccattttcaccagctcatcatgaaagacggaagagagattgtcgtgccctgtcgcaaccaagatgagctggtcggccgggctagagtgtcccagggggccggatggagcctgcgcgaaaccgcttgcctcggcaagtcttatgcccagatgtggcaactgatgtacttccatcggagagaccttcgcctggctgccaatgcgatctgttccgccgttccggtggattgggtccctacaagccggaccacgtggtctattcacgctcaccatcagtggatgacaaccgaggacatgctctccgtgtggaacagagtttggatcgaagagaatccctggatggaagataagacccacgtgagctcctgggaggaggtcccctatctggggaaacgggaagaccagtggtgcggatctcttatcggcctgacagccagagccacctgggctacaaacattcaggtggccatcaatcaagtgcgccggctcattgggaacgagaattacctggactacatgacgagcatgaagagatttaaaaacgaatccgatcctgagggcgcgctgtggtga

SEQ ID NO: 18784 - RNA, 9879 nt, synthetic construct
  misc_feature 1..9879: note = derived and/or modified CDS sequence (opt5) from DENV-1__FJ639814__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcaacctgtgcgagggaaccacagtggttgtggacgaacactgcggcaatagaggcccctctctccggaccacaaccgtcacggggaaaattatccatgagtggtgttgccgcagctgtacactgcctcccctgagatttcggggagaggatggctgctggtacgggatggaaattagaccggtgaaggagaaagaagagaaccttgttcgctccatggtgagcgcgggatctggcgaagtcgactccttcagcctcgggatcctgtgtgtgtccatcatgattgaggaggttatgcggtctagatggagccgcaagatgctgatgaccggaacactcgctgtgtttctgcttctgatcatgggccagctcacctggaatgatctgattagactgtgcatcatggtcggcgccaacgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagagctgggagacggcctcgccatggggatcatgatgctgaaactcctgaccgaatttcaaccccaccagctttggacaaccctgctcagcctgacgttcgtgaagacaaccctgtcccttgattacgcctggaaaaccacagctatggtgctgagcattgtctctctctttcctctgtgtctctccaccacaagccagaagacgacctggctgccggtgcttctgggatctttcggctgcaaacccctgacaatgtttctcatcaccgagaataagatctggggcagaaagtcctggcctctgaacgaggggattatggccatcggaattgttagcatccttctgtcttccctcctgaaaaatgacgtgcccctcgctggccctctgattgccgggggaatgcttatcgcgtgttatgtcatcagcggctccagcgccgatctgtctctggaaaaggctgccgaggtgagctgggaacaggaggctgaacattccggggcctctcacaacattctcgttgaggtgcaagacgatggaacaatgaaaatcaaggacgaggaacgggatgacaccctgacgattcttctgaaagccaccctcctggctgtcagcggcgtgtaccccatgtccatccctgcgacactcttcgtctggtatttctggcagaagaaaaagcagcgctctggcgtgctgtgggatacccccagcccgcctgaggttgaaagagccgtgcttgacgatgggatttaccggatcctgcagcgcggactgctcggcagatcccaagtcggggtgggagtttttcaggacggcgtgttccatacaatgtggcacgtcacccggggggctgtgctgatgtatcagggaaagagacttgagccctcttgggccagcgtgaaaaaggatctgatctcctacggcggcgggtggcgctttcagggaagctggaatacaggcgaggaagttcaagtcattgccgtggagcctgggaaaaaccccaagaatgtgcagacgaccccgggaacattcaaaacccctgaaggcgaggtcggggctatcgccctcgactttaagcccggaacctctggctcccctattgtgaaccgggaaggcaagatcgttgggctgtacggaaatggcgtggtcacaacgagcgggacctatgtgtctgcgattgctcaggccaaagcctcccaagagggacccctccccgagatcgaagacgaggttttcaagaaaagaaacctgacaattatggatcttcaccctggcagcgggaagacccgccggtacctgccggctatcgtgagagaagccatcaaacgcaagctgcggacactcattctggcgcccaccagagtcgtggcttccgagatggccgaagcccttaagggcatgcctatccgctatcagacgacagctgttaaatctgagcataccggacgggagattgtggacctgatgtgccacgccacctttacaatgagactcctgagccccgtccgggtgcctaattacaacatgatcattatggatgaagctcatttcaccgaccccgcctccatcgcggcccgcggctatatcagcacaagagtggggatgggagaggctgccgctatttttatgaccgccacgcctccgggctctgtcgaagccttcccccagtccaatgctgttatccaggatgaggaacgggacattcctgagcgcagctggaactctgggtacgattggatcacagactttcccggaaagaccgtgtggttcgtgcctagcattaaatccggcaatgatatcgcgaactgtctgagaaagaacgggaaacgggtcatccaactctctagaaagacattcgacaccgagtatcagaagacgaaaaataacgattgggactacgtggttaccacagacattagcgaaatgggcgccaattttcgcgctgatcgggtgatcgaccccagacgctgccttaagccggtcattctgaaagatggacctgagcgggtgatcctggccggccccatgcccgttaccgtggcctccgctgcccagagacgcgggcggattggaagaaaccagaataaggaaggcgaccaatacgtctatatggggcagcctctcaacaatgatgaggaccacgcgcattggacagaggctaaaatgctgcttgataacatcaatacccccgaaggaattatccctgccctgttcgagccggaacgcgagaagtctgccgctatcgacggcgaatacagactccggggggaggcccgcaagacatttgtggagctgatgagacggggcgatctgcccgtctggctcagctataaagtggcgtccgaaggattccagtacagcgaccgcagatggtgctttgatggcgagcggaacaatcaggttcttgaagagaacatggacgtggaaatttggaccaaggagggggagagaaaaaagctgcgccctcggtggctggatgccagaacgtattctgaccccctcgctctgcgcgaattcaaagagtttgccgctggacggagatccgtgagcggcgaccttatcctggaaattgggaagctccctcaacacctgacactgcgggcccagaatgctctcgataaccttgtcatgctgcacaattccgagcagggaggcaaagcctaccgccatgcgatggaagagctgcccgacaccatcgagaccctcatgctgcttgccctgattgctgttctcacaggcggggtgaccctgttctttctgtctggaaagggcctcgggaagacaagcatcggacttctgtgtgtgacggcctcctctgctctgctctggatggccagcgtcgaaccgcactggatcgccgcttccattatcctggagttctttcttatggtgctgctcattcctgaacccgatagacagcggacccctcaagacaaccagctggcgtatgttgtgatcggcctgctcttcatgattcttacagtcgccgctaacgagatggggctgctggagaccacaaaaaaggatctcggaatcggctacgtggccgccgaaaatcatcagcacgctaccatgctggacgtcgatcttcaccccgccagcgcgtggacgctgtacgccgtggctaccacagttatcacccctatgatgcgccatacaattgagaacaccacggccaatatctctctcacagctattgccaaccaagcggccatcctgatgggcctggacaaagggtggcccatttccaagatggatatcggagtgccgctccttgctctgggctgctatagccaggtcaatcctctgaccctcacagccgctgtgctgatgcttgttgcccactacgctattatcgggcccggactgcaggccaaagcgaccagagaagcccagaagcggaccgctgccggcatcatgaagaaccccacagtggacgggattgtcgctatcgatctcgaccctgtggtgtatgatgccaaatttgagaagcaactgggacagattatgctgctcatcctttgtacgtctcagattctgctgatgcgcaccacatgggccctctgcgaatccatcaccctggcgacaggcccgcttaccacgctgtgggagggcagccccgggaaattctggaatacaaccatcgctgtttctatggccaacattttcagaggaagctacctcgctggcgccgggctggccttttccctgatgaagtctctcggaggcgggcggcgcggaaccggcgctcagggcgagacacttggggaaaaatggaagagacaactgaatcagctgagcaagtccgagttcaacacctataaacggagcggaatcatggaagtcgacagatccgaggccaaggaaggcctcaaacgcggggagacaacgaagcatgcggtgtctcggggaaccgccaaactgagatggtttgtggagcgcaatcttgtcaagcctgaaggcaaggttattgacctggggtgtggacggggcggctggagctactattgcgctgggctcaaaaaggtgacagaggtgaaaggatacaccaagggcgggcccggacacgaagagcctatccccatggccacatacggctggaacctggtcaaactgcattccgggaaggatgtgttctttatgcctccggaaaaatgtgacaccctcctttgcgatattggagagtctagccccaatcctacgatcgaggaaggcagaaccctgcgcgttctgaagatggtggagccctggctccggggcaaccagttctgtatcaagattctgaatccttatatgccctccgtcgtggaaacacttgagcagatgcaaagaaaacacgggggaatgctggttcgcaacccgctctctcggaatagcacccacgagatgtactgggtgtcctgcggcacagggaacatcgtcagcgctgtgaacatgacctctagaatgctgctgaatcgctttacaatggcccatcggaagcctacctatgaaagagacgtggatctcggagcgggcacgcgccacgtcgccgttgagcccgaagtggctaacctggacattatcgggcagagaattgagaatatcaaaaacgaacataagtccacatggcactacgatgaggacaatccctataaaacctgggcctaccacggaagctatgaggtgaagccttctggctccgctagctctatggtcaacggcgtggttcggcttctgaccaagccctgggatgtgattcctatggtcacacagatcgccatgacggacaccacaccgttcgggcaacagcgcgtgtttaaagaaaaggttgataccagaacaccccgggctaaaagaggaaccacacagatcatggaggtgaccgccaagtggctctggggcttcctgtcccggaataaaaagcctcgcatttgtacgagagaagagtttacccggaaggtccgcagcaacgcggccatcggggctgtgttcgttgacgaaaatcagtggaactccgccaaagaggctgtggaggacgaaagattttgggatcttgtccatcgggagcgcgaactgcacaagcaaggaaaatgcgccacatgcgtgtacaatatgatgggcaagagagagaaaaagctcggggaattcggcaaggccaaaggaagccgggcgatttggtacatgtggctgggcgctcgcttcctggagtttgaggccctcgggttcatgaacgaagaccattggttttctagagagaatagcctgtccggagtcgaaggcgaggggcttcacaagctgggatatatcctccgggatatttctaaaatccccggcgggaacatgtacgccgacgataccgctggctgggacacacgcatcaccgaggatgacctgcagaatgaagccaagattacggatatcatggagcctgaacatgctcttctggccacaagcattttcaaactcacctatcagaacaaggtggttagagtgcagcggcccgcgaaaaacggaacagtcatggacgtgatctcccgcagagatcaacggggctctgggcaggtgggaacctacggcctgaatacgtttaccaacatggaggttcagctgattagacagatggaaagcgaggggatcttcctcccgtccgagctggaaacacctaatcttgccgagcgcgctctggactggctcgaaaagcacggagccgagcggctgaagagaatggctatctctggcgatgactgtgtggtcaaacccattgacgatcgctttgccaccgcgcttacagccctgaacgacatggggaaggtgcggaaagatatccctcaatgggaacccagcaagggctggaatgactggcagcaggttcctttctgctcccaccattttcaccagctcattatgaaagatggaagagagatcgtggtcccctgtcgcaaccaagacgagctggtgggccgggctagagtcagccagggggccggatggtctctgcgcgaaaccgcttgcctcggcaagtcctatgcccagatgtggcaactgatgtacttccatcggagagatcttcgcctggctgccaatgcgatttgtagcgccgtgccggttgactgggtgcctacatctcggaccacgtggtccatccacgctcaccatcagtggatgacaaccgaggatatgctcagcgtctggaacagagtgtggatcgaagagaatccctggatggaagacaagacccacgtttcctcttgggaggaggtgccctatctggggaaacgggaagatcagtggtgcggaagccttattggcctgacagccagagccacctgggctacaaacatccaggtcgccattaatcaagtgcgccggctcatcgggaacgagaattacctggactacatgacgtccatgaagagatttaaaaacgaaagcgaccctgagggcgcgctgtggtga

SEQ ID NO: 18785 - RNA, 9879 nt, synthetic construct
  misc_feature 1..9879: note = derived and/or modified CDS sequence (opt5) from DENV-1__FJ639815__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcgacctgtgcgagggaaccacagtggttgtggatgaacactgcggcaacagaggcccctctctccggaccacaaccgtcacggggaaaattatccatgagtggtgttgccgcagctgtacactgcctcccctgagatttcggggagaggacggctgctggtacgggatggaaattagaccggtgaaggagaaagaagagaatcttgttcgctccatggtgagcgcgggatctggcgaagtcgattccttcagcctcgggatcctgtgtgtgtccatcatgattgaggaggttatgcggtctagatggagccgcaagatgctgatgaccggaacactcgctgtgtttctgcttctgatcatgggccagctcacctggaacgacctgattagactgtgcatcatggtcggcgccaatgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagagctgggagatggcctcgccatggggatcatgatgctgaaactcctgaccgaatttcaaccccaccagctttggacaaccctgctcagcctgacgttcgtgaagacaaccctgtcccttgactacgcctggaaaaccacagctatgctgctcagcattgtgtctctgtttcctctctgtctgtccaccacaagccagaagacgacctggcttccggtcctgctgggatctttcggctgcaaacccctcacaatgtttctgatcaccgagaacaagatctggggcagaaagtcctggcctcttaatgaggggattatggccatcggaattgtgagcatcctgctctcttccctgctcaaaaacgatgttcccctggctggccctcttattgccgggggaatgctgatcgcgtgttatgtgatcagcggctccagcgccgacctgtctctcgaaaaggctgccgaggtcagctgggaacaggaggctgaacattccggggcctctcacaatattctggtggaggttcaagatgacggaacaatgaaaatcaaggatgaggaacgggacgatacccttacgattctgctcaaagccaccctgctcgctgtgagcggcgtctaccccatgtccatccctgcgacactgttcgtgtggtatttctggcagaagaaaaagcagcgctctggcgtcctttgggacacccccagcccgcctgaggtggaaagagccgttctggatgacgggatttaccggatcctgcagcgcggactcctgggcagatcccaagtgggggtcggagtgtttcaggatggcgttttccatacaatgtggcacgtgacccggggggctgtccttatgtatcagggaaagagactggagccctcttgggccagcgtgaaaaaggacctcatctcctacggcggcgggtggcgctttcagggaagctggaacacaggcgaggaagtgcaagttattgccgtcgagcctgggaaaaatcccaagaacgtgcagacgaccccgggaacattcaaaacccctgaaggcgaggtgggggctatcgccctggactttaagcccggaacctctggctcccctattgtcaatcgggaaggcaagatcgtggggctctacggaaacggcgttgtgacaacgagcgggacctatgtctctgcgattgctcaggccaaagcctcccaagagggacccctgcccgagatcgaagatgaggtgttcaagaaaagaaatcttacaattatggacctgcaccctggcagcgggaagacccgccggtacctgccggctatcgttagagaagccatcaaacgcaagctccggacactgattcttgcgcccaccagagtggtcgcttccgagatggccgaagccctgaagggcatgcctatccgctatcagacgacagctgtgaaatctgagcataccggacgggagattgttgatctcatgtgccacgccacctttacaatgagactgctgagccccgtgcgggtccctaactacaatatgatcattatggacgaagctcatttcaccgatcccgcctccatcgcggcccgcggctatatcagcacaagagtggggatgggagaggctgccgctatttttatgaccgccacgcctccgggctctgtggaagccttcccccagtccaacgctgtcatccaggacgaggaacgggatattcctgagcgcagctggaattctgggtacgactggatcacagattttcccggaaagaccgtttggttcgtgcctagcattaaatccggcaacgacatcgcgaattgtctcagaaagaacgggaaacgggtgatccaactttctagaaagacattcgataccgagtatcagaagacgaaaaacaatgactgggactacgtcgtgaccacagatattagcgaaatgggcgccaactttcgcgctgaccgggttatcgatcccagacgctgcctgaagccggtgattctgaaagacggacctgagcgggtcatcctcgccggccccatgcccgtgaccgttgcctccgctgcccagagacgcgggcggattggaagaaatcagaacaaggaaggcgatcaatacgtgtatatggggcagcctctgaataacgacgaggatcacgcgcattggacagaggctaaaatgcttctggacaatatcaacacccccgaaggaattatccctgccctcttcgagccggaacgcgagaagtctgccgctatcgatggcgaatacagactgcggggggaggcccgcaagacatttgtcgagctgatgagacggggcgacctccccgtgtggcttagctataaagtcgcgtccgaaggattccagtacagcgatcgcagatggtgctttgacggcgagcggaataaccaggtgctggaagagaatatggatgttgaaatttggaccaaggagggggagagaaaaaagctgcgccctcggtggctcgacgccagaacgtattctgaccccctggctcttcgcgaattcaaagagtttgccgctggacggagatccgtgagcggcgatctgatcctcgaaattgggaagctgcctcaacacctgacactccgggcccagaacgctcttgacaatctggtgatgctgcacaactccgagcagggaggcaaagcctaccgccatgcgatggaagagctccccgataccatcgagaccctgatgcttctggccctcattgctgtcctgacaggcggggttaccctgttctttctctctggaaagggccttgggaagacaagcatcggactgctgtgtgtgacggcctcctctgctctcctgtggatggccagcgtggaaccgcactggatcgccgcttccattatccttgagttctttctgatggtcctcctgattcctgaacccgacagacagcggacccctcaagataatcagctggcgtatgtggttatcggcctccttttcatgattctgacagtggccgctaacgagatggggctgctcgagaccacaaaaaaggacctgggaatcggctacgtcgccgccgaaaaccatcagcacgctaccatgcttgatgtggacctgcaccccgccagcgcgtggacgctctacgccgtcgctaccacagtgatcacccctatgatgcgccatacaattgagaataccacggccaacatctctctgacagctattgccaatcaagcggccatcctgatgggcctcgataaagggtggcccatttccaagatggacatcggagttccgcttctggctctgggctgctatagccaggtgaaccctctcaccctgacagccgctgtccttatgctggtggcccactacgctattatcgggcccggactccaggccaaagcgaccagagaagcccagaagcggaccgctgccggcatcatgaagaatcccacagttgatgggattgtggctatcgacctggatcctgtcgtgtatgacgccaaatttgagaagcaactgggacagattatgctccttatcctgtgtacgtctcagattctgctcatgcgcaccacatgggccctgtgcgaatccatcacccttgcgacaggcccgctgaccacgctctgggagggcagccccgggaaattctggaacacaaccatcgctgtgtctatggccaatattttcagaggaagctacctggctggcgccgggctggccttttccctcatgaagtctcttggaggcgggcggcgcggaaccggcgctcagggcgagacactgggggaaaaatggaagagacaactgaaccagctcagcaagtccgagttcaatacctataaacggagcggaatcatggaagttgacagatccgaggccaaggaaggcctgaaacgcggggagacaacgaagcatgcggtctctcggggaaccgccaaacttagatggtttgtggagcgcaacctggtgaagcctgaaggcaaggtcattgatctcgggtgtggacggggcggctggagctactattgcgctgggctgaaaaaggttacagaggtgaaaggatacaccaagggcgggcccggacacgaagagcctatccccatggccacatacggctggaatctggtgaaactccattccgggaaggacgtcttctttatgcctccggaaaaatgtgatacccttctgtgcgacattggagagtctagccccaaccctacgatcgaggaaggcagaaccctgcgcgtgctcaagatggttgagccctggctgcggggcaatcagttctgtatcaagattcttaacccttatatgccctccgtggtcgaaacactggagcagatgcaaagaaaacacgggggaatgctcgtgcgcaatccgctgtctcggaacagcacccacgagatgtactgggtttcctgcggcacagggaatatcgtgagcgctgtcaacatgacctctagaatgctgctcaaccgctttacaatggcccatcggaagcctacctatgaaagagatgtggacctgggagcgggcacgcgccacgtggccgtcgagcccgaagttgctaatcttgatattatcgggcagagaattgagaacatcaaaaatgaacataagtccacatggcactacgacgaggataacccctataaaacctgggcctaccacggaagctatgaggtgaagccttctggctccgctagctctatggtgaatggcgtcgtgcggctgctcaccaagccctgggacgttattcctatggtgacacagatcgccatgacggataccacaccgttcgggcaacagcgcgtctttaaagaaaaggtggacaccagaacaccccgggctaaaagaggaaccacacagatcatggaggttaccgccaagtggctgtggggcttcctttcccggaacaaaaagcctcgcatttgtacgagagaagagtttacccggaaggtgcgcagcaatgcggccatcggggctgtcttcgtggacgaaaaccagtggaattccgccaaagaggctgttgaggatgaaagattttgggacctggtgcatcgggagcgcgaactccacaagcaaggaaaatgcgccacatgcgtctacaacatgatgggcaagagagagaaaaagctgggggaattcggcaaggccaaaggaagccgggcgatttggtacatgtggctgggcgctcgcttcctcgagtttgaggccctggggttcatgaatgaagatcattggttttctagagagaacagcctttccggagtggaaggcgaggggctgcacaagctcggatatatcctgcgggacatttctaaaatccccggcgggaatatgtacgccgatgacaccgctggctgggatacacgcatcaccgaggacgatcttcagaacgaagccaagattacggacatcatggagcctgaacatgctctgctcgccacaagcattttcaaactgacctatcagaataaggtcgtgagagttcagcggcccgcgaaaaacggaacagtgatggatgtcatctcccgcagagaccaacggggctctgggcaggtgggaacctacggcctgaacacgtttaccaatatggaggtgcagctcattagacagatggaaagcgaggggatcttcctgccgtccgagcttgaaacacctaacctggccgagcgcgctctcgattggctggaaaagcacggagccgagcggcttaagagaatggctatctctggcgacgactgtgttgtgaaacccattgatgaccgctttgccaccgcgctgacagccctcaatgatatggggaaggtccggaaagacatccctcaatgggaacccagcaagggctggaacgattggcagcaggtgcctttctgctcccaccattttcaccagctgattatgaaagacggaagagagatcgttgtgccctgtcgcaatcaagatgagctggtcggccgggctagagtgagccagggggccggatggtctctccgcgaaaccgcttgcctgggcaagtcctatgcccagatgtggcaacttatgtacttccatcggagagacctgcgcctcgctgccaacgcgatttgtagcgccgtcccggtggattgggttcctacatctcggaccacgtggtccatccacgctcaccatcagtggatgacaaccgaggacatgctgagcgtgtggaatagagtctggatcgaagagaacccctggatggaagataagacccacgtgtcctcttgggaggaggttccctatcttgggaaacgggaagaccagtggtgcggaagcctgattggcctcacagccagagccacctgggctacaaatatccaggtggccattaaccaagtccgccggctgatcgggaatgagaactacctggactacatgacgtccatgaagagatttaaaaatgaaagcgatcctgagggcgcgctctggtga

SEQ ID NO: 18786 - RNA, 9879 nt, synthetic construct
  misc_feature 1..9879: note = derived and/or modified CDS sequence (opt5) from DENV-1__FJ639818__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaataccacggatacctgggtgacatatggaacctgttcccaaacaggcgagcacagacgggacaagcgctctgtcgccctggcccctcatgtggggctcggactggagaccagaacggaaacatggatgagctccgagggcgcttggaaacagattcagcgggttgaaacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggaaccgggattttgttgagggactctccggcgctacgtgggtggacgtcgtgctggagcacgggagctgtgtgaccacaatggccaagaataaacccaccctggatatcgaactcctgaagacagaggtcaccaaccctgctgttcttcgcaaactgtgcattgaagccaagatctctaatacgacaaccgactccagatgtccgacccaaggagaggcgacactcgtggaagagcaggatgccaacttcgtgtgccggcgcacctttgtcgacagaggctggggcaatgggtgtggactgttcggcaaagggagccttctgacatgcgctaagtttaagtgcgtgacgaaactcgagggaaagattgttcagtacgaaaacctgaaatattctgtgatcgtcaccgtgcacacaggcgatcagcatcaagttgggaatgagaccacagaacacggaaccatcgccacgattaccccccaggctcctacatccgagatccagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggccagcacctcccaagagacatggaatcgccaggatctgctggtgaccttcaaaaccgctcacgcgaagaagcaggaagtcgtggttctcggatctcaagagggcgccatgcacacagctctgacgggggccaccgaaattcagacaagcggaaccacaaccatctttgccggccatcttaaatgcagactgaagatggagaaactcacgctgaaggggatgtcctatgtgatgtgtacaggcagcttcaaactggaaaaggaggtcgctgagacccagcacggaaccgtgcttgttcaggtgaagtacgaaggcacagacgccccgtgcaaaattcctttctctacccaagatgagaagggggtcacacagaacggacggctcatcacggcgaatcccatcgtgaccgacaaagaaaagcctgtgaacattgagacagagcccccctttggcgaatcctatatcgttgtcggggctggagagaaagccctgaagctgagctggttcaagaaaggctctagcattgggaagatgtttgaagccaccgctagaggcgcccgccggatggctatcctcggagatacagcctgggacttcggctccattgggggagtgtttacctctgtgggcaaactggtccatcaggtgttcgggacggcgtacggagttctttttagcggcgtgtcctggaccatgaagatcgggatcggcattctgctcacatggctgggactgaatagcagatctacctcccttagcatgacatgtatcgccgtcggcatggtgaccctctacctgggggttatggtgcaggctgattctggatgcgtcattaactggaaaggccgcgagctgaagtgtgggtccggaatcttcgtgacaaacgaagttcacacctggacggagcaatataagtttcaggccgacagccctaaacggctctccgctgccattggcaaggcgtgggaggaaggggtgtgcggcatcagatctgccacacgcctggagaatattatgtggaaacagatcagcaacgaacttaatcatatcctgctcgagaacgatatgaagttcaccgtcgtggtgggagacgctaatggcattctggcccaggggaaaaagatgatccggccgcaacccatggaacacaaatactcctggaagtcttggggaaaggctaaaattatcggcgccgacattcagaacaccacatttatcatcgatgggcctgacacccccgagtgtcctgatggacagagagcctggaatatttgggaggtcgaagactatggcttcggcatctttacgacaaacatttggctgaagcttcgcgatagctacacccagatgtgcgaccaccggctcatgtccgctgcgatcaaagatagcaaggccgttcatgctgacatggggtattggattgagtctgaaaaaaatgagacatggaagctggccagagcctccttcatcgaagtgaagacctgtacatggcccaaaagccacaccctgtggtctaacggagtgctcgagtccgagatgatcattccgaagatctacggcgggcctattagccaacataattatcgccccggatacttcacgcagaccgctggcccttggcacctggggaaacttgaactggattttgacctctgcgagggaacaaccgtcgtggttgatgaacactgcggcaaccggggcccctctctgagaacaaccacggtgacagggaagatcattcatgagtggtgttgccggagctgtaccctgcctccccttcgcttcagaggagaggacggctgctggtacgggatggaaatccggccggtcaaagagaaggaagagaatctcgtgagatccatggttagcgccggatctggcgaagtggattcctttagcctggggatcctgtgtgtctccattatgatcgaggaggtgatgcgctctcggtggagcagaaagatgctcatgacaggaaccctggcggttttccttctgctcattatgggccagctgacctggaacgacctgatccgcctttgcattatggtgggcgctaatgcctccgacagaatggggatgggaacaacgcacctggccctcatggctacctttaaaatgcggcctatgttcgccgtcggcctgctctttcgcagactgacatctcgggaagtgcttctgctcaccatcgggctgagcctggtggcgtccgtcgagcttcccaactctctggaagagctcggagatggcctggctatggggattatgatgctcaagctgcttacagaattccaaccccatcagctgtggaccacgctcctgagcctgacatttgttaaaaccaccctttccctggactatgcctggaagacaaccgccatggtgctcagcatcgtgtctctgttccctctctgtctgtccacaacgagccagaaaaccacatggcttccggtcctgctgggatcttttggctgcaagcccctcaccatgttcctgatcacagagaacaagatttggggccgcaaatcctggcctcttaatgaggggatcatggctattggaatcgtgagcattctgctctcttccctgctcaagaacgatgttcccctggccggccctcttatcgctgggggaatgctgatcgcctgttacgtgattagcggctccagcgcggacctgtctctcgaaaaagccgctgaggtcagctgggaacaggaggccgaacactccggggcttctcataatatcctggtggaggttcaagatgacggaaccatgaagattaaagatgaggaaagagacgatacgcttaccatcctgctcaaggccacactgctcgccgtgagcggcgtctatcccatgtccattcctgctaccctgtttgtgtggtacttctggcagaaaaagaagcagcggtctggcgtcctttgggacacacccagcccgcctgaggtggaacgcgcggttctggatgacgggatctatagaatcctgcagcggggactcctgggccgctcccaagtgggggtcggagtgttccaggatggcgtttttcacaccatgtggcacgtgacaagaggggccgtccttatgtaccagggaaaacggctggagccctcttgggctagcgtgaagaaagacctcatttcctatggcggcgggtggagattccagggaagctggaacacgggcgaggaagtgcaagttatcgccgtcgagcctgggaagaatcccaaaaacgtgcagaccacaccgggaacctttaagacccctgaaggcgaggtgggggccattgctctggacttcaagcccggaacatctggctcccctatcgtcaatcgcgaaggcaaaattgtggggctctacggaaacggcgttgtgacgaccagcgggacatacgtctctgccatcgcgcaggctaaggcctcccaagagggacccctgcccgagattgaagatgaggtgtttaaaaagcggaatcttaccatcatggacctgcatcctggcagcgggaaaacaagacgctatctgccggccatcgttcgggaagctattaagagaaagctccgcaccctgatccttgcccccacgcgggtggtcgcgtccgagatggctgaagccctgaaaggcatgcctattagataccagacaaccgccgtgaagtctgagcacaccggacgcgagatcgttgatctcatgtgccatgctacattcaccatgcggctgctgagccccgtgagagtccctaactataatatgattatcatggacgaagcccactttacagatcccgcttccatcgccgcgcggggctacattagcacccgcgtggggatgggagaggccgctgccatcttcatgacggctacacctccgggctctgtggaagcctttccccagtccaacgccgtcattcaggacgaggaaagagatatccctgagcggagctggaattctgggtatgactggattaccgatttccccggaaaaacagtttggtttgtgcctagcatcaagtccggcaacgacatcgctaattgtctccgcaaaaacgggaagagagtgattcaactttctcggaagaccttcgatacggagtaccagaaaaccaagaacaatgactgggactatgtcgtgacaaccgatatcagcgaaatgggcgcgaacttcagagccgaccgcgttattgatccccggagatgcctgaaaccggtgatcctgaaggacggacctgagcgcgtcattctcgctggccccatgcccgtgacagttgcctccgccgctcagcggagagggcgcatcggacggaatcagaacaaagaaggcgatcaatacgtgtacatggggcagcctctgaataacgacgaggatcatgcccactggaccgaggcgaagatgcttctggacaatattaacacacccgaaggaatcatccctgctctctttgagccggaaagagagaagtctgccgccattgatggcgaatatcgcctgagaggggaggctcggaaaaccttcgtcgagctgatgcgcagaggcgacctccccgtgtggcttagctacaaggtcgcctccgaaggatttcagtatagcgatcggcgctggtgcttcgacggcgagagaaataaccaggtgctggaagagaatatggatgttgaaatctggacgaaagagggggagcggaagaaactgagacctcgctggctcgacgcgcggacatactctgaccccctggcccttagagaatttaaggagttcgctgccggacgccggtccgtgagcggcgatctgattctcgaaatcgggaaactgcctcaacacctgaccctcagagctcagaacgcccttgacaatctggtgatgctgcataactccgagcagggaggcaaggcttatcggcacgccatggaagagctccccgataccattgagacactgatgcttctggcgctcatcgccgtcctgaccggcggggttacactgtttttcctctctggaaagggccttgggaaaacgagcatcggactgctgtgtgtgaccgcttcctctgccctcctgtggatggctagcgtggaaccgcattggattgccgcctccatcattcttgagtttttcctgatggtcctcctgatccctgaacccgaccgccagagaacacctcaagataatcagctggcttacgtggttattggcctcctttttatgatcctgaccgtggcggccaacgagatggggctgctcgagacaaccaagaaagacctgggaatcggctatgtcgctgccgaaaaccaccagcacgccacgatgcttgatgtggacctgcggcccgctagcgcctggaccctctacgcggtcgccacaaccgtgattacacctatgatgcgccataccatcgagaatacgacagctaacatttctctgaccgccatcgctaatcaagccgcgattctgatgggcctcgataaggggtggcccatctccaaaatggacattggagttccgcttctggccctgggctgctacagccaggtgaaccctctcacactgaccgctgccgtccttatgctggtggctcactatgccatcatcgggcccggactccaggctaaggccaccagagaagcgcagaagcggacagccgctggcattatgaaaaatcccacggttgatgggatcgtggccattgacctggatcctgtcgtgtacgacgctaagttcgagaaacaactgggacagatcatgctccttattctgtgtacctctcagatcctgctcatgcgcacaacctgggccctgtgcgaatccatcacacttgccaccggcccgctgacgacactctgggagggcagccccgggaagttttggaacaccaccattgcggtgtctatggctaatatcttcagaggaagctatctggccggcgctgggctggccttctccctcatgaaatctcttggaggcgggcggcgcggaacaggcgcccagggcgagaccctgggggaaaagtggaagagacaactgaaccagctcagcaaatccgagtttaatacatacaagcggagcggaattatggaagttgacagatccgaggctaaagaaggcctgaagcgcggggagacgaccaaacatgccgtctctcggggaacagcgaagcttagatggttcgtggagcgcaacctggtgaagcctgaaggcaaagtcatcgatctcgggtgtggacggggcggctggagctattactgcgccgggctgaagaaagttaccgaggtgaagggatatacaaaaggcgggcccggacacgaagagcctattcccatggctacctacggctggaatctggtgaagctccattccgggaaagacgtctttttcatgcctccggaaaagtgtgatacgcttctgtgcgacatcggagagtctagccccaaccctaccatcgaggaaggcagaacactgcgcgtgctcaagatggttgagccctggctgaaaggcaatcagttttgtattaagatccttaacccttacatgccctccgtggtcgaaaccctggagcagatgcaacggaaacacgggggaatgctcgtgagaaatccgctgtctcgcaacagcacacacgagatgtattgggtttcctgcggcaccgggaatattgtgagcgccgtcaacatgacatctcggatgctgctcaacagattcaccatggctcatcgcaagcctacgtacgaacgggatgtggacctgggagccggcacaagacacgtggcggtcgagcccgaagttgccaatcttgatatcattgggcagcgcatcgagaacattaaaaatgaacataagtccacctggcactatgacgaggataacccctacaagacctgggcttatcacggaagctacgaggtgaaaccttctggctccgccagctctatggtgaatggcgtcgtgagactgctcacaaagccctgggacgttatccctatggtgacgcagatcgctatgaccgatacaaccccgtttgggcaacagcgggtcttcaaagaaaaggtggacacacgcacccccagagccaaacggggaacaacccagattatggaggttacggctaagtggctgtggggctttctttccagaaacaagaaacctcggatctgtacccgcgaagagttcacaagaaaggtgcggagcaatgccgcgattggggccgtctttgtggacgaaaaccagtggaattccgctaaagaggccgttgaggatgaacgcttctgggacctggtgcatagagagcgggaactccacaagcaaggaaaatgcgctacctgcgtctataacatgatgggcaagcgcgagaagaaactgggggaatttggcaaggccaaaggaagcagagccatctggtacatgtggctgggcgcgcggttcctcgagttcgaggctctggggtttatgaatgaagatcattggttctctcgcgagaacagcctttccggagtggaaggcgaggggctgcacaagctcggatacattctgagagacatctctaaaatccccggcgggaatatgtatgccgatgacacagccggctgggatacccggattacggaggacgatcttcagaacgaagctaagatcacagacattatggagcctgaacatgccctgctcgctaccagcatctttaaactgacataccagaataaggtcgtgcgcgttcagagacccgccaagaacggaaccgtgatggatgtcatttcccggcgcgaccaaagaggctctgggcaggtgggaacgtatggcctgaacaccttcacaaatatggaggtgcagctcatccggcagatggaaagcgaggggatctttctgccgtccgagcttgaaacccctaacctggcggagagagttctcgattggctggaaaaacacggagccgagcgccttaagcggatggctatttctggcgacgactgtgtggtcaaacccatcgatgacagattcgccacagctctgaccgccctcaatgatatggggaaggtgcgcaaagacattcctcaatgggaacccagcaagggctggaacgattggcagcaggttcctttttgctcccaccatttccaccagctgatcatgaaggacggacgggagattgtggtcccctgtagaaatcaagatgagctggtgggccgcgcgcgggtcagccagggggccggatggtctctcagagaaacagcttgcctgggcaaatcctacgcccagatgtggcaacttatgtattttcatcgccgggacctgagactcgctgccaacgctatctgtagcgccgtgccggttgattgggtgcctacctctcgcacgacatggtccatccacgcgcaccatcagtggatgaccaccgaggacatgctgagcgtctggaatcgggtgtggattgaagagaacccctggatggaagataagacacacgtttcctcttgggaggaggtgccctaccttgggaaaagagaagaccagtggtgcggaagcctgatcggcctcaccgcccgggctacatgggccacgaatattcaggtcgccatcaaccaagtgagacgcctgattgggaatgagaactatctggactacatgacctccatgaagcggttcaaaaatgaaagcgatcctgagggcgctctctggtga

SEQ ID NO: 18787 - RNA, 9879 nt, synthetic construct
  misc_feature 1..9879: note = derived and/or modified CDS sequence (opt5) from DENV-1__FJ639819__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcatcttcaccacgaacatttggctgaaactgcgggatagctacacacagatgtgcgaccacagacttatgtccgcggccatcaaggatagcaaagctgttcatgccgacatggggtattggattgagtctgaaaagaatgagacctggaaactcgcccgcgcttccttcatcgaagtgaagacatgtacctggcccaagagccacacactgtggtctaacggagtgctggagtccgagatgatcattccgaaaatctacggcgggcctattagccaacataattatcggcccggatactttacccagacggccggcccttggcacctcgggaagctggaacttgatttcgacctgtgcgagggaaccacagtcgtggttgatgaacactgcggcaacagaggcccctctctccggaccacaaccgtgacggggaaaatcattcatgagtggtgttgccgcagctgtacactgcctcccctgagatttcggggagaggacggctgctggtacgggatggaaatcagaccggtcaaggagaaagaagagaatcttgtgcgctccatggttagcgcgggatctggcgaagtggataacttctccctcgggatcctgtgtgtcagcattatgatcgaggaggtgatgcggtccagatggtctcgcaagatgctgatgaccggaacactcgctgtttttctgcttctgattatgggccagctcacctggaatgacctgatcagactgtgcattatggtgggcgccaacgccagcgaccggatggggatgggaaccacatatcttgctctgatggccacgttcaagatgcgccctatgtttgcggtcggcctcctgttcagacggctcacctcccgcgaagtgctgcttctgacaatcgggctctctctggtggctagcgtcgagctgcccaactcccttgaagagctgggagatggcctcgccatggggattatgatgctgaaactcctgaccgaatttcaaccccaccagctttggacaaccctgctctctctgacgttcgttaagacaaccctgagccttgactacgcctggaaaaccacagctatggtgctgtccatcgtgagcctctttcctctgtgtctctctaccacatcccagaagacgacctggctgccggtccttctgggaagcttcggctgcaaacccctgacaatgtttctcatcaccgagaataagatttggggcagaaagtcttggcctctgaacgaggggatcatggccattggaatcgtgtccattcttctgagctctctcctgaaaaatgatgttcccctcgctggccctctgatcgccgggggaatgcttatcgcgtgttatgtgatttccggcagctccgccgacctgagcctggaaaaggctgccgaggtctcttgggaacaggaggctgaacatagcggggcctcccacaacatcctcgtggaggttcaagatgacggaacaatgaaaattaaggatgaggaacgggacgataccctgacgatccttctgaaagccaccctcctggctgtgtctggcgtctaccccatgagcattcctgcgacactcttcgtgtggtatttctggcagaagaaaaagcagcgctccggcgtcctgtgggacaccccctctccgcctgaggtggaaagagccgttcttgatgacgggatctaccggatcctgcagcgcggactgctcggcagaagccaagtgggggtcggagtgtttcaggatggcgttttccatacaatgtggcacgtgacccggggggctgtcctgatgtatcagggaaagagacttgagccctcctgggcctgcgtgaaaaaggacctgatttcttacggcggcgggtggcgctttcagggactctggaatacaggcgaggaagtgcaagttatcgccgtcgagcctgggaaaaaccccaagaatgtgcagacgaccccgggaacattcaaaacccctgaaggcgaggtgggggctattgccctggactttaagcccggaaccagcggctcccctatcgtcaaccgggaaggcaagattgtggggctctacggaaatggcgttgtgacaacgagcgggacctatgtctctgcgatcgctcaggccaaagcctcccaagagggacccctgcccgagattgaagatgaggtgttcaagaaaagaaaccttacaatcatggacctgcaccctggcagcgggaagacccgccggtacctgccggctatcgttagagaagccattaaacgcaagctccggacactgatccttgcgcccaccagagtggtcgcttctgagatggccgaagccctgaagggcatgcctattcgctatcagacgacagctgtgaaatccgagcataccggacgggagatcgttgatctcatgtgtcacgccacctttacaatgagactgctgagccccgtgcgggtccctaattacaacatgattatcatggacgaagctcatttcaccgatcccgcctccatcgcggcccgcggctatatttctacaagagtggggatgggagaggctgccgctatctttatgaccgccacgcctccgggcagcgtggaagccttcccccagtccaatgctgtcattcaggacgaggaacgggatatccctgagcgcagctggaactctgggtacgactggattacagattttcccggaaagaccgtttggttcgtgccttccatcaaaagcggcaatgacatcgcgaactgcctcagaaagaacgggaaacgggtgattcaactttctagaaagacattcgataccgagtatcagaagacgaaaaataacgactgggactacgtcgtgaccacagatatcagcgaaatgggcgccaattttcgcgctgaccgggttattgatcccagacgctgcctgaagccggtgatcctgaaagacggacctgagcgggtcattctcgccggccccatgcccgtgaccgttgcctccgctgcccagagacgcgggcggatcggaagaaaccagaataaggaaggcgatcaatacgtgtatatggggcagcctctgaacaatgacgaggatcacgcgcattggacagaggctaaaatgcttctggacaacattaatacccccgaaggaatcatccctgccctcttcgagccggaacgcgagaagtctgccgctattgatggcgaatacagactgcggggggaggcccgcaagacatttgtcgagctgatgagacggggcgacctccccgtgtggcttagctataaagtcgcgtccgaaggattccagtactctgatcgcagatggtgttttgacggcgagcggaacaatcaggtgctggaagagaacatggatgttgaaatctggaccaaggagggggagagaaaaaagctgcgccctcggtggctcgacgccagaacgtatagcgaccccctggctcttcgcgaattcaaagagtttgccgctggacggagatccgtgagcggcgatctgattctcgaaatcgggaagctgcctcaacacctgacactccgggcccagaatgctcttgacaacctggtgatgctgcacaattctgagcagggaggcaaagcctaccgccatgcgatggaagagctccccgataccattgagaccctgatgcttctggccctcatcgctgtcctgacaggcggggttaccctgttctttctctccggaaagggccttgggaagacaagcatcggactgctgtgcgtgacggcctcctctgctctcctgtggatggccagcgtggaaccgcactggattgccgcttccatcattcttgagttctttctgatggtcctcctgatccctgaacccgacagacagcggacccctcaagataaccagctggcgtatgtggttattggcctccttttcatgatcctgacagtggccgctaacgagatggggctgctcgagaccacaaaaaaggacctgggaatcggctacgtcgccgccgaaaatcatcagcacgctaccatgcttgatgtggacctgcaccccgcctctgcgtggacgctctacgccgtcgctaccacagtgattacccctatgatgcgccatacaatcgagaacaccacggccaatattagcctgacagctatcgccaaccaagcggccattctgatgggcctcgataaagggtggcccatctccaagatggacattggagttccgcttctggctctgggctgttatagccaggtgaatcctctcaccctgacagccgctgtccttatgctggtggcccactacgctatcatcgggcccggactccaggccaaagcgaccagagaagcccagaagcggaccgctgccggcattatgaagaaccccacagttgatgggatcgtggctattgacctggatcctgtcgtgtatgacgccaaatttgagaagcaactgggacagatcatgctccttattctgtgcacgtctcagatcctgctcatgcgcaccacatgggccctgtgtgaatccatcacccttgcgacaggcccgctgaccacgctctgggagggcagccccgggaaattctggaatacaaccattgctgtgtctatggccaacatcttcagaggatcctacctggctggcgccgggctggcctttagcctcatgaagtctcttggaggcgggcggcgcggaaccggcgctcagggcgagacactgggggaaaaatggaagagacaactgaatcagctcagcaagtccgagttcaacacctataaacggtctggaattatggaagttgacagaagcgaggccaaggaaggcctgaaacgcggggagacaacgaagcatgcggtctcccggggaaccgccaaacttagatggtttgtggagcgcaatctggtgaagcctgaaggcaaggtcatcgatctcgggtgcggacggggcggctggagctactattgtgctgggctgaaaaaggttacagaggtgaaaggatacaccaagggcgggcccggacacgaagagcctattcccatggccacatacggctggaacctggtgaaactccattccgggaaggacgtcttctttatgcctccggaaaaatgcgatacccttctgtgtgacatcggagagtctagccccaatcctacgatcgaggaaggcagaaccctgcgcgtgctcaagatggttgagccctggctgcggggcaaccagttctgcattaagatccttaatccttatatgccctccgtggtcgaaacactggagcagatgcaaagaaaacacgggggaatgctcgtgcgcaacccgctgtctcggaatagcacccacgagatgtactgggtttcctgtggcacagggaacattgtgtctgctgtcaacatgaccagcagaatgctgctcaatcgctttacaatggcccatcggaagcctacctatgaaagagatgtggacctgggagcgggcacgcgccacgtggccgtcgagcccgaagttgctaaccttgatatcattgggcagagaatcgagaatattaaaaacgaacataagtccacatggcactacgacgaggataatccctataaaacctgggcctaccacggaagctatgaggtgaagccttctggctccgctagctctatggtgaacggcgtcgtgcggctgctcaccaagccctgggacgttatccctatggtgacacagatcgccatgacggataccacaccgttcgggcaacagcgcgtctttaaagaaaaggtggacaccagaacaccccgggctaaaagaggaaccacacagattatggaggttaccgccaagtggctgtggggcttcctttcccggaataaaaagcctcgcatctgcacgagagaagagtttacccggaaggtgcgcagcaacgcggccattggggctgtcttcgtggacgaaaatcagtggaactctgccaaagaggctgttgaggatgaaagattttgggacctggtgcatcgggagcgcgaactccacaagcaaggaaaatgcgccacatgtgtctacaatatgatgggcaagagagagaaaaagctgggggaattcggcaaggccaaaggatcccgggcgatctggtacatgtggctgggcgctcgcttcctcgagtttgaggccctggggttcatgaacgaagatcattggtttagcagagagaattcccttagcggagtggaaggcgaggggctgcacaagctcggatatattctgcgggacatctctaaaatccccggcgggaacatgtacgccgatgacaccgctggctgggatacacgcattaccgaggacgatcttcagaatgaagccaagatcacggacattatggagcctgaacatgctctgctcgccacaagcatcttcaaactgacctatcagaacaaggtcgtgagagttcagcggcccgcgaaaaacggaacagtgatggatgtcatttcccgcagagaccaacggggctctgggcaggtgggaacctacggcctgaatacgtttaccaacatggaggtgcagctcatcagacagatggaaagcgaggggatcttcctgccgtccgagcttgaaacacctaatctggccgagcgcgttctcgattggctggaaaagcacggagctgagcggcttaagagaatggccatttctggcgacgactgcgtggtcaaacccatcgatgaccgctttgctaccgccctgacagcgctcaacgatatggggaaggtgcggaaagacattcctcaatgggaacccagcaagggctggaatgattggcagcaggttcctttctgttcccaccattttcaccagctgatcatgaaagacggaagagagattgtggtcccctgccgcaaccaagatgagctggtgggccgggccagagtctctcagggggctggatggagcctccgcgaaaccgcctgtctgggcaagtcctatgctcagatgtggcaacttatgtacttccatcggagagacctgcgcctcgccgctaatgccatctgcagcgcggtgccggttgattgggtgcctacatctcggaccacgtggtccatccacgcccaccatcagtggatgacaaccgaggacatgctgagcgtctggaacagagtgtggattgaagagaatccctggatggaagataagacccacgtttcttcctgggaggaggtgccctatcttgggaaacgggaagaccagtggtgtggaagcctgatcggcctcacagctagagccacctgggccacaaacattcaggtcgctatcaatcaagtgcgccggctgattgggaacgagaattacctggactacatgacgtccatgaagagatttaaaaacgaatctgatcctgagggcgccctctggtga

SEQ ID NO: 18788 - RNA, 9879 nt, synthetic construct
  misc_feature 1..9879: note = derived and/or modified CDS sequence (opt5) from DENV-1__FJ639820__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatacgtgtatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacacctgacactcagagcccagaacgctcttgataatctggccatgctgcacaactccgaacagggaggcaaggcgtaccggcatgccatggaggaactccccgacaccattgagaccctgatgcttctggctctcatcgccgtgctgacaggcggggtcaccctgtttttcctctctggaaagggccttgggaaaacaagcatcggactgctgtgtgttacggcttcctctgccctcctgtggatggccagcgtggagccgcactggattgctgcgtccatcattcttgaatttttcctgatggtgctcctgatccctgagcccgatcgccagagaacccctcaagacaatcagctggcctatgtcgtgattggcctcctttttatgatcctgacagttgctgccaacgaaatggggctgctcgagaccacaaagaaagatctgggaatcggctacgtggccgctgagaaccatcagcacgccaccatgcttgacgtcgatctgcggcccgcgagcgcctggacgctctacgctgtggccaccacagtcattacccctatgatgcgccacacaatcgaaaataccacggctaacatttctctgacagccatcgcgaatcaagccgctattctgatgggcctcgacaaggggtggcccatctccaaaatggatattggagtgccgcttctggccctgggctgctatagccaggttaaccctctcaccctgacagctgccgtgcttatgctggtcgctcattacgccatcatcgggcccggactccaggcgaaggccaccagagaggctcagaagcggaccgccgctggcattatgaaaaatcccacagtggacgggatcgttgccattgatctggaccctgtggtctatgacgccaagttcgaaaaacaactgggacagatcatgctccttattctgtgtacgtctcagatcctgctcatgcgcaccacatgggcgctgtgcgagtccatcacccttgctacaggcccgctgaccacgctctgggaaggcagccccgggaagttttggaacacaaccattgccgtgtctatggctaatatcttcagaggaagctacctggccggcgccgggctggctttctccctcatgaaatctcttggaggcgggcggcgcggaaccggcgcccagggcgagacactgggggagaagtggaagagacaactgaaccagctcagcaaatccgaatttaatacctataagcggagcggaattatggaggtggatagatccgaagcgaaagagggcctgaagcgcggggaaacaacgaaacacgccgtttctcggggaaccgctaagcttagatggttcgtcgagcgcaacctggtgaagcctgagggcaaagtgatcgacctcgggtgtggacggggcggctggagctactattgcgccgggctgaagaaagtcacagaagttaagggatacaccaaaggcgggcccggacatgaggaacctattcccatggctacatacggctggaatctggtgaagctccactccgggaaagatgtgtttttcatgcctccggagaagtgtgacacccttctgtgcgatatcggagaatctagccccaaccctacgatcgaggagggcagaaccctgcgcgtcctcaagatggtggaaccctggctgaaaggcaatcagttttgtattaagatccttaacccttatatgccctccgttgtggagacactggaacagatgcaacggaaacatgggggaatgctcgtcagaaatccgctgtctcgcaacagcacccacgagatgtactgggtgtcctgcggcacagggaatattgttagcgccgtgaacatgacctctcggatgctgctcaacagattcacaatggcgcaccgcaagcctacctatgagcgggacgtcgatctgggagccggcacgagacatgtggctgtggaacccgaggtcgccaatcttgacatcattgggcagcgcatcgaaaacattaaaaatgagcacaagtccacatggcattacgatgaagacaacccctataagacctgggcttaccacggaagctatgaggttaaaccttctggctccgccagctctatggtgaatggcgtggtcagactgctcaccaagccctgggatgtgatccctatggttacacagatcgctatgacggacaccacaccgtttgggcaacagcgggtgttcaaagagaaggtcgacacccgcacacccagagccaaacggggaaccacacagattatggaagtgaccgcgaagtggctgtggggctttctttccagaaacaagaaacctcggatctgtacgcgcgaggaattcaccagaaaggttcggagcaatgccgctattggggccgtgtttgtcgatgagaaccagtggaattccgctaaagaagccgtggaggacgagcgcttctgggatctggttcacagagaacgggagctccataagcaaggaaaatgcgccacatgcgtgtacaacatgatgggcaagcgcgaaaagaaactgggggagtttggcaaggcgaaaggaagcagagctatctggtacatgtggctgggcgcccggttcctcgaattcgaggccctggggtttatgaatgaggaccactggttctctcgcgaaaacagcctttccggagtcgagggcgaagggctgcataagctcggatatattctgagagatatctctaaaatccccggcgggaatatgtacgctgacgataccgccggctgggacacacggattaccgaggatgaccttcagaacgaggctaagatcacggatattatggaacctgagcacgccctgctcgcgacaagcatctttaaactgacctatcagaataaggtggtccgcgtgcagagacccgccaagaacggaacagttatggacgtgatttcccggcgcgatcaaagaggctctgggcaggtcggaacctacggcctgaacacgttcaccaatatggaagtgcagctcatccggcagatggagagcgaagggatctttctgccgtccgagcttgagacacctaacctggctgaaagagtgctcgactggctggagaaacatggagccgaacgccttaagcggatggctatttctggcgacgattgtgttgtgaaacccatcgacgatagattcgccaccgcgctgacagccctcaatgacatggggaaggtccgcaaagatattcctcaatgggagcccagcaagggctggaacgactggcagcaggtgcctttttgctcccaccacttccatcagctgatcatgaaggatggacgggaaattgttgtgccctgtagaaatcaagacgagctggtcggccgcgctcgggtgagccagggggccggatggtctctcagagagaccgcttgcctgggcaaatcctatgcccagatgtggcaacttatgtactttcaccgccgggatctgagactcgctgccaacgcgatctgtagcgccgtcccggtggactgggttcctacatctcgcaccacgtggtccatccatgctcaccaccagtggatgacaaccgaagatatgctgagcgtgtggaatcgggtctggattgaggaaaacccctggatggaggacaagacccatgtgtcctcttgggaagaggttccctatcttgggaaaagagaggaccagtggtgcggaagcctgatcggcctcacagcccgggccacctgggctacaaatattcaggtggccatcaaccaagtcagacgcctgattgggaatgaaaactacctggattacatgacgtccatgaagcggttcaaaaatgagagcgaccctgaaggcgcgctctggtga

SEQ ID NO: 18789 - RNA, 9879 nt, synthetic construct
  misc_feature 1..9879: note = derived and/or modified CDS sequence (opt5) from DENV-1__FJ639821__SS-prME
  source 1..9879: mol_type = other RNA
agcgccaccatgctgctcatgctgcttcccacagctctggccttccacctcacgaccagaggcggggagcctcatatgatcgtgtccaagcaggaacggggaaaatctctgctttttaagacaagcgcgggcgtcaacatgtgcaccctgattgctatggacctcggggagctgtgtgaagatacaatgacctacaaatgcccgcgcatcacagaggccgaacccgacgatgttgactgttggtgcaatgccaccgatacgtgggtgacctatggaacatgttcccaaaccggcgagcacagacgggagaagcgctctgtggctctggcccctcatgtcgggctcggactggaaacaagaaccgagacgtggatgagctccgaaggcgcttggaaacagattcagcgggtggagacatgggcccttcgccaccccggcttcaccgttatcgcgtttttcctggcccatgctattgggacatctatcacccagaagggaatcatttttatcctcctgatgcttgtgacccctagcatggccatgagatgcgtcggcattgggaaccgggacttcgtggagggactgtccggcgctacatgggttgatgtggtcctcgaacacgggagctgtgtgacgaccatggccaagaataaacccacactggacatcgagctgctcaagaccgaagtgacaaaccctgcggtcctgcgcaaactttgcattgaggccaagatctctaataccacgacagattccagatgtccgacccaaggagaagctaccctggttgaggagcaggacgccaactttgtgtgccggcgcacattcgtggatagaggctggggcaatgggtgtggactctttggcaaagggagcctgcttacctgcgctaagttcaagtgcgtcacaaaactggaaggaaagattgtgcagtacgagaacctcaaatattctgttatcgtgacggtccacaccggcgaccagcatcaagtggggaatgaaacaaccgagcacggaacaatcgccaccattacgccccaggcccctacctccgaaatccagctgacagattacggcgctctgaccctcgactgtagcccccggacaggcctggactttaacgagatggttcttctgaccatgaaggagaaatcttggctcgtgcataagcagtggttcctggatcttcctctgccctggacgtccggggcgagcacatcccaagaaacctggaatcgccaggacctcctggtcacatttaaaaccgcccacgctaagaagcaggaggtggtcgtgctgggatctcaagaaggcgccatgcacaccgccctcacaggggctacggagattcagaccagcggaacaaccacaatcttcgccggccatctgaaatgcagacttaagatggataaactgaccctcaaggggatgtcctatgttatgtgtacgggcagcttcaaactggaaaaggaggtggcggagacacagcacggaaccgtcctggtgcaggttcggtacgaaggcaccgacgctccgtgcaagattcctttttctacacaagatgagaaaggggtgacccagaacggaagacttatcacagccaatcccatcgtcacggacaaggaaaaacctgtgaacattgagaccgagccccccttcggcgaatcctatatcgtggttggggccggagagaaggctctcaaactgagctggtttaagcgcggctctagcattgggaagatgttcgaagccacagctcggggcgccagacgcatggcgatcctgggagataccgcctgggactttggctccattgggggagtcttcacatctgtgggcaaactcgtgcatcaggtctttgggaccgcttacggagtgctgttcagcggcgtttcctggacgatgaagatcgggatcggcattcttctgacctggctcggactgaatagccggtctacatccctgagcatgacctgtatcgccgtgggcatggtcacactttacctcggggtgatggttcaggctgattctggatgcgtgattaactggaaaggcagagagctgaagtgtgggtccggaatctttgtcaccaacgaagtgcacacatggaccgagcaatataaattccaggccgacagccctaagcgcctgtccgcggccattggcaaggcttgggaggaaggggtttgcggcatccggtctgccacgagactcgagaatattatgtggaaacagatcagcaacgaactgaatcatatccttctggagaacgatatgaagtttacagtggtcgtgggagacgctaatggcattctcgcccaggggaaaaagatgatccgcccgcaacccatggaacacaaatactcctggaagtcttggggaaaagccaagattatcggcgctgacattcagaacaccaccttcatcatcgatgggcctgacacacccgagtgtcctgatggacagcgggcgtggaatatttgggaggtggaagactatggctttggcatcttcaccacgaacatttggctgaagctgagagatagctacacacagatgtgcgaccaccgccttatgtccgccgctatcaaagatagcaaggccgtccatgccgacatggggtattggattgagtctgaaaaaaatgagacctggaagctcgctcgggcctccttcatcgaagttaaaacatgtacctggcccaagagccacacactgtggtctaacggagtgctggagtccgagatgatcattccgaagatctacggcgggcctattagccaacataattatagacccggatactacacccagacggcgggcccttggcacctcgggaaactggaacttgattttgacctgtgcgagggaaccacagtggtcgtggatgaacactgcggcaaccggggcccctctctccgcaccacaaccgttacggggaagatcattcatgagtggtgttgcagaagctgtacactgcctcccctgcggttcagaggagaggacggctgctggtatgggatggaaatccgcccggtgaaagagaaggaagagaatcttgtccggtccatggtgagcgctggatctggcgaagttgataacttttccctcgggatcctgtgtgtgagcattatgatcgaggaggtcatgagatcccgctggtctagaaaaatgctgatgaccggaacactcgccgtgttcctgcttctgattatgggccagctcacctggaatgacctgatccggctgtgcattatggttggcgccaacgctagcgacgggatgggaatgggcaccacataccttgccctgatggcgacgtttaagatgcgccctatgttcgctgtggggctcctgtttagacggctcacctcccgcgaagtcctgcttctgacaatcggactctctctggtggccagcgtggagctgcccaactcccttgaagagctgggcgatgggctcgccatgggaattatgatgctgaagctcctgaccgaattccaaccccaccagctttggacaaccctgctctctctgacgtttgtcaaaacaaccctgagccttgactatgcttggaagaccacagccatggttctgtccatcgtgagcctcttccctctgtgtctctctaccacatcccagaaaacgacctggctgccggtgcttctgggcagctttggctgcaagcccctgacaatgttcctcatcaccgagaataaaatttgggggagaaagtcttggcctctgaacgagggaatcatggctattggcatcgtctccattcttctgagctctctcctgaagaatgatgtgcccctcgccgggcctctgatcgcgggaggcatgcttatcgcctgttacgttatttccgggagctccgctgacctgagcctggataaagccgctgaagtgtcttgggagcaggaagccgagcatagcggagcctcccacaacatctctgtcgaagtgcaagacgatggcacaatgaagattaaagacgaggagcgggatgacaccctcacgatcctgcttaaggctaccctgctcgcggttagcggcgtgtatcccatgtccattcctgccacactgtttgtctggtacttctggcagaaaaagaaacagcgctctggggtgctctgggatacccccagcccgcctgaagtcgagagagctgtgctggacgatggaatctatcggatccttcagcgcggcctgctggggagatcccaagttggagtgggcgtcttccaggacggggtgtttcatacaatgtggcacgttacccggggagccgtgctcatgtaccagggcaagagactggaaccctcttgggcctgcgtcaagaaagaccttattagctacggcgggggatggcgcttccagggctcctggaatacaggggaggaggtgcaagtgatcgctgttgaacctggaaagaaccccaaaaatgtccagacgaccccgggcacatttaagacccctgagggggaagtgggagccattgcgctggatttcaaacccggcaccagcggctctcctatcgtgaaccgggaggggaagattgtcggactctatggcaatggggtggttacaacgtccggaacctacgtgagcgctatcgcccaggccaaggcttctcaagaaggccccctgcccgagattgaggacgaagtctttaaaaagagaaacctcacaatcatggatctgcaccctgggtccggcaaaacccgccggtatcttccggccatcgtgagagaggcgattaagcgcaaactgcggacactgatcctcgctcccaccagagttgtggccagcgaaatggccgaggctctgaagggaatgcctattcgctaccagacgacagccgtcaagtccgaacataccggccgggagatcgtggaccttatgtgtcacgctaccttcacaatgagactgctctctcccgttcgggtgcctaattataacatgattatcatggatgaggcccattttaccgaccccgcgagcatcgccgctcgcgggtacatttccacaagagtcggaatgggcgaagccgctgccatcttcatgaccgccacgcctccggggagcgtggaggcttttccccagtctaatgcggtgattcaggatgaagagcgggacatccctgaacgctcctggaacagcggatatgattggattacagacttccccggcaaaaccgtctggtttgttccttctatcaagagcgggaatgatatcgccaactgcctgagaaaaaacggcaagcgggtgattcaactgtccagaaaaacattcgacaccgagtaccagaagacgaagaataacgactgggattacgtggtcaccacagacatctctgagatgggagctaatttccgcgccgatcgggtgattgaccccagacgctgcctcaaaccggttatccttaaggatggccctgaacgggtgattctggccgggcccatgcccgtcaccgtggctagcgccgcgcagagacgcggacggatcggcagaaaccagaataaagagggggaccaatatgtttacatgggacagcctctgaacaatgatgaagaccacgctcattggacagaggccaagatgctcctggataacattaatacccccgagggcatcatccctgccctttttgaaccggagcgcgaaaaatccgctgccattgacggggagtatagactgcggggcgaagcgcgcaagacattcgtggagctcatgagacggggagatctgcccgtctggctgtcttacaaggtggccagcgagggctttcagtattccgaccgcagatggtgtttcgatggggaacggaacaatcaggtcctcgaggaaaacatggacgtggagatctggaccaaagaaggagagagaaagaaacttcgccctcggtggctggacgctagaacgtacagcgatcccctggccctccgcgagtttaaggaattcgctgccggccggagatctgtttccggggacctgattcttgagatcggaaaactgcctcaacacctcacactgcgggctcagaatgccctggataacctcgtgatgcttcacaatagcgaacagggcggcaaggcgtatcgccatgccatggaggaactgcccgacaccattgagaccctgatgctcctggctcttatcgccgtgctgacagggggagtcaccctctttttcctgtccggcaaagggctgggaaagacatctatcggcctcctttgcgttacggctagctccgccctgctgtggatggcctctgtggagccgcactggattgctgcgagcatcattctcgaatttttcctgatggtgcttctgatccctgagcccgatagacagcggacccctcaagacaaccagctcgcctacgtcgtgattgggctgctgtttatgatcctcacagttgctgccaacgaaatgggacttctggagaccacaaagaaagatctgggcatcggctacgtggccgctgagaatcatcagcacgccaccatgctcgacgtcgatctgcaccccgcgtccgcctggacgctttatgctgtggccaccacagtcattacccctatgatgcgccatacaatcgaaaacaccacggctaatattagcctgacagccatcgcgaaccaagccgctattctcatggggctggacaagggatggcccatctctaaaatggatattggcgtgccgctgctcgcccttgggtgttactcccaggttaatcctctgaccctgacagctgccgtgctcatgctggtcgctcactatgccatcatcggacccggccttcaggcgaaggccaccagagaggctcagaaacggaccgccgctgggattatgaagaaccccacagtggacggaatcgttgccattgatctggaccctgtggtctacgacgtgaagttcgaaaaacaactcggccagatcatgctgctgattctctgcacgagccagatccttctgatgcgcaccacatgggccctgtgtgagtctatcaccctcgcgacaggcccgctgaccacgctttgggaagggtcccccggaaagttttggaatacaaccattgctgtgagcatggccaacatcttcagaggctcttatctggctggggccggactcgccttcagcctgatgaaatccctgggcgggggacggcgcggcaccggcgctcagggggagacactcggagagaagtggaaaagacaacttaatcagctgtctaagagcgaatttaacacctacaagcggtccggcattatggaggttgatagaagcgaagccaaagaggggctgaagcgcggagaaacaacgaatcatgcggtctcccggggcaccgccaaactcagatggttcgtggagcgcaacctggtgaagcctgaggggaaagtcatcgaccttggatgcggccggggcgggtggtcttattactgtgctggactgaagaaggttacagaagtgaaaggctacaccaaggggggacccggccacgaggaacctattcccatggccacatatgggtggaatctcgtgaaactgcatagcggaaaggatgtctttttcatgcctccggagaaatgcgacaccctgctctgtgatatcggcgaatcctctcccaaccctacgatcgaggagggcagaacccttcgcgtgctgaagatggttgaaccctggctgcgggggaatcagttttgcattaaaatcctcaacccttacatgcccagcgtggtcgagacactggaacagatgcaaagaaagcacggaggcatgcttgtgcgcaatccgctgtcccggaactctacccacgagatgtattgggttagctgtgggacaggaaacattgtgtccgctgtcaatatgaccagcagaatgctcctgaaccgcttcacaatggcccatcggaagcctacctacgagagagacgtggatctgggcgcggggacgcgccacgtgacagtcgaacccgaggttgccaatctcgacatcattggacagagaatcgaaaacattaaaaatgagcataagtctacctggcactatgatgaagacaacccctacaaaacctgggcttatcacggctcctacgaggtgaagcctagcggctctgcctccagcatggtgaatggggtcgtgcggctgcttacaaaaccctgggatgttatccctatggtgacgcagatcgctatgaccgacacaaccccgtttggacaacagcgcgtcttcaaggagaaggtggacacaagaaccccccgggccaaaagaggcacaacccagattatggaagttacggctaagtggctgtgggggtttctctctcggaacaaaaagcctcgcatctgcaccagagaggaattcacacggaaagtgcgctccaatgccgcgattggagccgtctttgtggatgagaaccagtggaatagcgctaaggaagccgttgaggacgagagattctgggatctggtgcatcgggaacgcgagcttcacaagcaaggcaaatgcgctacctgtgtctacaacatgatggggaagagagaaaaaaagctgggcgagtttggaaaagccaagggctcccgggccatctggtatatgtggctcggggcgcgcttcctggaattcgaggctctgggatttatgaatgaggaccattggttcagcagagaaaactctctcagcggcgtggagggggaaggactgcacaagcttggctacattctgcgggatatctccaaaatccccgggggcaatatgtatgccgacgatacagccggatgggacacccgcattacggaggatgacctccagaacgaggctaagatcacagatattatggaacctgagcatgccctgcttgctacctctatctttaaactgacataccagaacaaggtcgtgagagttcagcggcccgccaaaaatggcaccgtgatggacgtcattagccgcagagatcaacgggggtccggacaggtgggcacgtatgggctcaacaccttcacaaatatggaagtgcagctgatcagacagatggagtctgaaggaatctttctgccgagcgagctcgagacccctaacctggcggaacgcgttcttgactggctggagaagcacggcgccgaacggctcaaaagaatggctatttccggggacgattgcgtggtcaagcccatcgacgatcgcttcgccacagctctgaccgcccttaatgacatgggcaaggtgcggaaagatattcctcaatgggagccctctaagggatggaacgactggcagcaggttcctttttgtagccaccatttccaccagctgatcatgaaagatggcagagaaattgtggtcccctgccgcaatcaagacgagctcgtggggcgggcgagagtctcccagggagccggctggagcctgcgcgagacagcttgtctggggaagtcttacgcccagatgtggcaactcatgtattttcatcggagagatctgcgccttgctgccaacgctatctgctccgccgtgccggttgactgggtgcctaccagccggacgacatggtctatccacgcgcaccatcagtggatgaccaccgaagatatgctgtccgtctggaatagagtgtggattgaggaaaacccctggatggaggacaaaacacacgttagctcctgggaagaggtgccctacctcggaaagcgggaggaccagtggtgtggctctctgatcgggcttaccgccagagctacatgggccacgaatattcaggtcgccatcaaccaagtgcgccggctgattggcaatgaaaactacctcgattatatgaccagcatgaagagattcaaaaatgagtccgaccctgaaggagctctgtggtga

SEQ ID NO: 18790 - RNA, 9879 nt, synthetic construct
  misc_feature 1..9879: note = derived and/or modified CDS sequence (opt5) from DENV-1__FJ639824__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttgtggccgggggaatgctgatcgcgtgttatgtcatcagcggctccagcgccgatctgtctctcgagaaagctgccgaagtgagctgggagcaggaagctgagcattccggggcctctcacaatattctggttgaagtgcaagacgatggaacaatgaagatcaaagacgaggagagagatgacacccttacgattctgctcaaggccaccctgctcgctgtcagcggcgtgtaccccatgtccatccctgcgacactgtttgtctggtatttctggcagaaaaagaagcagcggtctggcgtgctttgggatacccccagcccgcctgaagttgagcgcgccgtgctggacgatgggatttacagaatcctgcagcggggactcctgggccgctcccaagtcggggtgggagttttccaggacggcgtgtttcatacaatgtggcacgtcaccagaggggctgtgcttatgtatcagggaaaacggctggaaccctcttgggccagcgtgaagaaagacctcatctcctacggcggcgggtggagattccagggaagctggaacacaggcgaggaggttcaagtcattgccgtggaacctgggaagaatcccaaaaacgtgcagacgaccccgggaacatttaagacccctgagggcgaagtcggggctatcgccctggatttcaagcccggaacctctggctcccctattgtgaatcgcgagggcaaaatcgttgggctctacggaaacggcgtggtcacaacgagcgggacctatgtgtctgcgattgctcaggccaaggcctcccaagaaggacccctgcccgagatcgaggacgaagtttttaaaaagcggaatcttacaattatggatctgcaccctggcagcgggaaaaccagacgctacctgccggctatcgtgcgggaggccatcaagagaaagctccgcacactgattcttgcgcccacccgggtcgtggcttccgaaatggccgaggccctgaaaggcatgcctatcagatatcagacgacagctgttaagtctgaacataccggacgcgagattgtggacctcatgtgccacgccaccttcacaatgcggctgctgagccccgtcagagtgcctaactacaatatgatcattatggatgaggctcattttaccgaccccgcctccatcgcggcccggggctatatcagcacacgcgtggggatgggagaagctgccgctattttcatgaccgccacgcctccgggctctgtcgaggcctttccccagtccaacgctgttatccaggatgaagagagagacattcctgaacggagctggaattctgggtacgattggatcacagacttccccggaaaaaccgtgtggtttgtgcctagcattaagtccggcaacgatatcgcgaattgtctccgcaaaaacgggaagagagtcatccaactttctcggaagacattcgacaccgagtatcagaaaacgaagaacaatgactgggattacgtggttaccacagacattagcgagatgggcgccaacttcagagctgatcgcgtgatcgacccccggagatgcctgaaaccggtcattctgaaggatggacctgaacgcgtgatcctcgccggccccatgcccgttaccgtggcctccgctgcccagcggagagggcgcattggacggaatcagaacaaagagggcgaccaatacgtctatatggggcagcctctgaataacgatgaagaccacgcgcattggacagaggctaagatgcttctggataatatcaacacccccgagggaattatccctgccctctttgaaccggagagagaaaagtctgccgctatcgacggcgagtaccgcctgagaggggaagcccggaaaacattcgtggagctgatgcgcagaggcgatctccccgtctggcttagctataaggtggcgtccgagggatttcagtacagcgaccggcgctggtgcttcgatggcgaaagaaataaccaggttctggaggaaaatatggacgtggagatttggaccaaagaaggggagcggaagaaactgagacctcgctggctcgacgcccggacgtattctgatcccctggctcttagagagtttaaggaattcgccgctggacgccggtccgtgagcggcgacctgatcctcgagattgggaaactgcctcaacacctgacactcagagcccagaacgctcttgataatctggtcatgctgcacaactccgaacagggaggcaaggcctaccggcatgcgatggaggaactccccgacaccatcgagaccctgatgcttctggccctcattgctgttctgacaggcggggtgaccctgtttttcctctctggaaagggccttgggaaaacaagcatcggactgctgtgtgtgacggcctcctctgctctcctgtggatggccagcgtcgagccgcactggatcgccgcttccattatccttgaatttttcctgatggtgctcctgattcctgagcccgatcgccagagaacccctcaagacaatcagctggcgtatgttgtgatcggcctcctttttatgattctgacagtcgccgctaacgaaatggggctgctcgagaccacaaagaaagatctgggaatcggctacgtggccgccgagaaccatcagcacgctaccatgcttgacgtcgatctgcggcccgccagcgcgtggacgctctacgccgtggctaccacagttatcacccctatgatgcgccacacaattgaaaataccacggccaacatctctctgacagctattgccaatcaagcggccatcctgatgggcctcgacaaggggtggcccatttccaaaatggatatcggagtgccgcttctggctctgggctgctatagccaggtcaaccctctcaccctgacagccgctgtgcttatgctggttgcccattacgctattatcgggcccggactccaggccaaggcgaccagagaggcccagaagcggaccgctgccggcatcatgaaaaatcccacagtggacgggattgtcgctatcgatctggaccctgtggtgtatgacgccaagttcgaaaaacaactgggacagattatgctccttatcctgtgtacgtctcagattctgctcatgcgcaccacatgggccctgtgcgagtccatcacccttgcgacaggcccgctgaccacgctctgggaaggcagccccgggaagttttggaacacaaccatcgctgtttctatggccaatattttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaatcatggaggtcgatagatccgaagccaaagagggcctgaagcgcggggaaacaacgaaacacgcggtgtctcggggaaccgccaagcttagatggttcgtggagcgcaacctggtcaagcctgagggcaaagttattgacctcgggtgtggacggggcggctggagctactattgcgctgggctgaagaaagtgacagaagtgaagggatacaccaaaggcgggcccggacatgaggaacctatccccatggccacatacggctggaatctggtcaagctccactccgggaaagatgtgtttttcatgcctccggagaagtgtgacacccttctgtgcgatattggagaatctagccccaaccctacgatcgaggagggcagaaccctgcgcgttctcaagatggtggaaccctggctgaaaggcaatcagttttgtatcaagattcttaacccttatatgccctccgtcgtggagacactggaacagatgcaacggaaacatgggggaatgctcgttagaaatccgctgtctcgcaacagcacccacgagatgtactgggtgtcctgcggcacagggaatatcgtcagcgctgtgaacatgacctctcggatgctgctcaacagattcacaatggcccaccgcaagcctacctatgagcgggacgtggatctgggagcgggcacgagacatgtcgccgttgaacccgaggtggctaatcttgacattatcgggcagcgcattgaaaacatcaaaaatgagcacaagtccacatggcattacgatgaagacaacccctataagacctgggcctaccacggaagctatgaggtgaaaccttctggctccgctagctctatggtcaatggcgtggttagactgctcaccaagccctgggatgtgattcctatggtcacacagatcgccatgacggacaccacaccgtttgggcaacagcgggtgttcaaagagaaggttgacacccgcacacccagagctaaacggggaaccacacagatcatggaagtgaccgccaagtggctgtggggctttctttccagaaacaagaaacctcggatttgtacgcgcgaggaattcaccagaaaggtccggagcaatgcggccatcggggctgtgtttgttgatgagaaccagtggaattccgccaaagaagctgtggaggacgagcgcttctgggatctggtccacagagaacgggagctccataagcaaggaaaatgcgccacatgcgtgtacaacatgatgggcaagcgcgaaaagaaactgggggagtttggcaaggccaaaggaagcagagcgatttggtacatgtggctgggcgctcggttcctcgaattcgaggccctggggtttatgaatgaggaccactggttctctcgcgaaaacagcctttccggagtcgagggcgaagggctgcataagctcggatatatcctgagagatatttctaaaatccccggcgggaatatgtacgccgacgataccgctggctgggacacacggatcaccgaggatgaccttcagaacgaggccaagattacggatatcatggaacctgagcacgctctgctcgccacaagcatttttaaactgacctatcagaataaggtggttcgcgtgcagagacccgcgaagaacggaacagtcatggacgtgatctcccggcgcgatcaaagaggctctgggcaggtgggaacctacggcctgaacacgttcaccaatatggaagttcagctcattcggcagatggagagcgaagggatctttctgccgtccgagcttgagacacctaacctggccgaaagagtgctcgactggctggagaaacatggagctgaacgccttaagcggatggccatctctggcgacgattgtgtcgtgaaacccattgacgatagattcgctaccgccctgacagcgctcaatgacatggggaaggttcgcaaagatatccctcaatgggagcccagcaagggctggaacgactggcagcaggtgcctttttgctcccaccacttccatcagctgattatgaaggatggacgggaaatcgtcgtgccctgtagaaatcaagacgagctggtcggccgcgcccgggtgagccagggggctggatggtctctcagagagaccgcctgcctgggcaaatcctatgctcagatgtggcaacttatgtactttcaccgccgggatctgagactcgccgctaacgccatttgtagcgcggttccggtggactgggtccctacatctcgcaccacgtggtccatccatgcccaccaccagtggatgacaaccgaagatatgctgagcgtgtggaatcgggtttggatcgaggaaaacccctggatggaggacaagacccatgtgtcctcttgggaagaggtcccctatcttgggaaaagagaggaccagtggtgcggaagcctgattggcctcacagctcgggccacctgggccacaaatatccaggtggctattaaccaagtgagacgcctgatcgggaatgaaaactacctggattacatgacgtccatgaagcggttcaaaaatgagagcgaccctgaaggcgccctctggtga

SEQ ID NO: 18791 - RNA, 9879 nt, synthetic construct
  misc_feature 1..9879: note = derived and/or modified CDS sequence (opt5) from DENV-1__JN819425__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcgacctgtgcgagggaaccacagtggttgtggatgaacactgcggcaacagaggcccctctctccggaccacaaccgtcacggggaaaattatccatgagtggtgttgccgcagctgtacactgcctcccctgagatttcggggagaggacggctgctggtacgggatggaaattagaccggtgaaggagaaagaagagaatcttgttcgctccatggtgagcgcgggatctggcgaagtcgattccttcagcctcgggatcctgtgtgtgtccatcatgattgaggaggttatgcggtctagatggagccgcaagatgctgatgaccggaacactcgctgtgtttctgcttctgatcatgggccagctcacctggaacgacctgattagactgtgcatcatggtcggcgccaatgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagagctgggagatggcctcgccatggggatcatgatgctgaaactcctgaccgaatttcaaccccaccagctttggacaaccctgctcagcctgacgttcgtgaagacaaccctgtcccttgactacgcctggaaaaccacagctatggtgctgagcattgtctctctctttcctctgtgtctctccaccacaagccagaagacgacctggctgccggtgcttctgggatctttcggctgcaaacccctgacaatgtttctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttatgtcatcagcggctccagcgccgacctgtctctggaaaaggctgtgaaaattagctgggagcaggaagccgagcattccggggcttctcacaatatcctcgttgaagtgcaagatgacggaacaatgaagattaaagatgaggagcgggacgataccctgacgatccttctgaaggccaccctcctggccgtcagcggcgtgtaccccatgtccattcctgctacactcttcgtctggtatttctggcagaaaaagaagcagcgctctggcgtgctgtgggacacccccagcccgcctgaagttgagagagcggtgcttgatgacgggatctaccggatcctgcagcgcggactgctcggcagatcccaagtcggggtgggagtttttcaggatggcgtgttccatacaatgtggcacgtcacccggggggccgtgctgatgtatcagggaaaaagacttgaaccctcttgggctagcgtgaagaaagacctgatttcctacggcggcgggtggcgctttcagggaagctggaacacaggcgaggaggttcaagtcatcgccgtggaacctgggaagaatcccaaaaacgtgcagacgaccccgggaacattcaagacccctgagggcgaagtcggggccattgctctcgactttaagcccggaacctctggctcccctatcgtgaatcgggagggcaaaattgttgggctgtacggaaacggcgtggtcacaacgagcgggacctatgtgtctgccatcgcgcaggctaaggcctcccaagaaggacccctccccgagattgaggatgaagttttcaaaaagagaaatctgacaatcatggaccttcaccctggcagcgggaaaacccgccggtacctgccggccatcgtgagagaggctattaagcgcaagctgcggacactcatcctggcccccaccagagtcgtggcgtccgaaatggctgaggcccttaaaggcatgcctattcgctatcagacgacagccgttaagtctgaacataccggacgggagatcgtggatctgatgtgccacgctacctttacaatgagactcctgagccccgtccgggtgcctaactacaatatgattatcatggacgaggcccatttcaccgatcccgcttccatcgccgcgcgcggctatattagcacaagagtggggatgggagaagccgctgccatctttatgaccgctacgcctccgggctctgtcgaggccttcccccagtccaacgccgttattcaggacgaagagcgggatatccctgaacgcagctggaattctgggtacgactggattacagattttcccggaaaaaccgtgtggttcgtgcctagcatcaagtccggcaacgacatcgctaattgtctgagaaaaaacgggaagcgggtcattcaactctctagaaagacattcgataccgagtatcagaaaacgaagaacaatgactgggactacgtggttaccacagatatcagcgagatgggcgcgaactttcgcgccgaccgggtgattgatcccagacgctgccttaaaccggtcatcctgaaggacggacctgaacgggtgattctggctggccccatgcccgttaccgtggcctccgccgctcagagacgcgggcggatcggaagaaatcagaacaaagagggcgatcaatacgtctatatggggcagcctctcaataacgacgaagatcacgcccattggacagaggcgaagatgctgcttgacaatattaacacccccgagggaatcatccctgctctgttcgaaccggagcgcgaaaagtctgccgccattgatggcgagtacagactccggggggaagctcgcaaaacatttgtggagctgatgagacggggcgacctgcccgtctggctcagctataaggtggcctccgagggattccagtacagcgatcgcagatggtgctttgacggcgaacggaataaccaggttcttgaggaaaatatggatgtggagatctggaccaaagaaggggagagaaagaaactgcgccctcggtggctggacgcgagaacgtattctgaccccctcgccctgcgcgagttcaaggaatttgctgccggacggagatccgtgagcggcgatcttattctggagatcgggaaactccctcaacacctgacactgcgggctcagaacgccctcgacaatcttgtcatgctgcacaactccgaacagggaggcaaggcttaccgccatgccatggaggaactgcccgataccattgagaccctcatgctgcttgcgctgatcgccgttctcacaggcggggtgaccctgttctttctgtctggaaagggcctcgggaaaacaagcatcggacttctgtgtgtgacggcttcctctgccctgctctggatggctagcgtcgagccgcactggattgccgcctccatcattctggaattctttcttatggtgctgctcatccctgagcccgacagacagcggacccctcaagataatcagctggcttatgttgtgattggcctgctcttcatgatccttacagtcgcggccaacgaaatggggctgctggagaccacaaagaaagacctcggaatcggctacgtggctgccgagaaccatcagcacgccaccatgctggatgtcgaccttcaccccgctagcgcctggacgctgtacgcggtggccaccacagttattacccctatgatgcgccatacaatcgaaaataccacggctaacatttctctcacagccatcgctaatcaagccgcgattctgatgggcctggataaggggtggcccatctccaaaatggacattggagtgccgctccttgccctgggctgctatagccaggtcaaccctctgaccctcacagctgccgtgctgatgcttgttgctcactacgccatcatcgggcccggactgcaggctaaggccaccagagaggcgcagaagcggaccgccgctggcattatgaaaaatcccacagtggatgggatcgtcgccattgacctcgatcctgtggtgtatgacgctaagtttgaaaaacaactgggacagatcatgctgctcattctttgtacgtctcagatcctgctgatgcgcaccacatgggccctctgcgagtccatcaccctggccacaggcccgcttaccacgctgtgggaaggcagccccgggaagttctggaacacaaccattgcggtttctatggctaatatcttcagaggaagctacctcgccggcgctgggctggccttttccctgatgaaatctctcggaggcgggcggcgcggaaccggcgcccagggcgagacacttggggagaagtggaagagacaactgaaccagctgagcaaatccgaattcaatacctataagcggagcggaattatggaggtcgacagatccgaagctaaagagggcctcaagcgcggggaaacaacgaaacatgccgtgtctcggggaaccgcgaagctgagatggtttgtggagcgcaaccttgtcaagcctgagggcaaagttatcgatctggggtgtggacggggcggctggagctactattgcgccgggctcaagaaagtgacagaagtgaagggatacaccaaaggcgggcccggacacgaggaacctattcccatggctacatacggctggaatctggtcaagctgcattccgggaaagacgtgttctttatgcctccggagaagtgtgataccctcctttgcgacatcggagaatctagccccaaccctacgatcgaggagggcagaaccctgcgcgttctgaagatggtggaaccctggctccggggcaatcagttctgtattaaaatcctgaacccttatatgccctccgtcgtggagacacttgaacagatgcaaagaaagcacgggggaatgctggttcgcaatccgctctctcggaacagcacccacgagatgtactgggtgtcctgcggcacagggaatattgtcagcgccgtgaacatgacctctagaatgctgctgaaccgctttacaatggctcatcggaaacctacctatgagagagatgtggacctcggagccggcacgcgccacgtcgcggttgaacccgaggtggccaatctggatatcattgggcagagaatcgaaaacattaagaatgagcataaatccacatggcactacgacgaagataacccctataagacctgggcttaccacggaagctatgaggtgaagccttctggctccgccagctctatggtcaatggcgtggttcggcttctgaccaaaccctgggacgtgatccctatggtcacacagatcgctatgacggataccacaccgttcgggcaacagcgcgtgtttaaggagaaagttgacaccagaacaccccgggccaagagaggaaccacacagattatggaagtgaccgctaaatggctctggggcttcctgtcccggaacaagaagcctcgcatctgtacgagagaggaatttacccggaaagtccgcagcaatgccgcgattggggccgtgttcgttgacgagaaccagtggaattccgctaaggaagccgtggaggatgagagattttgggaccttgtccatcgggaacgcgagctgcacaaacaaggaaagtgcgctacatgcgtgtacaacatgatgggcaaaagagaaaagaagctcggggagttcggcaaagccaagggaagccgggccatctggtacatgtggctgggcgcgcgcttcctggaatttgaggctctcgggttcatgaatgaggatcattggttttctagagaaaacagcctgtccggagtcgagggcgaagggcttcacaaactgggatatattctccgggacatctctaagatccccggcgggaatatgtacgccgatgacaccgccggctgggatacacgcattaccgaggacgatctgcagaacgaggctaaaatcacggacattatggaacctgagcatgcccttctggctacaagcatcttcaagctcacctatcagaataaagtggttagagtgcagcggcccgccaagaacggaacagtcatggatgtgatttcccgcagagaccaacggggctctgggcaggtgggaacctacggcctgaacacgtttaccaatatggaagttcagctgatcagacagatggagagcgaagggatcttcctcccgtccgagctggagacacctaaccttgcggaacgcgccctggattggctcgagaagcacggagctgaacggctgaaaagaatggccatttctggcgacgactgtgtggtcaagcccatcgatgaccgctttgctaccgcccttacagcgctgaatgatatggggaaagtgcggaaggacattcctcaatgggagcccagcaaaggctggaacgattggcagcaggttcctttctgctcccaccattttcaccagctcatcatgaaggacggaagagaaattgtggtcccctgtcgcaatcaagatgagctggtgggccgggccagagtcagccagggggctggatggtctctgcgcgagaccgcctgcctcggcaagtcctatgctcagatgtggcaactgatgtacttccatcggagagaccttcgcctggccgctaacgccatctgtagcgcggtgccggttgattgggtgcctacatctcggaccacgtggtccatccacgcccaccatcagtggatgacaaccgaagacatgctcagcgtctggaatagagtgtggattgaggaaaacccctggatggaggataaaacccacgtttcctcttgggaagaggtgccctatctggggaagcgggaggaccagtggtgcggaagccttatcggcctgacagctagagccacctgggccacaaatattcaggtcgctatcaaccaagtgcgccggctcattgggaatgaaaactacctggactacatgacgtccatgaaaagatttaagaatgagagcgatcctgaaggcgccctgtggtga

SEQ ID NO: 18792 - RNA, 9879 nt, synthetic construct
  misc_feature 1..9879: note = derived and/or modified CDS sequence (opt5) from DENV-1__FJ850099__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatacgtgtatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacacctgacactcagagcccagaacgctcttgataatctggtgatgctgcacaactccgaacagggaggcaaggcctaccggcatgcgatggaggaactccccgacaccattgagaccctgatgcttctggccctcatcgctgtcctgacaggcggggttaccctgtttttcctctctggaaagggccttgggaaaacaagcatcggactgctgtgtgtgacggcctcctctgctctcctgtggatggccagcgtggagccgcactggattgccgcttccatcattcttgaatttttcctgatggtcctcctgatccctgagcccgatcgccagagaacccctcaagacaatcagctggcgtatgtggttattggcctcctttttatgatcctgacagtggccgctaacgaaatggggctgctcgagaccacaaagaaagatctgggaatcggctacgtcgccgccgagaaccatcagcacgctaccatgcttgacgtggatctgcggcccgccagcgcgtggacgctctacgccgtcgctaccacagtgattacccctatgatgcgccacacaatcgaaaataccacggccaacatttctctgacagctatcgccaatcaagcggccattctgatgggcctcgacaaggggtggcccatctccaaaatggatattggagttccgcttctggctctgggctgctatagccaggtgaaccctctcaccctgacagccgctgtccttatgctggtggcccattacgctatcatcgggcccggactccaggccaaggcgaccagagaggcccagaagcggaccgctgccggcattatgaaaaatcccacagttgacgggatcgtggctattgatctggaccctgtcgtgtatgacgccaagttcgaaaaacaactgggacagatcatgctccttattctgtgtacgtctcagatcctgctcatgcgcaccacatgggccctgtgcgagtccatcacccttgcgacaggcccgctgaccacgctctgggaaggcagccccgggaagttttggaacacaaccattgctgtgtctatggccaatatcttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaattatggaggttgatagatccgaagccaaagagggcctgaagcgcggggaaacaacgaaacacgcggtctctcggggaaccgccaagcttagatggttcgtggagcgcaacctggtgaagcctgagggcaaagtcatcgacctcgggtgtggacggggcggctggagctactattgcgctgggctgaagaaagttacagaagtgaagggatacaccaaaggcgggcccggacatgaggaacctattcccatggccacatacggctggaatctggtgaagctccactccgggaaagatgtctttttcatgcctccggagaagtgtgacacccttctgtgcgatatcggagaatctagccccaaccctacgatcgaggagggcagaaccctgcgcgtgctcaagatggttgaaccctggctgaaaggcaatcagttttgtattaagatccttaacccttatatgccctccgtggtcgagacactggaacagatgcaacggaaacatgggggaatgctcgtgagaaatccgctgtctcgcaacagcacccacgagatgtactgggtttcctgcggcacagggaatattgtgagcgctgtcaacatgacctctcggatgctgctcaacagattcacaatggcccaccgcaagcctacctatgagcgggacgtggatctgggagcgggcacgagacatgtggccgtcgaacccgaggttgctaatcttgacatcattgggcagcgcatcgaaaacattaaaaatgagcacaagtccacatggcattacgatgaagacaacccctataagacctgggcctaccacggaagctatgaggtgaaaccttctggctccgctagctctatggtgaatggcgtcgtgagactgctcaccaagccctgggatgttatccctatggtgacacagatcgccatgacggacaccacaccgtttgggcaacagcgggtcttcaaagagaaggtggacacccgcacacccagagctaaacggggaaccacacagattatggaagttaccgccaagtggctgtggggctttctttccagaaacaagaaacctcggatctgtacgcgcgaggaattcaccagaaaggtgcggagcaatgcggccattggggctgtctttgtggatgagaaccagtggaattccgccaaagaagctgttgaggacgagcgcttctgggatctggtgcacagagaacgggagctccataagcaaggaaaatgcgccacatgcgtctacaacatgatgggcaagcgcgaaaagaaactgggggagtttggcaaggccaaaggaagcagagcgatctggtacatgtggctgggcgctcggttcctcgaattcgaggccctggggtttatgaatgaggaccactggttctctcgcgaaaacagcctttccggagtggagggcgaagggctgcataagctcggatatattctgagagatatctctaaaatccccggcgggaatatgtacgccgacgataccgctggctgggacacacggattaccgaggatgaccttcagaacgaggccaagatcacggatattatggaacctgagcacgctctgctcgccacaagcatctttaaactgacctatcagaataaggtcgtgcgcgttcagagacccgcgaagaacggaacagtgatggacgtcatttcccggcgcgatcaaagaggctctgggcaggtgggaacctacggcctgaacacgttcaccaatatggaagtgcagctcatccggcagatggagagcgaagggatctttctgtcctctgagcttgagacaccgaacctggccgaaagagttctcgactggctggagaaacatggagctgaacgccttaagcggatggccattagcggcgacgattgtgtggtcaaacctatcgacgatagattcgctaccgccctgacagcgctcaatgacatggggaaggtgcgcaaagatattccccaatgggagccttccaagggctggaacgactggcagcaggttcccttttgcagccaccacttccatcagctgatcatgaaggatggacgggaaattgtggtcccttgtagaaatcaagacgagctggtgggccgcgcccgggtctctcagggggctggatggtccctcagagagaccgcctgcctgggcaaaagctatgctcagatgtggcaacttatgtactttcaccgccgggatctgagactcgccgctaacgccatctgttctgcggtgcccgttgactgggtgccgacatcccgcaccacgtggagcatccatgcccaccaccagtggatgacaaccgaagatatgctgtccgtctggaatcgggtgtggattgaggaaaacccttggatggaggacaagacccatgtttctagctgggaagaggtgccctatcttgggaaaagagaggaccagtggtgcggatccctgatcggcctcacagctcgggccacctgggccacaaatattcaggtcgctatcaaccaagtgagacgcctgattgggaatgaaaactacctggattacatgacgagcatgaagcggttcaaaaatgagtctgaccccgaaggcgccctctggtga

SEQ ID NO: 18793 - RNA, 9879 nt, synthetic construct
  misc_feature 1..9879: note = derived and/or modified CDS sequence (opt5) from DENV-1__FJ850100__SS-prME
  source 1..9879: mol_type = other RNA
agcgtgaccatgctgctcatgctgcttcccacagccctggctttccacctcacgaccagaggcggggaacctcatatgatcgtctccaagcaggaacggggaaagtctctgctttttaagacaagcgccggcgttaatatgtgcaccctgattgcgatggacctcggggaactgtgtgaagatacaatgacctacaagtgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaatcgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagccgccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaaacttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacacacctggctctcatggccacgtttaaaatgcggcctatgttcgcggtcggcctgctctttcgcagactgacctctcgggaggtgcttctgctcacaatcgggctgagcctgatggcttccatggaacttcccaactctctggaggaactcggagacggcctggccatggggattatgatgctcaagctgcttaccgagttccaaccccatcagctgtggacaaccctcctgagcctgacgtttgtgaaaacaaccctttccctggattatgcctggaagaccacagctatgatcctcagcatcgtctctctgttccctctctgtctgtccaccacaagccagaaaacgacctggcttccggttctgctgggatcttttggctgcaagcccctcacaatgttcctgattaccgaaaacaagatctggggccgcaaatcctggcctcttaatgaggggattatggccatcggaattgtgagcatcctgctctcttccctgctcaagaacgacgtgcccctggctggccctcttatcgccgggggaatgctgattgcgtgttacgtcatcagcggctccagcgccgatctgtctctcgagaaagctgccgaagtgagctgggagcaggaagctgagcactccggggcctctcataatattctggttgaagtgcaagacgatggaacaatgaagatcaaagacgaggagagagatgacacccttacgattctgctcaaggccaccctgctcgctgtcagcggcgtgtatcccatgtccatccctgcgacactgtttgtttggtacttctggcagaaaaagaagcagcggtctggcgtgctttgggatacccccagcccgcctgaagtcgagcgcgccgtgctggacgatgggatctatcgcattctgcagcggggactcctgggccgctcccaagtcggggtgggagttttccaggacggcgtgtttcacacaatgtggcacgtcaccagaggggctgtgcttatgtaccagggaaaacggctggaaccctcttgggccagcgttaagaaagacctcatctcctatggcggcgggtggagattccagggaagctggaacacaggcgaggaggtgcaagtcattgccgtggaacctgggaagaatcccaaaaacgtgcagacgaccccgggaacatttaagacccctgagggcgaagttggggctatcgccctggatttcaagcccggaacctctggctcccctattgtcaatcgcgagggcaaaatcgtggggctctacggaaacggcgtggtcacaacgagcgggacctacgtgtctgcgattgctcaggccaaggcctcccaagaaggacccctgcccgagatcgaggacgaagtttttaaaaagcggaatcttacaatcatggatctgcatcctggcagcgggaaaaccagacgctatctgccggctattgtgcgggaggccatcaagagaaagctccgcacactgattcttgcgcccacccgggtcgtggcttccgaaatggccgaggccctgaaaggcatgcctatcagataccagacgacagctgttaagtctgaacacaccggacgcgagattgtggacctcatgtgccatgccaccttcacaatgcggctgctgagccccgtcagagtgcctaactataatatgatcatcatggatgaggctcactttaccgaccccgcctccattgcggcccggggctacatcagcacacgcgttgggatgggagaagctgccgctattttcatgaccgccacgcctccgggctctgtggaggcctttccccagtccaacgctgtcatccaggatgaagagagagacattcctgaacggagctggaactctgggtatgattggatcacagacttccccggaaaaaccgtgtggtttgtgcctagcatcaagtccggcaacgatattgcgaattgtctccgcaaaaacgggaagagagtcatccaactttctcggaagacattcgacaccgagtaccagaaaacgaagaacaatgactgggattatgttgtgaccacagacattagcgagatgggcgccaacttcagagctgatcgcgtgatcgacccccggagatgcctgaaaccggtcattctgaaggatggacctgaacgcgtgatcctcgccggccccatgcccgttaccgtggcctccgctgcccagcggagagggcgcattggacggaatcagaacaaagagggcgaccaatacgtctacatggggcagcctctgaataacgatgaagaccatgcgcactggacagaggctaagatgcttctggataatatcaacacccccgagggaatcattcctgccctctttgaaccggagagagaaaagtctgccgctatcgacggcgagtatcgcctgagaggggaagcccggaaaacattcgtggagctgatgcgcagaggcgatctccccgtttggcttagctacaaggtggcgtccgagggatttcagtatagcgaccggcgctggtgcttcgatggcgaaagaaataaccaggtcctggaggaaaatatggacgtggagatttggaccaaagaaggggagcggaagaaactgagacctcgctggctcgacgcccggacgtactctgatcccctggctcttagagagtttaaggagttcgccgctggacgccggtccgtcagcggcgacctgatcctcgagattgggaaactgcctcaacacctgacactcagagcccagaacgctcttgataatctggtgatgctgcataactccgaacagggaggcaaggcctatcggcacgcgatggaggaactccccgacaccatcgagaccctgatgcttctggccctcatcgctgttctgacaggcggggtgaccctgtttttcctctctggaaagggccttgggaaaacaagcattggactgctgtgtgtgacggcctcctctaccctcctgtggatggctagcgtcgagccgcattggatcgccgcctccattatccttgaatttttcctgatggttctcctgattcctgagcccgatcgccagagaacacctcaagacaatcagctggcttacgtggtgatcggcctcctttttatgatcctgaccgtcgcggccaacgaaatggggctgctcgagacaaccaagaaagatctgggaattggctatgtggctgccgagaaccaccagcacgccacgatgcttgacgttgatctgcggcccgctagcgcctggaccctctacgcggtggccacaaccgtcatcacacctatgatgcgccataccattgaaaatacgacagctaacatctctctgaccgccattgctaatcaagccgcgatcctgatgggcctcgacaaggggtggcccatttccaaaatggatatcggagtgccgcttctggccctgggctgctacagccaggtcaaccctctcacactgaccgctgccgtgcttatgctggttgctcactatgccatcattgggcccggactccaggctaaggccaccagagaggcgcagaagcggacagccgctggcatcatgaaaaatcccacggtggacgggattgtcgccatcgatctggaccctgtggtttacgacgctaagttcgaaaaacaactgggacagattatgctccttatcctgtgtacctctcagatcctgctcatgcgcacaacctgggccctgtgcgagtccattacacttgccaccggcccgctgacgacactctgggaaggcagccccgggaagttttggaacaccaccatcgcggtgtctatggctaatattttcagaggaagctatctggccggcgctgggctggccttctccctcatgaaatctcttggaggcgggcggcgcggaacaggcgcccagggcgagaccctgggggagaagtggaagagacaactgaaccagctcagcaaatccgaatttaatacatacaagcggagcggaatcatggaggtcgatagatccgaagctaaagagggcctgaagcgcggggaaacgaccaaacatgccgtgtctcggggaacagcgaaacttagatggttcgtggagcgcaacctggttaagcctgagggcaaagtcattgacctcgggtgtggacggggcggctggagctattactgcgccgggctgaagaaagtgaccgaagtgaagggatatacaaaaggcgggcccggacacgaggaacctatccccatggctacctacggctggaatctggtcaagctccattccgggaaagatgtgtttttcatgcctccggagaagtgtgacacgcttctgtgcgatatcggagaatctagccccaaccctaccattgaggagggcagaacactgcgcgttctcaagatggtggaaccctggctgaaaggcaatcagttttgtatcaagattcttaacccttacatgccctccgtcgtggagaccctggaacagatgcaacggaaacacgggggaatgctcgttagaaatccgctgtctcgcaacagcacacacgagatgtattgggtgtcctgcggcaccgggaatatcgtcagcgccgtgaacatgacatctcggatgctgctcaacagattcaccatggctcatcgcaagcctacgtacgagcgggacgttgatctgggagccggcacaagacacgtggcggtcgaacccgaggtggccaatcttgacattatcgggcagcgcattgaaaacatcaaaaatgagcataagtccacctggcactatgatgaagacaacccctacaagacctgggcttatcacggaagctacgaggtgaaaccttctggctccgccagctctatggtcaatggcgttgtgagactgctcacaaagccctgggatgtgatccctatggtcacgcagattgctatgaccgacacaaccccgtttgggcaacagcgggtgttcaaagagaaggttgacacacgcacccccagagccaaacggggaacaacccagatcatggaagtgacggctaagtggctgtggggctttctttccagaaacaagaaacctcggatttgtacccgcgaggagttcacaagaaaggtccggagcaatgccgcgatcggggccgtgtttgttgatgagaaccagtggaactccgctaaagaagccgtggaggacgagcgcttctgggatctggtccatagagaacgggagctccacaagcaaggaaaatgcgctacctgcgtgtataacatgatgggcaagcgcgaaaagaaactgggggagtttggcaaggccaaaggaagcagagccatttggtacatgtggctgggcgcgcggttcctcgagttcgaggctctggggtttatgaatgaggaccattggttctctcgcgaaaacagcctttccggagttgagggcgaagggctgcacaagctcggatacatcctgagagatatctctaaaattcccggcgggaatatgtatgccgacgatacagccggctgggacacccggatcacggaggatgaccttcagaacgaggctaagattacagatatcatggaacctgagcatgccctgctcgctaccagcatttttaaactgacataccagaataaggtggtccgcgtgcagagacccgccaagaacggaaccgtcatggacgtgatctcccggcgcgatcaaagaggctctgggcaggttggaacgtatggcctgaacaccttcacaaatatggaagtgcagctcatccggcagatggagagcgaagggatttttctgccgtccgagcttgagacccctaacctggcggaaagagtcctcgactggctggagaaacacggagccgaacgccttaagcggatggctatctctggcgacgattgtgtggtgaaacccattgacgatagattcgccacagctctgaccgccctcaatgacatggggaaggttcgcaaagatatccctcaatgggagcccagcaagggctggaacgactggcaacaggtgcctttttgctcccaccatttccaccagctgattatgaaggatggacgggaaatcgtcgtgccctgtagaaatcaagacgagctggttggccgcgcgcgggtgagccagggggccggatggtctctcagagagacagcttgcctgggcaaatcctacgcccagatgtggcaacttatgtattttcatcgccgggatctgagactcgctgccaacgctatctgtagcgccgtcccggtggactgggtccctacctctcgcacgacatggtccattcacgcgcaccatcagtggatgaccaccgaagatatgctgagcgtgtggaatcgggtttggatcgaggaaaacccctggatggaggacaagacacacgtgtcctcttgggaagaggtcccctaccttgggaaaagagaggaccagtggtgcggaagcctgattggcctcaccgcccgggctacatgggccacgaatatccaggtggccattaaccaagttagacgcctgatcgggaatgaaaactatctggattacatgacctccatgaagcggttcaaaaatgagagcgaccctgaaggcgctctctggtga

SEQ ID NO: 18794 - RNA, 9879 nt, synthetic construct
  misc_feature 1..9879: note = derived and/or modified CDS sequence (opt5) from DENV-1__FJ882579__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggatttcgttgagggactgtccggcgccacatgggtggacgtcgtgctcgagcacgggagctgtgtgacgaccatggctaagaataaacccacactggatatcgaactgctcaagaccgaggtcacaaaccctgccgttctgcgcaaactttgcattgaagcgaagatctctaataccacgacagactccagatgtccgacccaaggagaggccaccctggtggaagagcaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaaggggatgtcctatgtgatgtgtacgggcagcttcaaactggagaaggaagtcgccgagacacagcacggaaccgtgctggttcaggtgaagtacgagggcaccgatgcgccgtgcaaaattcctttttctacacaagacgaaaagggggtcacccagaacggacggcttatcacagctaatcccatcgtgacggataaagagaagcctgtgaacattgaaaccgagccccccttcggcgagtcctatatcgttgtcggggccggagaaaaagccctcaagctgagctggtttaagaaaggctctagcattgggaagatgttcgaggctacagccagaggcgctcgccggatggccatcctgggagacaccgcgtgggattttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagcagatctacatccctgagcatgacctgtatcgctgtcggcatggtgacactttacctcggggttatggtgcaggccgactctggatgcgtcattaactggaaaggccgcgaactgaagtgtgggtccggaatctttgtgaccaacgaggttcacacatggaccgaacaatataagttccaggctgatagccctaaacggctgtccgccgcgattggcaaggcctgggaggagggggtgtgcggcatcagatctgctacgcgcctcgaaaatattatgtggaaacagatcagcaacgagctgaatcatatccttctggaaaacgacatgaagtttacagtcgtggtgggagacgccaatggcattctcacccaggggaaaaagatgatccggccgcaacccatggagcacaaatactcctggaagtcttggggaaaggctaaaattatcggcgccgatattcagaacaccacattcatcatcgacgggcctgatacccccgaatgtcctgacggacagagagcctggaatatttgggaggtcgaggattatggctttggcatcttcacgacaaacatttggctgaagctgcgcgacagctacacccagatgtgcgatcaccggcttatgtccgctgcgatcaaagacagcaaggccgttcatgctgatatggggtattggattgaatctgagaaaaatgaaacatggaagctcgccagagcctccttcatcgaggtgaagacctgtacatggcccaaaagccacaccctgtggtctaacggagtgctggaatccgagatgatcattccgaagatctacggcgggcctattagccaacataattatcgccccggatactttacgcagaccgctggcccttggcacctcgggaaactggagcttgacttcgatctgtgcgaaggaacaaccgtcgtggttgacgagcactgcggcaaccggggcccctctctcagaacaaccacggtgacagggaagatcattcatgaatggtgttgccggagctgtaccctgcctcccctgcgctttagaggagaggatggctgctggtacgggatggagatccggccggtcaaagaaaaggaggaaaatcttgtgagatccatggttagcgccggatctggcgaggtggactccttcagcctcgggatcctgtgtgtctccattatgatcgaagaggtgatgcgctctcggtggagcagaaagatgctgatgacaggaaccctcgcggtttttctgcttctgattatgggccagctcacctggaacgacctgatccgcctgtgcattatggtgggcgctaatgcctccgatagaatggggatgggaacaacgtatcttgccctgatggctaccttcaaaatgcggcctatgtttgccgtcggcctcctgttccgcagactcacatctcgggaggtgctgcttctgaccatcgggctcagcctggtggcgtccgtcgaactgcccaactctcttgaggaactgggagacggcctcgctatggggattatgatgctgaagctcctgacagagtttcaaccccaccagctttggaccacgctgctcagcctgacattcgttaaaaccaccctgtcccttgattacgcctggaagacaaccgccatggtgctgagcatcgtgtctctctttcctctgtgtctctccacaacgagccagaaaaccacatggctgccggtccttctgggatctttcggctgcaagcccctgaccatgtttctcatcacagaaaacaagatttggggccgcaaatcctggcctctgaatgaggggatcatggctattggaatcgtgagcattcttctgtcttccctcctgaagaacgacgttcccctcgccggccctctgatcgctgggggaatgcttatcgcctgttatgtgattagcggctccagcgcggatctgctgctcgagaaagccgctgaagtctcttgggagcaggaagccgagcatagcggggcttcccacaatatcctggtggaagttcaagacgatggaaccatgaagattaaagacgaggagagagatgacacgcttaccatcctgctcaaggccacactgctcgccgtgtctggcgtctaccccatgagcattcctgctaccctgttcgtgtggtatttctggcagaaaaagaagcagcggtccggcgtcctttgggatacaccctctccgcctgaagtggagcgcgcggttctggacgatgggatctacagaatcctgcagcggggactcctgggccgcagccaagtgggggtcggagtgtttcaggacggcgttttccataccatgtggcacgtgacaagaggggccgtccttatgtatcagggaaaacggctggaaccctcctgggcttctgtgaagaaagacctcattagctacggcggcgggtggagatttcagggatcctggaacacgggcgaggaggtgcaagttatcgccgtcgaacctgggaagaatcccaaaaacgtgcagaccacaccgggaaccttcaagacccctgagggcgaagtgggggccattgctctggattttaagcccggaacaagcggctctcctatcgtcaatcgcgagggcaaaattgtggggctctacggaaacggcgttgtgacgacctccgggacatatgtcagcgccatcgcgcaggctaaggcctctcaagaaggacccctgcccgagattgaggacgaagtgttcaaaaagcggaatcttaccatcatggatctgcaccctggctccgggaaaacaagacgctacctgccggccatcgttcgggaggctattaagagaaagctccgcaccctgatccttgcccccacgcgggtggtcgcgagcgaaatggctgaggccctgaaaggcatgcctattagatatcagacaaccgccgtgaagtccgaacataccggacgcgagatcgttgacctcatgtgccacgctacatttaccatgcggctgctgtctcccgtgagagtccctaactacaatatgattatcatggatgaggcccatttcacagaccccgctagcatcgccgcgcggggctatatttccacccgcgtggggatgggagaagccgctgccatctttatgacggctacacctccgggcagcgtggaggccttcccccagtctaacgccgtcattcaggatgaagagagagacatccctgaacggtcctggaatagcgggtacgattggattaccgactttcccggaaaaacagtttggttcgtgccttctatcaagagcggcaacgatatcgctaattgtctccgcaaaaacgggaagagagtgattcaactttcccggaagaccttcgacacggagtatcagaaaaccaagaacaatgactgggattacgtcgtgacaaccgacatctctgagatgggcgcgaactttagagccgatcgcgttattgacccccggagatgcctgaaaccggtgatcctgaaggatggacctgaacgcgtcattctcgctggccccatgcccgtgacagttgccagcgccgctcagcggagagggcgcatcggacggaatcagaacaaagagggcgaccaatacgtgtatatggggcagcctctgaataacgatgaagaccacgcccattggaccgaggcgaagatgcttctggataatattaacacacccgagggaatcatccctgctctcttcgaaccggagagagaaaagtccgccgccattgacggcgagtaccgcctgagaggggaagctcggaaaacctttgtcgagctgatgcgcagaggcgatctccccgtgtggctttcttataaggtcgccagcgagggattccagtactccgaccggcgctggtgctttgatggcgaaagaaataaccaggtgctggaggaaaatatggacgttgagatctggacgaaagaaggggagcggaagaaactgagacctcgctggctcgacgcgcggacatatagcgatcccctggcccttagagagttcaaggaatttgctgccggacgccggtctgtgtccggcgacctgattctcgagatcgggaaactgcctcaacacctgaccctcagagctcagaacgcccttgataatctggtgatgctgcacaacagcgaacagggaggcaaggcttaccggcatgccatggaggaactccccgacaccattgagacactgatgcttctggcgctcatcgccgtcctgaccggcggggttacactgttctttctctccggaaagggccttgggaaaacgtctatcggactgctgtgtgtgaccgctagctccgccctcctgtggatggcttctgtggagccgcactggattgccgccagcatcattcttgaattctttctgatggtcctcctgatccctgagcccgatcgccagagaacacctcaagacaatcagctggcttatgtggttattggcctccttttcatgatcctgaccgtggcggccaacgaaatggggctgctcgagacaaccaagaaagatctgggaatcggctacgtcgctgccgagaaccatcagcacgccacgatgcttgacgtggatctgcggcccgcttccgcctggaccctctacgcggtcgccacaaccgtgattacacctatgatgcgccacaccatcgaaaatacgacagctaacattagcctgaccgccatcgctaatcaagccgcgattctgatgggcctcgacaaggggtggcccatctctaaaatggatattggagttccgcttctggccctgggctgctattcccaggtgaaccctctcacactgaccgctgccgtccttatgctggtggctcattacgccatcatcgggcccggactccaggctaaggccaccagagaggcgcagaagcggacagccgctggcattatgaaaaatcccacggttgacgggatcgtggccattgatctggaccctgtcgtgtatgacgctaagtttgaaaaacaactgggacagatcatgctccttattctgtgtaccagccagatcctgctcatgcgcacaacctgggccctgtgcgagtctatcacacttgccaccggcccgctgacgacactctgggaaggctcccccgggaagttctggaacaccaccattgcggtgagcatggctaatatcttcagaggatcttacctggccggcgctgggctggcctttagcctcatgaaatcccttggaggcgggcggcgcggaacaggcgcccagggcgagaccctgggggagaagtggaagagacaactgaaccagctctctaaaagcgaattcaatacatataagcggtccggaattatggaggttgatagaagcgaagctaaagagggcctgaagcgcggggaaacgaccaaacacgccgtctcccggggaacagcgaagcttagatggtttgtggagcgcaacctggtgaagcctgagggcaaagtcatcgacctcgggtgtggacggggcggctggtcttactattgcgccgggctgaagaaagttaccgaagtgaagggatacacaaaaggcgggcccggacatgaggaacctattcccatggctacctacggctggaatctggtgaagctccacagcgggaaagatgtcttctttatgcctccggagaagtgtgacacgcttctgtgcgatatcggagaatcctctcccaaccctaccatcgaggagggcagaacactgcgcgtgctcaagatggttgaaccctggctgaaaggcaatcagttctgtattaagatccttaacccttatatgcccagcgtggtcgagaccctggaacagatgcaacggaaacatgggggaatgctcgtgagaaatccgctgtcccgcaactctacacacgagatgtactgggttagctgcggcaccgggaatattgtgtccgccgtcaacatgacaagccggatgctgctcaacagatttaccatggctcaccgcaagcctacgtatgagcgggacgtggatctgggagccggcacaagacatgtggcggtcgaacccgaggttgccaatcttgacatcattgggcagcgcatcgaaaacattaaaaatgagcacaagtctacctggcattacgatgaagacaacccctataagacctgggcttaccacggatcctatgaggtgaaacctagcggctctgcctccagcatggtgaatggcgtcgtgagactgctcacaaagccctgggatgttatccctatggtgacgcagatcgctatgaccgacacaaccccgttcgggcaacagcgggtctttaaagagaaggtggacacacgcacccccagagccaaacggggaacaacccagattatggaagttacggctaagtggctgtggggcttcctttctagaaacaagaaacctcggatctgtacccgcgaggaatttacaagaaaggtgcggtccaatgccgcgattggggccgtcttcgtggatgagaaccagtggaatagcgctaaagaagccgttgaggacgagcgcttttgggatctggtgcacagagaacgggagctccataagcaaggaaaatgcgctacctgcgtctacaacatgatgggcaagcgcgaaaagaaactgggggagttcggcaaggccaaaggatccagagccatctggtacatgtggctgggcgcgcggttcctcgaatttgaggctctggggttcatgaatgaggaccactggtttagccgcgaaaactctcttagcggagtggagggcgaagggctgcataagctcggatatattctgagagatatctccaaaatccccggcgggaatatgtacgccgacgatacagccggctgggacacccggattacggaggatgaccttcagaacgaggctaagatcacagatattatggaacctgagcacgccctgctcgctacctctatcttcaaactgacatatcagaataaggtcgtgcgcgttcagagacccgccaagaacggaaccgtgatggacgtcattagccggcgcgatcaaagaggctccgggcaggtgggaacgtacggcctgaacacctttacaaatatggaagtgcagctcatccggcagatggagtctgaagggatcttcctgccgagcgagcttgagacccctaacctggcggaaagagttctcgactggctggagaaacatggagccgaacgccttaagcggatggctatttccggcgacgattgtgtggtcaaacccatcgacgatagatttgccacagctctgaccgccctcaatgacatggggaaggtgcgcaaagatattcctcaatgggagccctctaagggctggaacgactggcagcaggttcctttctgcagccaccactttcatcagctgatcatgaaggatggacgggaaattgtggtcccctgtagaaatcaagacgagctggtgggccgcgcgcgggtctcccagggggccggatggagcctcagagagacagcttgcctgggcaaatcttatgcccagatgtggcaacttatgtacttccaccgccgggatctgagactcgctgccaacgctatctgttccgccgtgccggttgactgggtgcctaccagccgcacgacatggtctatccatgcgcaccaccagtggatgaccaccgaagatatgctgtccgtctggaatcgggtgtggattgaggaaaacccctggatggaggacaagacacatgttagctcctgggaagaggtgccctatcttgggaaaagagaggaccagtggtgcggatctctgatcggcctcaccgcccgggctacatgggccacgaatattcaggtcgccatcaaccaagtgagacgcctgattgggaatgaaaactacctggattacatgaccagcatgaagcggtttaaaaatgagtccgaccctgaaggcgctctctggtga

SEQ ID NO: 18795 - RNA, 9879 nt, synthetic construct
  misc_feature 1..9879: note = derived and/or modified CDS sequence (opt5) from DENV-1__JN819414__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgtacgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcatgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtatgaaaacctgaaatactctgtgatcgtcacggtgcacaccggcgatcagcaccaagttgggaatgagacaaccgaacatggaacaatcgctaccattacgccccaggcccctacctccgagatccagctgacagactatggcgccctcaccctggactgtagcccccggacaggccttgatttcaacgaaatggtgctgctcaccatgaaggagaaatcttggctggtccacaagcagtggtttcttgacctgcctctcccctggacgtccggggctagcacatcccaagagacctggaatcgccaggatctgctggtgacattcaaaaccgcgcatgccaagaagcaggaagtcgtggttctcggatctcaagagggcgctatgcacaccgccctgacaggggccacggaaattcagaccagcggaacaaccacaatctttgctggccaccttaaatgcagactgaagatggacaaactcaccctgaaggggatgtcctacgtgatgtgtacgggcagcttcaaactggagaaggaagtcgccgagacacagcatggaaccgtgcttgttcaggtgaagtatgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctacatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccaccaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctatctgggggttatggtgcaggccgactctggatgcgtcattaactggaaaggccgcgaactgaagtgtgggtccggaatcttcgtgaccaacgaggttcatacatggaccgaacaatacaagtttcaggctgatagccctaaacggctctccgccgcgattggcaaggcctgggaggagggggtgtgcggcatcagatctgctacgcgcctggaaaatattatgtggaaacagatcagcaacgagcttaatcacatcctgctcgaaaacgacatgaagttcacagtcgtggtgggagacgccaatggcattctggctcaggggaaaaagatgatccggccgcaacccatggagcataaatattcctggaagtcttggggaaaggccaaaattatcggcgccgatattcagaacaccacctttatcatcgacgggcctgatacacccgaatgtcctgacggacagagagcttggaatatttgggaggtcgaggattacggcttcggcatctttaccacgaacatttggctgaagcttcgcgacagctatacacagatgtgcgatcaccggctcatgtccgcggccatcaaagacagcaaggctgttcacgccgatatggggtactggattgaatctgagaaaaatgaaacctggaagctggccagagcttccttcatcgaggtgaagacatgtacctggcccaaaagccatacactgtggtctaacggagtgctcgaatccgagatgatcattccgaagatctatggcgggcctattagccaacacaattaccgccccggatacttcacccagacggccggcccttggcatctggggaaacttgagctggactttgatctctgcgaaggaaccacagtcgtggttgacgagcactgcggcaaccggggcccctctctgagaaccacaaccgtgacggggaagatcattcacgaatggtgttgccggagctgtacactgcctccccttcgcttcagaggagaggatggctgctggtatgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatacctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccatcagctgtggacaaccctcctgagcctgacgtttgttaaaacaaccctttccctggattatgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttacgtgattagcggctccagcgccgatctgctcctggagaaagctgccgaagtctcttgggagcaggaagctgagcacagcggggcctcccataatatccttgtggaagttcaagacgatggaacaatgaagattaaagacgaggagagagatgacaccctgacgatcctcctgaaggccaccctcctggctgtgtctggcgtctatcccatgagcattcctgcgacactttttgtgtggtacttctggcagaaaaagaagcagcggtccggcgtcctgtgggataccccctctccgcctgaagtggagcgcgccgttctggacgatgggatctatagaatcctccagcggggactgcttggccgcagccaagtgggggtcggagtgttccaggacggcgtttttcacacaatgtggcatgtgaccagaggggctgtcctgatgtaccagggaaaacggctcgaaccctcctgggcctctgtgaagaaagacctgattagctacggcggcgggtggagattccagggatcctggaacacaggcgaggaggtgcaagttatcgccgtcgaacctgggaagaatcccaaaaacgtgcagacgaccccgggaacatttaagacccctgagggcgaagtgggggctattgccctcgatttcaagcccggaaccagcggctctcctatcgtcaatcgcgagggcaaaattgtggggctgtatggaaacggcgttgtgacaacggggggaacctacgtctccgcgatcgctcaggccaaggccagccaagaaggcccccttcccgagattgaggacgaagtgtttaaaaagcggaatctgacaatcatggatctgcaccctgggtctggcaaaaccagacgctatctcccggctatcgttcgggaggccattaagagaaagctgcgcacacttatcctggcgcccacccgggtggtcgcttccgaaatggccgaggccctcaaaggaatgcctattagataccagacgacagctgtgaagagcgaacacaccggccgcgagatcgttgacctgatgtgccatgccaccttcacaatgcggctgctctcccccgtgagagtccctaactataatatgattatcatggatgaggctcactttaccgaccccgcctctatcgcggcccgggggtacattagcacacgcgtgggaatgggcgaagctgccgctatcttcatgaccgccacgcctccggggtccgtggaggcctttccccagagcaacgctgtcattcaggatgaagagagagacatccctgaacggtcttggaattccggatatgattggattacagacttccccggcaaaaccgtttggtttgtgcctagcatcaagtctgggaacgatatcgcgaattgtcttcgcaaaaacggcaagagagtgattcaactgagccggaagacattcgacaccgagtaccagaaaacgaagaacaatgactgggattacgtcgtgaccacagacatctccgagatgggagccaacttcagagctgatcgcgttattgacccccggagatgcctgaaaccggtgatcctcaaggatggccctgaacgcgtcattctggccgggcccatgcccgtgaccgttgcctctgctgcccagcggagaggacgcatcggccggaatcagaacaaagagggggaccaatatgtgtacatgggacagcctcttaataacgatgaagaccatgcgcactggacagaggctaagatgctgctcgataatattaacacccccgagggcatcatccctgccctgtttgaaccggagagagaaaagagcgccgctattgacggggagtatcgcctgagaggcgaagcccggaaaacattcgtcgagctcatgcgcagaggagatcttcccgtgtggctgtcctacaaggtcgcgtctgagggctttcagtatagcgaccggcgctggtgcttcgatggggaaagaaataaccaggtgctggaggaaaatatggacgttgagatctggaccaaagaaggagagcggaagaaactcagacctcgctggctggacgcccggacgtactccgatccccttgctctgagagagtttaaggaattcgccgctggccgccggagcgtgtctggggacctcattctggagatcggaaaactgcctcaacatctcacacttagagcccagaacgctctggataatctggtgatgctccacaactccgaacagggcggcaaggcctatcggcacgcgatggaggaactgcccgacaccattgagacccttatgctgctcgccctgatcgctgtcctgacagggggagttaccctctttttccttagcggcaaggggctgggaaaaacatccatcggcctgctctgtgtgacggcctctagcgctctgctttggatggcctccgtggagccgcattggattgccgcttctatcattctggaatttttcctcatggtcctgctgatccctgagcccgatcgccagagaacccctcaagacaatcagctcgcgtacgtggttattgggcttctgtttatgatcctgacagtggccgctaacgaaatgggactcctggagaccacaaagaaagatcttggcatcggctacgtcgccgccgagaaccaccagcatgctaccatgctggacgtggatctccggcccgccagcgcgtggacgctgtatgccgtcgctaccacagtgattacccctatgatgcgccacacaatcgaaaataccacggccaacatttccctgacagctatcgccaatcaagcggccattctcatggggcttgacaagggatggcccatcagcaaaatggatattggcgttccgctgctggctctcgggtgctactctcaggtgaaccctctgacccttacagccgctgtcctgatgctcgtggcccactatgctatcatcggacccggcctgcaggccaaggcgaccagagaggcccagaagcggaccgctgccgggattatgaaaaatcccacagttgacggaatcgtggctattgatctggaccctgtcgtgtacgacgccaagttcgaaaaacaactcggccagatcatgcttctgattctgtgtacgtcccagatcctcctgatgcgcaccacatgggccctttgcgagagcatcaccctggcgacaggcccgctcaccacgctgtgggaagggtctcccggaaagttttggaacacaaccattgctgtgtccatggccaatatcttcagaggcagctatctggctggggccggactcgccttctctcttatgaaaagcctgggcgggggacggcgcggcaccggcgctcagggggagacactgggagagaagtggaagagacaactcaaccagctgtccaaatctgaatttaatacctacaagcggagcggcattatggaggttgatagatccgaagccaaagaggggcttaagcgcggagaaacaacgaaacatgcggtcagccggggcaccgccaagctgagatggttcgtggagcgcaacctcgtgaagcctgaggggaaagtcatcgacctgggatgtggccggggcgggtggtcctattactgcgctggactgaagaaagttacagaagtgaagggctacaccaaagggggacccggccacgaggaacctattcccatggccacatatgggtggaatctcgtgaagcttcattctggaaaagatgtctttttcatgcctccggagaagtgtgacaccctgctgtgcgatatcggcgaaagctcccccaaccctacgatcgaggagggcagaaccctccgcgtgctgaagatggttgaaccctggcttaaagggaatcagttttgtattaagatcctgaacccttacatgccctctgtggtcgagacactcgaacagatgcaacggaaacacggaggcatgctggtgagaaatccgctgagccgcaactccacccatgagatgtattgggtttcttgcgggacaggaaatattgtgagcgctgtcaacatgacctcccggatgctcctgaacagattcacaatggcccaccgcaagcctacctacgagcgggacgtggatcttggcgcggggacgagacacgtggccgtcgaacccgaggttgctaatctggacatcattggacagcgcatcgaaaacattaaaaatgagcataagagcacatggcactatgatgaagacaacccctacaagacctgggcctatcatggctcttacgaggtgaaaccttccggcagcgcttcttccatggtgaatggggtcgtgagactcctgaccaagccctgggatgttatccctatggtgacacagatcgccatgacggacaccacaccgtttggacaacagcgggtcttcaaagagaaggtggacacccgcacacccagagctaaacggggcaccacacagattatggaagttaccgccaagtggctttgggggtttctgagcagaaacaagaaacctcggatctgtacgcgcgaggaattcaccagaaaggtgcggtctaatgcggccattggagctgtctttgtggatgagaaccagtggaatacagccaaagaagctgttgaggacgagcgcttctgggatctcgtgcacagagaacgggagctgcacaagcaaggcaaatgcgccacctgcgtctacaacatgatggggaagcgcgaaaagaaactgggcgagtttggaaaggccaaaggctccagagcgatctggtatatgtggctcggggctcggttcctggaattcgaggcccttggatttatgaatgaggaccattggttcagccgcgaaaactccctgagcggcgtggagggggaaggactccacaagctgggctacattcttagagatatctctaaaatccccgggggcaatatgtatgccgacgatacagctggatgggacacccggattacggaggatgacctgcagaacgaggccaagatcacagatattatggaacctgagcatgctctcctggccaccagcatctttaaactgacataccagaataaggtcgtgcgcgttcagagacccgcgaagaacggcaccgtgatggacgtcatttcccggcgcgatcaaagagggtctggacaggtgggcacgtatgggctcaacaccttcacaaatatggaagtgcagctgatccggcagatggagagcgaaggaatctttcttccgtccgagctggagacccctaacctcgccgaaagagctctggactggcttgagaaacacggcgccgaacgcctgaagcggatggctatttctggggacgattgtgttgtgaaacccatcgacgatagattcgccacagcgctcaccgccctgaatgacatgggcaaggtccgcaaagatattcctcaatgggagcccagcaagggatggaacgactggcagcaggtgcctttttgctcccatcacttccaccagctgatcatgaaggatggccgggaaattgttgtgccctgtagaaatcaagacgagctcgtcgggcgcgctcgggtgtctcagggagccggctggagcctgagagagacagcttgccttgggaaatcctacgcccagatgtggcaactgatgtattttcatcgccgggatctcagactggctgccaacgcgatctgtagcgccgtcccggtggactgggttcctacctctcgcacgacatggtccatccacgctcatcaccagtggatgaccaccgaagatatgcttagcgtgtggaatcgggtctggattgaggaaaacccctggatggaggacaagacacacgtgtcttcctgggaagaggttccctacctgggaaaaagagaggaccagtggtgcggcagcctcatcgggctgaccgcccgggccacatgggctacgaatattcaggtggccatcaaccaagtcagacgcctgattggcaatgaaaactacctcgattatatgacctccatgaagcggttcaaaaatgagtctgaccctgaaggagcgctgtggtga

SEQ ID NO: 18796 - RNA, 9879 nt, synthetic construct
  misc_feature 1..9879: note = derived and/or modified CDS sequence (opt5) from DENV-1__FJ873810__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgttggcgtgaatatgtgcaccctgattgccatggacctcggggagctgtgtgaagatacaatgacctacaaatgccccagaatcacagaggcggaacccgacgatgtggactgttggtgcaatgctaccgatacgtgggtcacctatggaacatgttcccagaccggcgagcaccggcgggagaagcgctctgtggccctggcccctcatgttgggctcggactggaaacaagaaccgagacgtggatgagctccgaaggcgcttggaaacagattcagcgggtggagacatgggcccttcgccaccccggcttcaccgtcatcgcctttttcctggcccatgcgattgggacatctatcacccagaagggaatcatttttatcctcctgatgcttgtgacccctagcatggccatgagatgcgttggcattgggaatcgggacttcgtggagggactgtccggcgctacatgggtcgatgtggtgctcgaacacgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtacgagaacctcaaatattctgtcatcgtgacggttcacaccggcgaccagcatcaagtggggaatgaaacaaccgagcacggaacaatcgccaccattacgccccaggctcctacctccgaaatccagctgacagattacggcgccctgaccctcgactgtagcccccggacaggcctggactttaacgagatggtccttctgaccatgaaggagaaatcttggctcgtgcataagcagtggttcctggatcttcctctgccctggacgtccggggccagcacatcccaagaaacctggaatcgccaggacctcctggtcacatttaaaaccgctcacgcgaagaagcaggaggtggttgtgctgggatctcaagaaggcgccatgcacaccgctctcacaggggccacggagattcagaccagcggaacaaccacaatcttcgccggccatctgaaatgcagacttaagatggataaactgaccctcaaggggatgtcctatgtcatgtgtacgggcagcttcaaactggaaaaggaggtggctgagacacagcacggaaccgttctggtgcaggtcaagtacgaaggcaccgacgccccgtgcaaaattcctttttctacacaagatgagaagggggtgacccagaacggacggcttatcacagcgaatcccatcgtgacggacaaagaaaagcctgttaacattgagaccgagccgcccttcggcgaatcctatatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcatcaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttacctcggggtgatggtccaggctgattctggatgcgtgattaactggaagggccgggagctgaaatgtgggtccggaatctttgttaccaacgaagtgcacacatggaccgagcaatataagttccaggccgacagccctaagagactgtccgctgccattggcaaagcgtgggaggaaggggtctgcggcatccgctctgccacgcggctcgagaatattatgtggaagcagatcagcaacgaactgaatcatatccttctggagaacgatatgaaatttacagtggtggtcggagacgctaatggcattctcgcccaggggaagaaaatgatcagaccgcaacccatggaacacaagtactcctggaaatcttggggaaaggctaagattatcggcgccgacattcagaacaccaccttcatcatcgatgggcctgacacacccgagtgtcctgatggacagcgcgcctggaatatttgggaggttgaagactatggctttggcgtgttcaccacgaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacactgtggtctaacggagtgctggagtccgagatgatcatcccgaaaatttacggcgggcctatcagccaacataattatcggcccggatactttacccagacggctggcccttggcacctcgggaagctggaacttgatttcgacctgtgcgagggaaccacagttgtggtcgatgaacactgcggcaacagaggcccctctctccggaccacaaccgtgacggggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggatctggcgaagtggattccttcagcctcgggatcctgtgtgtttccatcatgattgaggaggtgatgcggtctagatggagccgcaagatgctgatgaccggaacactcgcggtctttctgcttctgatcatgggccagctcacctggaacgacctgattagactgtgcatcatggtgggcgctaatgcctccgaccggatggggatgggaaccacatatcttgccctgatggctacgttcaagatgcgccctatgtttgccgtgggcctcctgttcagacggctcacctctcgcgaagtcctgcttctgacaattgggctcagcctggttgcgtccgtggagctgcccaactctcttgaagaactgggagatggcctcgctatggggatcatgatgctgaaactcctgaccgaatttcaaccccaccagctttggacaaccctgctcagcctgacgttcgtgaagacaaccctgtcccttgactacgcctggaaaaccacagccatggtcctgagcattgtgtctctctttcctctgtgtctctccaccacaagccagaagacgacctggctgccggttcttctgggatctttcggctgcaaacccctgacaatgtttctcatcaccgagaacaagatctggggcagaaagtcctggcctctgaatgaggggattatggctatcggaattgtgagcatccttctgtcttccctcctgaaaaacgatgtccccctcgccggccctctgattgctgggggaatgcttatcgcctgttatgtgatcagcggctccagcgcggacctgtctctggaaaaggccgctgaggttagctgggaacaggaggccgaacattccggggcttctcacaatattctcgtggaggtccaagatgacggaacaatgaaaatcaaggatgaggaacgggacgataccctgacgattcttctgaaagccaccctcctggccgtgagcggcgtctaccccatgtccatccctgctacactcttcgtgtggtatttctggcagaagaaaaagcagcgctctggcgttctgtgggacacccccagcccgcctgaggtggaaagagcggtccttgatgacgggatttaccggatcctgcagcgcggactgctcggcagatcccaagtgggggttggagtgtttcaggatggcgtcttccatacaatgtggcacgtgaccagaggggctgtgctgatgtatcagggaaagagacttgagccctcttgggctagcgttaaaaaggacctgatctcctacggcggcgggtggcgctttcagggaagctggaacacaggcgaggaagtccaagtgattgccgtggagcctgggaaaaatcccaagaacgtccagacgaccccgggaacattcaaaacccctgaaggcgaggtgggggccatcgctctcgactttaagcccggaacctctggctcccctattgttaatcgggaaggcaagatcgtggggctgtacggaaacggcgtcgtgacaacgagcgggacctatgtttctgccattgcgcaggctaaagcctcccaagagggacccctccccgagatcgaagatgaggtgttcaagaaaagaaatctgacaattatggaccttcaccctggcagcgggaagacccgccggtacctgccggccatcgtcagagaagctatcaaacgcaagctgcggacactcattctggcccccaccagagtggttgcgtccgagatggctgaagcccttaagggcatgcctatccgctatcagacgacagccgtgaaatctgagcataccggacgggagattgtcgatctgatgtgccacgctacctttacaatgagactcctgagccccgtgcgggtgcctaactacaatatgatcattatggacgaagcccatttcaccgatcccgcttccatcgccgcgcgcggctatatcagcacaagagtcgggatgggagaggccgctgccatttttatgaccgctacgcctccgggctctgttgaagccttcccccagtccaacgccgtgatccaggacgaggaacgggatattcctgagcgcagctggaactctgggtacgactggatcacagattttcccggaaagaccgtgtggttcgtccctagcattaaatccggcaacgacatcgctaattgtctgagaaagaacgggaaacgggtgatccaactctctagaaagacattcgataccgagtatcagaagacgaaaaacaatgactgggactacgttgtgaccacagatattagcgaaatgggcgcgaactttcgcgccgaccgggtcatcgatcccagacgctgccttaagccggtgattctgaaagacggacctgagcgggttatcctggctggccccatgcccgtgaccgtcgcctccgccgctcagagacgcgggcggattggaagaaatcagaacaaggaaggcgatcaatacgtgtatatggggcagcctctcaataacgacgaggatcacgcccattggacagaggcgaaaatgctgcttgacaatatcaacacccccgaaggaattatccctgctctgttcgagccggaacgcgagaagtctgccgccatcgatggcgaatacagactcagaggggaagctcgcaagacatttgtcgagctgatgagacggggcgacctgcccgtgtggctcagctataaagttgcctccgaaggattccagtacagcgatcgcagatggtgctttgacggcgagcggaataaccaggtgcttgaagagaatatggatgtggaaatttggaccaaggagggggagcgcaagaaactgcgccctcggtggctggacgcgagaacgtattctgaccccctcgccctgcgcgagttcaaagagtttgctgccggacggagatccgtcagcggcgatcttatcctggaaattgggaaactccctcaacacctgacactgcgggctcagaacgccctcgacaatcttgttatgctgcacaactccgagcagggaggcaaggcttaccgccatgccatggaggaactgcccgataccatcgagaccctcatgctgcttgcgctgattgccgtgctcacaggcggggtgaccctgttctttctgtctggaaagggcctcgggaagacaagcatcggacttctgtgtgtcacggcttcctctgccctgctctggatggctagcgtggaaccgcactggatcgccgcctccattatcctggagttctttcttatggttctgctcattcctgaacccgacagacagcggacccctcaagataatcagctggcttatgtggtcatcggcctcctgttcatgattcttacagtggcggccaacgagatggggctgctggagaccaccaaaaaggacctcggaatcggctacgtcgctgccgaaaaccatcagcacgccaccatgctggatgtggaccttcaccccgctagcgcctggacgctgtacgcggttgccaccacagtgatcacccctatgatgcgccatacaattgagaataccacggctaacatctctctcacagccattgctaatcaagccgcgatcctgatgggcctggataaagggtggcccatttccaagatggacatcggagtcccgctccttgccctgggctgctatagccaggtgaaccctctgaccctcacagctgccgttctgatgcttgtggctcactacgccattatcgggcccggactgcaggctaaagccaccagagaagcgcagaagcggaccgccgctggcatcatgaagaatcccacagtcgatgggattgtggccatcgacctcgatcctgtggtttatgacgctaaatttgagaagcaactgggacagattatgctgctcatcctttgtacgtctcagattctgctgatgcgcaccacatgggccctctgcgaatccatcaccctggccacaggcccgcttaccacgctgtgggagggcagccccgggaaattctggaacacaaccatcgcggtctctatggctaatattttcagaggaagctacctcgccggcgctgggctggccttttccctgatgaagtctctcggaggcgggcggcgcggaaccggcgcccagggcgagacacttggggaaaaatggaagagacaactgaaccagctgagcaagtccgagttcaatacctataaacggagcggaatcatggaagtggacagatccgaggctaaggaaggcctcaaacgcggggagacaacgaagcatgccgtgtctcggggaaccgcgaaactgagatggtttgtcgagcgcaaccttgttaagcctgaaggcaaggtgattgatctggggtgtggacggggcggctggagctactattgcgccgggctcaaaaaggtgacagaggtcaaaggatacaccaagggcgggcccggacacgaggaacctatccccatggctacatacggctggaatctggtgaaactgcattccgggaaggacgttttctttatgcctccggaaaaatgtgataccctcctttgcgacattggagagtctagccccaaccctacgatcgaggaaggcagaaccctgcgcgtgctgaagatggtcgagccctggctccggggcaatcagttctgtatcaagattctgaacccttatatgccctccgtggttgaaacacttgagcagatgcaaagaaaacacgggggaatgctggtgcgcaatccgctctctcggaacagcacccacgagatgtactgggtctcctgcggcacagggaatatcgtgagcgccgtgaacatgacctctagaatgctgctgaaccgctttacaatggctcatcggaagcctacctatgaaagagatgtcgacctcggagccggcacgcgccacgttgcggtggagcccgaagtggccaatctggatattatcgggcagagaattgagaacatcaaaaatgaacataagtccacatggcactacgacgaggataacccctataaaacctgggcttaccacggaagctatgaggtcaagccttctggctccgccagctctatggtgaatggcgttgtgcggcttctgaccaagccctgggacgtcattcctatggtgacacagatcgctatgacggataccacaccgttcgggcaacagcgcgtttttaaagaaaaggtggacaccagaacaccccgggccaaaagaggaaccacacagatcatggaggtcaccgctaagtggctctggggcttcctgtcccggaacaaaaagcctcgcatttgtacgagagaagagtttacccggaaggtgcgcagcaatgccgcgatcggggccgttttcgtggacgaaaaccagtggaactccgctaaagaggccgtcgaggatgaaagattttgggaccttgtgcatcgggagcgcgaactgcacaagcaaggaaaatgcgctacatgcgtctacaacatgatgggcaagagagagaaaaagctcggggagttcggcaaggccaaaggaagccgggccatttggtacatgtggctgggcgcgcgcttcctggagtttgaggctctcgggttcatgaatgaagatcattggttttctagagagaacagcctgtccggagtggaaggcgaggggcttcacaagctgggatatatcctccgggacatttctaaaatccccggcgggaatatgtacgccgatgacaccgccggctgggatacacgcatcaccgaggacgatctgcagaacgaagctaagattacggacatcatggagcctgaacatgcccttctggctacaagcattttcaaactcacctatcagaataaggttgtgagagtccagcggcccgccaaaaacggaacagtgatggatgtgatctcccgcagagaccaacggggctctgggcaggttggaacctacggcctgaacacgtttaccaatatggaggtgcagctgattagacagatggaaagcgaggggatcttcctcccgtccgagctggaaacacctaaccttgcggagcgcgccctggattggctcgaaaagcacggagctgagcggctgaagagaatggccatctctggcgacgactgtgtcgtgaaacccattgatgaccgctttgctaccgcccttacagcgctgaatgatatggggaaggttcggaaagacatccctcaatgggaacccagcaagggctggaacgattggcaacaggtgcctttctgctcccaccattttcaccagctcattatgaaagacggaagagagatcgtcgtgccctgtcgcaatcaagatgagctggtcggccgggccagagtgagccagggggctggatggtctctgcgcgaaaccgcctgcctcggcaagtcctatgctcagatgtggcaactgatgtacttccatcggagagaccttcgcctggccgctaacgccatttgtagcgcggttccggtggattgggtccctacatctcggaccacgtggtccatccacgcccaccatcagtggatgacaaccgaggacatgctcagcgtgtggaatagagtttggatcgaagagaacccctggatggaagataagacccacgtgtcctcttgggaggaggtcccctatctggggaaacgggaagaccagtggtgcggaagccttattggcctgacagctagagccacctgggccacaaatatccaggtggctattaaccaagtgcgccggctcatcgggaatgagaactacctggactacatgacgtccatgaagagatttaaaaatgaaagcgatcctgagggcgccctgtggtga

SEQ ID NO: 18797 - RNA, 9879 nt, synthetic construct
  misc_feature 1..9879: note = derived and/or modified CDS sequence (opt5) from DENV-1__FJ850103__SS-prME
  source 1..9879: mol_type = other RNA
agcgtgaccatgctgctcatgctgcttcccacagccctggctttccacctcacgacccggggcggggagcctcatatgatcgtctccaagcaggaacgggggaagtctctgctttttaagacaagcgccggcgttaacatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcaccggcgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtatctggcccaagagccacaccctgtggtctaacggagtcctggagtccgagatgatcattccgaaaatctacggcgggcctattagccaacataattatcggcccggatactttacacagaccgccggcccttggcacctcgggaagctggaacttgatttcgacctgtgcgagggaacgaccgtggttgtggatgaacactgcggcaacagaggcccctctctccggacaaccacagtcaccgggaaaatcattcatgagtggtgttgccgcagctgtacgctgcctcccctgagatttcggggagaggacggctgctggtacgggatggaaatcagaccggtgaaggagaaagaagagaatcttgttcgctccatggtgagcgcgggatctggcgaagtcgattccttcagcctcgggatcctgtgtgtgtccattatgatcgaggaggttatgcggtctagatggagccgcaagatgctgatgacaggaaccctcgctgtgtttctgcttctgattatgggccagctcacatggaacgacctgatcagactgtgcattatggtcggcgccaatgcctccgaccggatggggatgggaaccacctatcttgctctgatggccacattcaagatgcgccctatgtttgcggtgggcctcctgttcagacggctcacgtctcgcgaagtgctgcttctgaccatcgggctcagcctggtcgcttccgttgagctgcccaactctcttgaagaactgggagatggcctcgccatggggattatgatgctgaaactcctgacagaatttcaaccccaccagctttggaccacactgctcagcctgaccttcgtgaagacgacactgtcccttgactacgcctggaaaaccaccgctatggtgctgagcatcgtctctctctttcctctgtgtctctccacaaccagccagaagacaacgtggctgccggtgcttctgggatctttcggctgcaaacccctgaccatgtttctcatcacagagaacaagatttggggcagaaagtcctggcctctgaatgaggggatcatggccattggaatcgttagcattcttctgtcttccctcctgaaaaacgatgtgcccctcgctggccctctgatcgccgggggaatgcttatcgcgtgttatgtcattagcggctccagcgccgacctgtctctggaaaaggctgccgaggtgagctgggaacaggaggctgaacattccggggcctctcacaatatcctcgttgaggtgcaagatgacggaaccatgaaaattaaggatgaggaacgggacgatacactgaccatccttctgaaagccacgctcctggctgtcagcggcgtgtaccccatgtccattcctgcgaccctcttcgtctggtatttctggcagaagaaaaagcagcgctctggcgtgctgtgggacacacccagcccgcctgaggttgaaagagccgtgcttgatgacgggatctaccggatcctgcagcgcggactgctcggcagatcccaagtcggggtgggagtttttcaggatggcgtgttccataccatgtggcacgtcacaagaggggctgtgctgatgtatcagggaaagagacttgagccctcttgggccagcgtgaaaaaggacctgatttcctacggcggcgggtggcgctttcagggaagctggaacaccggcgaggaagttcaagtcatcgccgtggagcctgggaaaaatcccaagaacgtgcagacaacgccgggaaccttcaaaacacctgaaggcgaggtcggggctattgccctcgactttaagcccggaacctctggctcccctatcgtgaatcgggaaggcaagattgttgggctgtacggaaacggcgtggtcaccacaagcgggacgtatgtgtctgcgatcgctcaggccaaagcctcccaagagggacccctccccgagattgaagatgaggttttcaagaaaagaaatctgaccatcatggaccttcaccctggcagcgggaagacacgccggtacctgccggctatcgtgagagaatccattaaacgcaagctgcggaccctcatcctggcccccacaagagtcgtggcgtctgagatggctgaagcccttaagggcatgcctattcgctatcagaccacggccgttaaaagcgagcatacaggacgggagatcgtggatctgatgtgccacgctacctttaccatgagactcctgtcccccgtccgggtgcctaactacaatatgattatcatggacgaagcccatttcacagatcccgctagcatcgccgcgcgcggctatatttctaccagagtggggatgggagaggccgctgccatctttatgacagctacccctccgggctccgtcgaagccttcccccagagcaacgccgttattcaggacgaggaacgggatatccctgagcgctcttggaatagcgggtacgactggattacggattttcccggaaagacagtgtggttcgtgccttccatcaaatctggcaacgacatcgctaattgtctgagaaagaacgggaaacgggtcattcaactcagcagaaagaccttcgatacagagtatcagaagaccaaaaacaatgactgggactacgtggttacgaccgatatctccgaaatgggcgcgaactttcgcgccgaccgggtgattgatcccagacgctgccttaagccggtcatcctgaaagacggacctgagcgggtgattctggctggccccatgcccgttacagtggcctctgccgctcagagacgcgggcggatcggaagaaatcagaacaaggaaggcgatcaatacgtctatatggggcagcctctcaataacgacgaggatcacgcccattggaccgaggcgaaaatgctgcttgacaatattaacacacccgaaggaatcatccctgctctgttcgagccggaacgcgagaaaagcgccgccattgatggcgaatacagactcagaggggaagctcgcaagacctttgtggaactgatgagacggggcgacctgcccgtctggctctcctataaagtggccagcgaaggattccagtactctgatcgcagatggtgctttgacggcgagcggaataaccaggttcttgaagagaatatggatgtggaaatctggacaaaggagggggagcgcaagaagctgcgccctcggtggctggacgcgagaacctattccgaccccctcgccctgcgcgagttcaaagagtttgctgccggacggagaagcgtgtccggcgatcttattctggaaatcgggaagctccctcaacacctgacgctgcgggctcagaacgccctcgacaatcttgtcatgctgcacaactctgagcagggaggcaaggcttaccgccatgccatggaggaactgcccgatacaattgagaccctcatgctgcttgcgctgatcgccgttctcaccggcggggtgacactgttctttctgagcggaaagggcctcgggaagacctccatcggacttctgtgtgtgacagcttctagcgccctgctctggatggcttccgtcgaaccgcactggattgccgccagcatcattctggagttctttcttatggtgctgctcatccctgaacccgacagacagcggacgcctcaagataatcagctggcttatgttgtgattggcctcctgttcatgatccttaccgtcgcggccaacgagatggggctgctggagacaaccaaaaaggacctcggaatcggctacgtggctgccgaaaaccatcagcacgccacaatgctggatgtcgaccttcaccccgcttctgcctggaccctgtacgcggtggccacgaccgttattacacctatgatgcgccataccatcgagaatacaaccgctaacatttccctcacggccatcgctaatcaagccgcgattctgatgggcctggataaagggtggcccatcagcaagatggacattggagtgccgctccttgccctgggctgctattctcaggtcaaccctctgacactcaccgctgccgtgctgatgcttgttgctcactacgccatcatcgggcccggactgcaggctaaagccacaagagaagcgcagaagcggaccgccgctggcattatgaagaatcccaccgtggatgggatcgtcgccattgacctcgatcctgtggtgtatgacgctaaatttgagaagcaactgggacagatcatgctgctcattctttgtacatcccagatcctgctgatgcgcacgacctgggccctctgcgaaagcatcacactggccaccggcccgcttacaaccctgtgggagggctctcccgggaaattctggaacacgacaattgcggttagcatggctaatatcttcagaggatcctacctcgccggcgctgggctggccttttctctgatgaaaagcctcggaggcgggcggcgcggaaccggcgcccagggcgagacccttggggaaaaatggaagagacaactgaaccagctgtccaagagcgagttcaatacatataaacggtccggaattatggaagtcgacagatctgaggctaaggaaggcctcaaacgcggggagaccacaaagcatgccgtgagccggggaacggcgaaactgagatggtttgtggagcgcaaccttgtcaagcctgaaggcaaggttatcgatctggggtgtggacggggcggctggtcctactattgcgccgggctcaaaaaggtgaccgaggtgaaaggatacacaaagggcgggcccggacacgaggagcctattcccatggctacctacggctggaatctggtcaaactgcattctgggaaggacgtgttctttatgcctccggaaaaatgtgatacactcctttgcgacatcggagagagctcccccaaccctaccatcgaggaaggcagaacgctgcgcgttctgaagatggtggagccctggctccggggcaatcagttctgtattaagatcctgaacccttatatgccctctgtcgtggaaacccttgagcagatgcaaagaaaacacgggggaatgctggttcgcaatccgctcagccggaactccacacacgagatgtactgggtgagctgcggcaccgggaatattgtctctgccgtgaacatgacatccagaatgctgctgaaccgctttaccatggctcatcggaagcctacatatgaaagagatgtggacctcggagccggcacccgccacgtcgcggttgagcccgaagtggccaatctggatatcattgggcagagaatcgagaacattaaaaatgaacataagagcacgtggcactacgacgaggataacccctataaaacatgggcttaccacggatcttatgaggtgaagccttccggcagcgcctcttccatggtcaatggcgtggttaaacttctgaccaaaccctgggacgtgatccctatggtcacccagatcgctatgacagatacgaccccgttcgggcaacagcgggtgtttaaggaaaaagttgacacacgcacccccagagccaagcggggaacaacccagattatggaggtgacagctaaatggctctggggcttcctgagcagaaacaagaagcctcggatctgtacccgcgaagagtttacgagaaaagtccggtccaatgccgcgattggggccgtgttcgttgacgaaaaccagtggaatagcgctaaggaggccgtggaggatgaacgcttttgggaccttgtccatagagagcgggaactgcacaaacaaggaaagtgcgctacctgcgtgtacaacatgatgggcaaacgcgagaagaagctcggggagttcggcaaagccaagggatctagagccatctggtacatgtggctgggcgcgcggttcctggagtttgaggctctcgggttcatgaatgaagatcattggtttagccgcgagaactccctgtctggagtcgaaggcgaggggcttcacaaactgggatatattctcagagacatcagcaagatccccggcgggaatatgtacgccgatgacacagccggctgggatacccggattacagaggacgatctgcagaacgaagctaaaatcaccgacattatggagcctgaacatgcccttctggctacgtccatcttcaagctcacatatcagaataaagtggttcgcgtgcagagacccgccaagaacggaaccgtcatggatgtgatttctcggcgcgaccaaagaggcagcggacaggtgggaacatacggcctgaacacctttacgaatatggaggttcagctgatccggcagatggaatccgaggggatcttcctcccgtctgagctggaaacccctaaccttgcggagagagccctggattggctcgaaaagcacggagctgagcgcctgaaacggatggccattagcggcgacgactgtgtggtcaagcccatcgatgacagatttgctacagcccttaccgcgctgaatgatatggggaaagtgcgcaaggacattcctcaatgggaaccctccaaaggctggaacgattggcagcaggttcctttctgcagccaccattttcaccagctcatcatgaaggacggacgggagattgtggtcccctgtagaaatcaagatgagctggtgggccgcgcccgggtctctcagggggctggatggtccctgagagaaacagcctgcctcggcaagagctatgctcagatgtggcaactgatgtacttccatcgccgggaccttagactggccgctaacgccatctgttctgcggtgccggttgattgggtgcctacctcccgcacaacctggagcatccacgcccaccatcagtggatgacgacagaggacatgctctccgtctggaatcgggtgtggattgaagagaacccctggatggaagataaaacccacgtttctagctgggaggaggtgccctatctggggaagagagaagaccagtggtgcggatcccttatcggcctgaccgctcgggccacatgggccaccaatattcaggtcgctatcaaccaagtgagacgcctcattgggaatgagaactacctggactacatgacaagcatgaaacggtttaagaatgaatctgatcctgagggcgccctgtggtga

SEQ ID NO: 18798 - RNA, 9879 nt, synthetic construct
  misc_feature 1..9879: note = derived and/or modified CDS sequence (opt5) from DENV-1__FJ850104__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgtgaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagcgggtggaaacatgggcccttcgccaccccggcttcaccgtcatcgctctgtttctcgcccatgcgattgggacatctatcacccagaagggaatcattttcatcctgcttatgctggtgacccctagcatggccatgagatgcgttggcattgggaaccgggattttgtggagggactctccggcgctacatgggtcgacgtggtgctggagcacgggagctgtgtcacgaccatggccaagaataaacccacactggatatcgaactcctgaagaccgaggttacaaaccctgctgtgcttcgcaaactgtgcattgaagccaagatctctaataccacgacagactccagatgtccgacccaaggagaggcgaccctcgtggaagagcaggatgccaacttcgtctgccggcgcacatttgtggacagaggctggggcaatgggtgtggactgttcggcaaagggagccttctgacctgcgctaagtttaagtgcgttacaaaactcgagggaaagattgtgcagtacgaaaacctgaaatattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggccagcacatcccaagagacctggaatcgccaggatctgctggtcacattcaaaaccgctcacgcgaagaagcaggaagtggttgtgctcggatctcaagagggcgccatgcacaccgctctgacaggggccacggaaattcagaccagcggaacaaccacaatctttgccggccatcttaaatgcagactgaagatggacaaactcaccctgaaggggatgtcctatgtcatgtgtacgggcagcttcaaactggagaaggaagtggctgagacacagcacggaaccgttcttgtgcaggtcaagtacgagggcaccgatgccccgtgcaaaattcctttctctacacaagacgaaaagggggtgacccagaacggacggctcatcacagcgaatcccatcgtgacggataaagagaagcctgttaacattgaaaccgagcccccctttggcgagtcctatatcgtcgtgggggctggagaaaaagccctgaagctgagctggttcaagaaaggctctagcattgggaagatgtttgaggccacagctagaggcgcccgccggatggctatcctcggagacaccgcctgggatttcggctccattgggggagtgtttacatctgtcggcaaactggtgcatcaggttttcgggaccgcgtacggagtgctttttagcggcgtctcctggacgatgaagatcgggatcggcattctgctcacctggctgggactgaatagcagatctacatcccttagcatgacctgtatcgccgtgggcatggttacactctacctgggggtgatggtccaggctgactctggatgcgtgattaactggaaaggccgcgaactgaagtgtgggtccggaatcttcgttaccaacgaggtgcacacatggaccgaacaatataagtttcaggccgatagccctaaacggctctccgctgccattggcaaggcgtgggaggagggggtctgcggcatcagatctgccacgcgcctggaaaatattatgtggaaacagatcagcaacgagcttaatcatatcctgctcgaaaacgacatgaagttcacagtggtggtcggagacgctaatggcattctggcccaggggaaaaagatgatccggccgcaacccatggagcacaaatactcctggaagtcttggggaaaggctaaaattatcggcgccgatattcagaacaccacctttatcatcgacgggcctgatacacccgaatgtcctgacggacagagagcctggaatatttgggaggttgaggattatggcttcggcatctttaccacgaacatttggctgaagcttcgcgacagctacacacagatgtgcgatcaccggctcatgtccgctgcgatcaaagacagcaaggccgtgcatgctgatatggggtattggattgaatctgagaaaaatgaaacctggaagctggccagagcctccttcatcgaggtgaagacatgtacctggcccaaaagccacacactgtggtctaacggagtcctcgaatccgagatgatcattccgaagatctacggcgggcctattagccaacataatcaccgccccggatatttcacccagacggctggcccttggcacctggggaaacttgagctggactttgatctctgcgaaggaaccacagtggttgtggacgagcattgcggcaaccggggcccctctctgagaaccacaaccgtcacggggaagatcattcacgaatggtgttgccggagctgtacactgcctccccttcgcttcagaggagaggatggctgctggtacgggatggagatccggccggtgaaagaaaaggaggaaaatctcgttagatccatggtgagcgccggatctggcgaggtcgactcctttagcctggggatcctgtgtgtgtccattatgatcgaagaggttatgcgctctcggtggagcagaaagatgctcatgaccggaacactggcggtgttccttctgctcattatgggccagctgacctggaacgacctgatccgcctttgcattatggtcggcgctaatgcctccgatagaatggggatgggaaccacatacctggccctcatggctacgtttaaaatgcggcctatgttcgccgtgggcctgctctttcgcagactgacctctcgggaggtgcttctgctcacaatcgggctgagcctggtcgcgtccgttgaacttcccaactctctggaggaactcggagacggcctggctatggggattatgatgctcaagctgcttaccgagttccaaccccatcagctgtggacaaccctcctgagcctgacgtttgtgaaaacaaccctttccctggattatgcctggaagaccacagccatggtgctcagcatcgtctctctgttccctctctgtctgtccaccacaagccagaaaacgacctggcttccggtgctgctgggatcttttggctgcaagcccctcacaatgttcctgatcaccgaaaacaagatttggggccgcaaatcctggcctcttaatgaggggatcatggctattggaatcgttagcattctgctctcttccctgctcaagaacgacgtgcccctggccggccctcttatcgctgggggaatgctgatcgcctgttacgtcattagcggctccagcgcggatctgtctctcgagaaagccgctgaagtgagctgggagcaggaagccgagcactccggggcttctcataatatcctggttgaagtgcaagacgatggaacaatgaagattaaagacgaggagagagatgacacccttacgatcctgctcaaggccaccctgctcgccgtcagcggcgtgtatcccatgtccattcctgctacactgtttgtctggtacttctggcagaaaaagaagcagcggtctggcgtgctttgggatacccccagcccgcctgaagttgagcgcgcggtgctggacgatgggatctatagaatcctgcagcggggactcctgggccgctcccaagtcggggtgggagttttccaggacggcgtgtttcacacaatgtggcacgtcaccagaggggccgtgcttatgtaccagggaaaacggctggaaccctcttgggctagcgtgaagaaagacctcatttcctatggcggcgggtggagattccagggaagctggaacacaggcgaggaggttcaagtcatcgccgtggaacctgggaagaatcccaaaaacgtgcagacgaccccgggaacatttaagacccctgagggcgaagtcggggccattgctctggatttcaagcccggaacctctggctcccctatcgtgaatcgcgagggcaaaattgttgggctctacggaaacggcgtggtcacaacgagcgggacctacgtgtctgccatcgcgcaggctaaggcctcccaagaaggacccctgcccgagattgaggacgaagtttttaaaaagcggaatcttacaatcatggatctgcatcctggcagcgggaaaaccagacgctatctgccggccatcgtgcgggaggctattaagagaaagctccgcacactgatccttgcccccacccgggtcgtggcgtccgaaatggctgaggccctgaaaggcatgcctattagataccagacgacagccgttaagtctgaacacaccggacgcgagatcgtggacctcatgtgccatgctaccttcacaatgcggctgctgagccccgtcagagtgcctaactataatatgattatcatggatgaggcccactttaccgaccccgcttccatcgccgcgcggggctacattagcacacgcgtggggatgggagaagccgctgccatcttcatgaccgctacgcctccgggctctgtcgaggcctttccccagtccaacgccgttattcaggatgaagagagagacatccctgaacggagctggaattctgggtatgattggattacagacttccccggaaaaaccgtgtggtttgtgcctagcatcaagtccggcaacgatatcgctaattgtctccgcaaaaacgggaagagagtcattcaactttctcggaagacattcgacaccgagtaccagaaaacgaagaacaatgactgggattatgtggttaccacagacatcagcgagatgggcgcgaacttcagagccgatcgcgtgattgacccccggagatgcctgaaaccggtcatcctgaaggatggacctgaacgcgtgattctcgctggccccatgcccgttaccgtggcctccgccgctcagcggagagggcgcatcggacggaatcagaacaaagagggcgaccaatacgtctacatggggcagcctctgaataacgatgaagaccatgcccactggacagaggcgaagatgcttctggataatattaacacccccgagggaatcatccctgctctctttgaaccggagagagaaaagtctgccgccattgacggcgagtatcgcctgagaggggaagctcggaaaacattcgtggagctgatgcgcagaggcgatctccccgtctggcttagctacaaggtggcctccgagggatttcagtatagcgaccggcgctggtgcttcgatggcgaaagaaataaccaggttctggaggaaaatatggacgtggagatctggaccaaagaaggggagcggaagaaactgagacctcgctggctcgacgcgcggacgtactctgatcccctggcccttagagagtttaaggaattcgctgccggacgccggtccgtgagcggcgacctgattctcgagatcgggaaactgcctcaacacctgacactcagagctcagaacgcccttgataatctggtcatgctgcataactccgaacagggaggcaaggcttatcggcacgccatggaggaactccccgacaccattgagaccctgatgcttctggcgctcatcgccgttctgacaggcggggtgaccctgtttttcctctctggaaagggccttgggaaaacaagcatcggactgctgtgtgtgacggcttcctctgccctcctgtggatggctagcgtcgagccgcattggattgccgcctccatcattcttgaatttttcctgatggtgctcctgatccctgagcccgatcgccagagaacccctcaagacaatcagctggcttacgttgtgattggcctcctttttatgatcctgacagtcgcggccaacgaaatggggctgctcgagaccacaaagaaagatctgggaatcggctatgtggctgccgagaaccaccagcacgccaccatgcttgacgtcgatctgcggcccgctagcgcctggacgctctacgcggtggccaccacagttattacccctatgatgcgccatacaatcgaaaataccacggctaacatttctctgacagccatcgctaatcaagccgcgattctgatgggcctcgacaaggggtggcccatctccaaaatggatattggagtgccgcttctggccctgggctgctacagccaggtcaaccctctcaccctgacagctgccgtgcttatgctggttgctcactatgccatcatcgggcccggactccaggctaaggccaccagagaggcgcagaagcggaccgccgctggcattatgaaaaatcccacagtggacgggatcgtcgccattgatctggaccctgtggtgtacgacgctaagttcgaaaaacaactgggacagatcatgctccttattctgtgtacgtctcagatcctgctcatgcgcaccacatgggccctgtgcgagtccatcacccttgccacaggcccgctgaccacgctctgggaaggcagccccgggaagttttggaacacaaccattgcggtttctatggctaatatcttcagaggaagctatctggccggcgctgggctggccttctccctcatgaaatctcttggaggcgggcggcgcggaaccggcgcccagggcgagacactgggggagaagtggaagagacaactgaaccagctcagcaaatccgaatttaatacctacaagcggagcggaattatggaggtcgatagatccgaagctaaagagggcctgaagcgcggggaaacaacgaaacatgccgtgtctcggggaaccgcgaagcttagatggttcgtggagcgcaacctggtcaagcctgagggcaaagttatcgacctcgggtgtggacggggcggctggagctattactgcgccgggctgaagaaagtgacagaagtgaagggatataccaaaggcgggcccggacacgaggaacctattcccatggctacatacggctggaatctggtcaagctccattccgggaaagatgtgtttttcatgcctccggagaagtgtgacacccttctgtgcgatatcggagaatctagccccaaccctacgatcgaggagggcagaaccctgcgcgttctcaagatggtggaaccctggctgcggggcaatcagttttgtattaaaatccttaacccttacatgccctccgtcgtggagacactggaacagatgcaaagaaagcacgggggaatgctcgttcgcaatccgctgtctcggaacagcacccacgagatgtattgggtgtcctgcggcacagggaatattgtcagcgccgtgaacatgacctctagaatgctgctcaaccgcttcacaatggctcatcggaaacctacctacgagagagacgtggatctgggagccggcacgcgccacgtcgcggttgaacccgaggaagccaatcttgacatcattgggcagagaatcgagaacattaagaatgaacataaatccacatggcactatgatgaggacaacccctacaagacctgggcttatcacggaagctacgaggtgaagccttctggctccgccagctctatggtgaatggcgtcgtgcggctgctcaccaaaccctgggatgttatccctatggtgacacagatcgctatgacggacaccacaccgtttgggcaacagcgcgtcttcaaggaaaaagtggacaccagaacaccccgggccaagagaggaaccacacagattatggaggttaccgctaaatggctgtggggctttctttcccggaacaagaagcctcgcatctgtacgagagaagagttcacccggaaagtgcgcagcaatgccgcgattggggccgtctttgtggatgaaaaccagtggaattccgctaaggaggccgttgaggacgaaagattctgggatctggtgcatcgggagcgcgaactccacaaacaaggaaagtgcgctacatgcgtctataacatgatgggcaaaagagagaagaagctgggggaatttggcaaagccaagggaagccgggccatctggtacatgtggctgggcgcgcgcttcctcgagttcgaggctctggggtttatgaatgaagaccattggttctctagagagaacagcctttccggagtggaaggcgaggggctgcacaaactcggatacattctgcgggatatctctaagatccccggcgggaatatgtatgccgacgataccgccggctgggacacacgcattaccgaggatgaccttcagaacgaagctaaaatcacggatattatggagcctgaacatgccctgctcgctacaagcatctttaagctgacctaccagaataaagtcgtgagagttcagcggcccgccaagaacggaacagtgatggacgtcatttcccgcagagatcaacggggctctgggcaggtgggaacctatggcctgaacacgttcaccaatatggaggtgcagctcatcagacagatggaaagcgaggggatctttctgccgtccgagcttgaaacacctaacctggcggagcgcgttctcgactggctggaaaagcacggagccgagcggcttaaaagaatggctatttctggcgacgattgtgtggtcaagcccatcgacgatcgcttcgccaccgctctgacagccctcaatgacatggggaaagtgcggaaggatattcctcaatgggaacccagcaaaggctggaacgactggcagcaggttcctttttgctcccaccatttccaccagctgatcatgaaggatggaagagagattgtggtcccctgtcgcaatcaagacgagctggtgggccgggcgagagtcagccagggggccggatggtctctccgcgaaaccgcttgcctgggcaagtcctacgcccagatgtggcaacttatgtattttcatcggagagatctgcgcctcgctgccaacgctatctgtagcgccgtgccggttgactgggtgcctacatctcggaccacgtggtccatccacgcgcaccatcagtggatgacaaccgaggatatgctgagcgtctggaatagagtgtggattgaagagaacccctggatggaagacaaaacccacgtttcctcttgggaggaggtgccctaccttgggaagcgggaagaccagtggtgcggaagcctgatcggcctcacagccagagctacctgggccacaaatattcaggtcgccatcaaccaagtgcgccggctgattgggaatgagaactatctggattacatgacgtccatgaaaagattcaagaatgaaagcgaccctgagggcgctctctggtga

SEQ ID NO: 18799 - RNA, 9879 nt, synthetic construct
  misc_feature 1..9879: note = derived and/or modified CDS sequence (opt5) from DENV-1__JN819405__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacacacctggctctcatggccacgtttaaaatgcggcctatgttcgcggtcggcctgctctttcgcagactgacctctcgggaggtgcttctgctcacaatcgggctgagcctgatggcttccatggaacttcccaactctctggaggaactcggagacggcctggccatggggattatgatgctcaagctgcttaccgagttccaaccccatcagctgtggacaaccctcctgagcctgacgtttgtgaaaacaaccctttccctggattatgcctggaagaccacagctatgatcctcagcatcgtctctctgttccctctctgtctgtccaccacaagccagaaaacgacctggcttccggttctgctgggatcttttggctgcaagcccctcacaatgttcctgattaccgaaaacaagatctggggccgcaaatcctggcctcttaatgaggggattatggccatcggaattgtgagcatcctgctctcttccctgctcaagaacgacgtgcccctggctggccctcttatcgccgggggaatgctgattgcgtgttacgtcatcagcggctccagcgccgatctgtctctcgagaaagctgccgaagtgagctgggagcaggaagctgagcactccggggcctctcataatattctggttgaagtgcaagacgatggaacaatgaagatcaaagacgaggagagagatgacacccttacgattctgctcaaggccaccctgctcgctgtcagcggcgtgtatcccatgtccatccctgcgacactgtttgtttggtacttctggcagaaaaagaagcagcggtctggcgtgctttgggatacccccagcccgcctgaagtcgagcgcgccgtgctggacgatgggatctatagaattctgcagcggggactcctgggccgctcccaagtcggggtgggagttttccaggacggcgtgtttcacacaatgtggcacgtcaccagaggggctgtgcttatgtaccagggaaaacggctggaaccctcttgggccagcgttaagaaagacctcatctcctatggcggcgggtggagattccagggaagctggaacacaggcgaggaggtgcaagtcattgccgtggaacctgggaagaatcccaaaaacgtgcagacgaccccgggaacatttaagacccctgagggcgaagttggggctatcgccctggatttcaagcccggaacctctggctcccctattgtcaatcgcgagggcaaaatcgtggggctctacggaaacggcgtggtcacaacgagcgggacctacgtgtctgcgattgctcaggccaaggcctcccaagaaggacccctgcccgagatcgaggacgaagtttttaaaaagcggaatcttacaatcatggatctgcatcctggcagcgggaaaaccagacgctatctgccggctattgtgcgggaggccatcaagagaaagctccgcacactgattcttgcgcccacccgggtcgtggcttccgaaatggccgaggccctgaaaggcatgcctatcagataccagacgacagctgttaagtctgaaaccaccggacgcgagattgtggacctcatgtgccacgccacattcaccatgcggctgctgagccccgtcagagtgcctaactataatatgatcatcatggatgaggctcattttacagaccccgcctccattgcggcccggggctacatcagcacccgcgttgggatgggagaagctgccgctattttcatgacggccacacctccgggctctgtggaggcctttccccagtccaacgctgtcatccaggatgaagagagagacattcctgaacggagctggaattctgggtatgattggatcaccgacttccccggaaaaacagtgtggtttgtgcctagcatcaagtccggcaacgatattgcgaattgtctccgcaaaaacgggaagagagtcatccaactttctcggaagaccttcgacacggagtaccagaaaaccaagaacaatgactgggattatgttgtgacaaccgacattagcgagatgggcgccaacttcagagctgatcgcgtgatcgacccccggagatgcctgaaaccggtcattctgaaggatggacctgaacgcgtgatcctcgccggccccatgcccgttacagtggcctccgctgcccagcggagagggcgcattggacggaatcagaacaaagagggcgaccaatacgtctacatggggcagcctctgaataacgatgaagaccacgcgcattggaccgaggctaagatgcttctggataatatcaacacacccgagggaatcattcctgccctctttgaaccggagagagaaaagtctgccgctatcgacggcgagtatcgcctgagaggggaagcccggaaaaccttcgtggagctgatgcgcagaggcgatctccccgtttggcttagctacaaggtggcgtccgagggatttcagtatagcgaccggcgctggtgcttcgatggcgaaagaaataaccaggtcctggaggaaaatatggacgtggagatttggacgaaagaaggggagcggaagaaactgagacctcgctggctcgacgcccggacatactctgatcccctggctcttagagagtttaaggaattcgccgctggacgccggtccgtcagcggcgacctgatcctcgagattgggaaactgcctcaacacctgaccctcagagcccagaacgctcttgataatctggtgatgctgcacaactccgaacagggaggcaaggcctatcggcatgcgatggaggaactccccgacaccatcgagacactgatgcttctggccctcatcgctgttctgaccggcggggtgacactgtttttcctctctggaaagggccttgggaaaacgagcattggactgctgtgtgtgaccgcctcctctgctctcctgtggatggccagcgtcgagccgcactggatcgccgcttccattatccttgaatttttcctgatggttctcctgattcctgagcccgatcgccagagaacacctcaagacaatcagctggcgtacgtggtgatcggcctcctttttatgatcctgaccgtcgccgctaacgaaatggggctgctcgagacaaccaagaaagatctgggaattggctatgtggccgccgagaaccatcagcacgctacgatgcttgacgttgatctgcggcccgccagcgcgtggaccctctacgccgtggctacaaccgtcatcacacctatgatgcgccacaccattgaaaatacgacagccaacatctctctgaccgctattgccaatcaagcggccatcctgatgggcctcgacaaggggtggcccatttccaaaatggatatcggagtgccgcttctggctctgggctgctacagccaggtcaaccctctcacactgaccgccgctgtgcttatgctggttgcccattatgctatcattgggcccggactccaggccaaggcgaccagagaggcccagaagcggacagctgccggcatcatgaaaaatcccacggtggacgggattgtcgctatcgatctggaccctgtggtttacgacgccaagttcgaaaaacaactgggacagattatgctccttatcctgtgtacctctcagatcctgctcatgcgcacaacctgggccctgtgcgagtccattacacttgcgaccggcccgctgacgacactctgggaaggcagccccgggaagttttggaacaccaccatcgctgtgtctatggccaatattttcagaggaagctatctggctggcgccgggctggccttctccctcatgaaatctcttggaggcgggcggcgcggaacaggcgctcagggcgagaccctgggggagaagtggaagagacaactgaaccagctcagcaaatccgaatttaatacatacaagcggagcggaatcatggaggtcgatagatccgaagccaaagagggcctgaagcgcggggaaacgaccaaacacgcggtgtctcggggaacagccaagcttagatggttcgtggagcgcaacctggttaagcctgagggcaaagtcattgacctcgggtgtggacggggcggctggagctattactgcgctgggctgaagaattttaccgaagtgaaaggatatacatccggcgggcccggacatgaggaacctatccccatggccacctacggctggaacctggtgaagctccactctgggaaagatgtcttctttatgcctccggagaagtgtgacacgcttctgtgcgatatcggagaaagctcccccaatcctaccattgaggagggcagaacactgcgcgttctcaaaatggtggaaccctggctgaagggcaaccagttctgtatcaagattcttaatccttacatgccctctgtggtcgagaccctggaacagatgcaacggaaacatgggggaatgctcgtgagaaacccgctgagccgcaattccacacacgagatgtattgggttagctgcggcaccgggaacatcgtgtctgctgtcaacatgacatcccggatgctgctcaatagatttaccatggcccaccgcaagcctacgtacgagcgggacgtggatctgggagcgggcacaagacatgttgccgtggaacccgaggtcgctaaccttgacattatcgggcagcgcattgaaaatatcaaaaacgagcacaagagcacctggcattatgatgaagacaatccctacaaaacctgggcctatcacggatcttacgaggtgaagccttccggcagcgcttcttccatggtgaacggcgtcgttagactgctcacaaagccctgggatgtgatccctatggtgacgcagattgccatgaccgacacaaccccgttcgggcaacagcgggtctttaaagagaaggtggacacacgcacccccagagctaaacggggaacaacccagatcatggaagttacggccaagtggctgtggggcttccttagcagaaataaaaagcctcggatttgtacccgcgaggaatttacaagaaaggtgcggtccaacgcggccatcggggctgtcttcgtggatgagaatcagtggaacagcgccaaagaagctgttgaggacgagcgcttttgggatctggtgcacagagaacgggagctccataagcaaggaaaatgcgccacctgcgtctataatatgatgggcaagcgcgaaaaaaagctgggggagttcggcaaggccaaaggatctagagcgatttggtacatgtggctgggcgctcggttcctcgaatttgaggccctggggttcatgaacgaggaccactggtttagccgcgaaaattccctttctggagtggagggcgaagggctgcataagctcggatacatcctgagagatatcagcaaaattcccggcgggaacatgtatgccgacgatacagctggctgggacacccggatcacggaggatgaccttcagaatgaggccaagattacagatatcatggaacctgagcacgctctgctcgccacctccattttcaaactgacataccagaacaaggttgtgcgcgtccagagacccgcgaaaaacggaaccgtgatggacgtcatctctcggcgcgatcaaagaggcagcgggcaggtgggaacgtatggcctgaatacctttacaaacatggaagttcagctcatccggcagatggagtccgaagggattttcctgccgtctgagcttgagacccctaatctggccgaaagagtgctcgactggctggagaagcatggagctgaacgccttaagcggatggccatcagcggcgacgattgtgtcgtgaaacccattgacgatagatttgctacagccctgaccgcgctcaacgacatggggaaggtgcgcaaagatatccctcaatgggagccctccaagggctggaatgactggcagcaggttcctttctgcagccaccactttcatcagctgattatgaaagatggacgggaaatcgtggtcccctgtagaaaccaagacgagctggtgggccgcgcccgggtttctcagggggctggatggtccctcagagagacagcctgcctgggcaagagctacgctcagatgtggcaacttatgtatttccaccgccgggatctgagactcgccgctaatgccatctgttctgcggtgccggtcgactgggtgcctacctcccgcacgacatggagcattcatgcccaccaccagtggatgaccaccgaagatatgctgtccgtctggaaccgggtgtggatcgaggaaaatccctggatggaggacaagacacatgtttctagctgggaagaggtgccctaccttgggaaaagagaggaccagtggtgcggatccctgattggcctcaccgctcgggccacatgggccacgaacatccaggtcgctattaatcaagtgagacgcctgatcgggaacgaaaattatctggattacatgaccagcatgaagcggtttaaaaacgagtctgaccctgaaggcgccctctggtga

SEQ ID NO: 18800 - RNA, 9879 nt, synthetic construct
  misc_feature 1..9879: note = derived and/or modified CDS sequence (opt5) from DENV-1__GQ199877__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcgacctgtgcgagggaaccacagtggttgtggatgaacactgcggcaacagaggcccctctctccggaccacaaccgtcacggggaaaattatccatgagtggtgttgccgcagctgtacactgcctcccctgagatttcggggagaggacggctgctggtacgggatggaaattagaccggtgaaggagaaagaagagaatcttgttcgctccatggtgagcgcgggatctggcgaagtcgattccttcagcctcgggatcctgtgtgtgtccatcatgattgaggaggttatgcggtctagatggagccgcaagatgctgatgaccggaacactcgctgtgtttctgcttctgatcatgggccagctcacctggaacgacctgattagactgtgcatcatggtcggcgccaatgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgccctctagccttgaagagctgggagatggcctcgccatggggatcatgatgctgaaactcctgaccgaatttcaaccccaccagctttggacaaccctgctctccctgacgttcgtgaagacaaccctgagccttgactacgcctggaaaaccacagctatggtgctgtctattgtctccctctttcctctgtgtctcagcaccacatctcagaagacgacctggctgccggtgcttctgggatccttcggctgcaaacccctgacaatgtttctcatcaccgagaacaagatctggggcagaaagagctggcctctgaacgaggggattatggccatcggaattgtttctatccttctgtccagcctcctgaaaaatgatgtgcccctcgctggccctctgattgccgggggaatgcttatcgcgtgttatgtcatctccggcagctctgccgacctgagcctggaaaaggctgccgaggtgtcctgggaacaggaggctgaacattctggggccagccacaacattctcgttgaggtgcaagatgacggaacaatgaaaatcaaggatgaggaacgggacgataccctgacgattcttctgaaagccaccctcctggctgtctccggcgtgtaccccatgtctatccctgcgacactcttcgtctggtatttctggcagaagaaaaagcagcgcagcggcgtgctgtgggacaccccctccccgcctgaggttgaaagagccgtgcttgatgacgggatttaccggatcctgcagcgcggactgctcggcagatctcaagtcggggtgggagtttttcaggatggcgtgttccatacaatgtggcacgtcacccggggggctgtgctgatgtatcagggaaagagacttgagcccagctgggcctccgtgaaaaaggacctgatcagctacggcggcgggtggcgctttcagggatcttggaatacaggcgaggaagttcaagtcattgccgtggagcctgggaaaaaccccaagaatgtgcagacgaccccgggaacattcaaaacccctgaaggcgaggtcggggctatcgccctcgactttaagcccggaacctccggcagccctattgtgaaccgggaaggcaagatcgttgggctgtacggaaatggcgtggtcacaacgtctgggacctatgtgtccgcgattgctcaggccaaagccagccaagagggacccctccccgagatcgaagatgaggttttcaagaaaagaaacctgacaattatggaccttcaccctggctccgggaagacccgccggtacctgccggctatcgtgagagaagccatcaaacgcaagctgcggacactcattctggcgcccaccagagtcgtggcttctgagatggccgaagcccttaagggcatgcctatccgctatcagacgacagctgttaaaagcgagcataccggacgggagattgtggatctgatgtgccacgccacctttacaatgagactcctgtcccccgtccgggtgcctaattacaacatgatcattatggacgaagctcatttcaccgatcccgccagcatcgcggcccgcggctatatctctacaagagtggggatgggagaggctgccgctatttttatgaccgccacgcctccgggctccgtcgaagccttcccccagagcaatgctgttatccaggacgaggaacgggatattcctgagcgctcttggaacagcgggtacgactggatcacagattttcccggaaagaccgtgtggttcgtgccttccattaaatctggcaatgacatcgcgaactgtctgagaaagaatgggaaacgggtcatccaactcagcagaaagacattcgataccgagtatcagaagacgaaaaacaacgactgggactacgtggttaccacagatatttccgaaatgggcgccaattttcgcgctgaccgggtgatcgatcccagacgctgccttaagccggtcattctgaaagacggacctgagcgggtgatcctggccggccccatgcccgttaccgtggcctctgctgcccagagacgcgggcggattggaagaaaccagaataaggaaggcgatcaatacgtctatatggggcagcctctcaacaatgacgaggatcacgcgcattggacagaggctaaaatgctgcttgacaacatcaatacccccgaaggaattatccctgccctgttcgagccggaacgcgagaagagcgccgctatcgatggcgaatacagactccggggggaggcccgcaagacatttgtggagctgatgagacggggcgacctgcccgtctggctctcctataaagtggcgagcgaaggattccagtactctgatcgcagatggtgctttgacggcgagcggaacaatcaggttcttgaagagaacatggatgtggaaatttggaccaaggagggggagagaaaaaagctgcgccctcggtggctggacgccagaacgtattccgaccccctcgctctgcgcgaattcaaagagtttgccgctggacggagaagcgtgtccggcgatcttatcctggaaattgggaagctccctcaacacctgacactgcgggcccagaatgctctcgacaaccttgtcatgctgcacaattctgagcagggaggcaaagcctaccgccatgcgatggaagagctgcccgataccatcgagaccctcatgctgcttgccctgattgctgttctcacaggcggggtgaccctgttctttctgagcggaaagggcctcgggaagacatccatcggacttctgtgtgtgacggcctctagcgctctgctctggatggcctccgtcgaaccgcactggatcgccgctagcattatcctggagttctttcttatggtgctgctcattcctgaacccgacagacagcggacccctcaagataaccagctggcgtatgttgtgatcggcctgctcttcatgattcttacagtcgccgctaatgagatggggctgctggagaccacaaaaaaggacctcggaatcggctacgtggccgccgaaaaccatcagcacgctaccatgctggatgtcgaccttcaccccgcctctgcgtggacgctgtacgccgtggctaccacagttatcacccctatgatgcgccatacaattgagaacaccacggccaatatctccctcacagctattgccaaccaagcggccatcctgatgggcctggataaagggtggcccattagcaagatggacatcggagtgccgctccttgctctgggctgctattctcaggtcaatcctctgaccctcacagccgctgtgctgatgcttgttgcccactacgctattatcgggcccggactgcaggccaaagcgaccagagaagcccagaagcggaccgctgccggcatcatgaagaaccccacagtggatgggattgtcgctatcgacctcgatcctgtggtgtatgacgccaaatttgagaagcaactgggacagattatgctgctcatcctttgtacgtcccagattctgctgatgcgcaccacatgggccctctgcgaaagcatcaccctggcgacaggcccgcttaccacgctgtgggagggctctcccgggaaattctggaatacaaccatcgctgttagcatggccaacattttcagaggatcctacctcgctggcgccgggctggccttttctctgatgaagagcctcggaggcgggcggcgcggaaccggcgctcagggcgagacacttggggaaaaatggaagagacaactgaatcagctgtccaagagcgagttcaacacctataaaaagtccggaatcatggaagtcgaccggtctgaggccaaagaaggcctcaagagaggggagacaacgaaacatgcggtgagccgcggaaccgccaagctgcggtggtttgtggagagaaatcttgtcaagcctgaaggcaaagttattgatctggggtgtggacgcggcggctggtcctactattgcgctgggctcaagaaagtgacagaggtgaagggatacaccaaaggcgggcccggacacgaagagcctatccccatggccacatacggctggaacctggtcaagctgcattctgggaaagacgtgttctttatgcctccggaaaagtgtgataccctcctttgcgacattggagagagctcccccaatcctacgatcgaggaaggccggaccctgagagttctgaagatggtggagccctggctccgcggcaaccagttctgtatcaaaattctgaatccttatatgccctctgtcgtggaaacacttgagcagatgcaacggaagcacgggggaatgctggttagaaacccgctcagccgcaattccacccacgagatgtactgggtgagctgcggcacagggaacatcgtctctgctgtgaatatgacctcccggatgctgctgaacagatttacaatggcccatcgcaaacctacctatgaacgggatgtggacctcggagcgggcacgagacacgtcgccgttgagcccgaagtggctaacctggatattatcgggcagcgcattgagaatatcaagaacgaacataaaagcacatggcactacgacgaggataatccctataagacctgggcctaccacggatcttatgaggtgaagccttccggcagcgcttcttccatggtcaacggcgtggttagacttctgaccaaaccctgggacgtgattcctatggtcacacagatcgccatgacggataccacaccgttcgggcaacagcgggtgtttaaggaaaaagttgacacccgcacacccagagctaagcggggaaccacacagatcatggaggtgaccgccaaatggctctggggcttcctgagcagaaataagaagcctcggatttgtacgcgcgaagagtttaccagaaaagtccggtccaacgcggccatcggggctgtgttcgttgacgaaaatcagtggaacagcgccaaggaggctgtggaggatgaacgcttttgggaccttgtccatagagagcgggaactgcacaaacaaggaaagtgcgccacatgcgtgtacaatatgatgggcaaacgcgagaagaagctcggggaattcggcaaagccaagggatctagagcgatttggtacatgtggctgggcgctcggttcctggagtttgaggccctcgggttcatgaacgaagatcattggtttagccgcgagaattccctgtctggagtcgaaggcgaggggcttcacaaactgggatatatcctcagagacattagcaagatccccggcgggaacatgtacgccgatgacaccgctggctgggatacacggatcaccgaggacgatctgcagaatgaagccaaaattacggacatcatggagcctgaacatgctcttctggccacatccattttcaagctcacctatcagaacaaagtggttcgcgtgcagagacccgcgaagaatggaacagtcatggatgtgatctctcggcgcgaccaaagaggcagcgggcaggtgggaacctacggcctgaacacgtttaccaacatggaggttcagctgattcggcagatggaatccgaggggatcttcctcccgtctgagctggaaacacctaatcttgccgagagagctctggattggctcgaaaagcacggagccgagcgcctgaaacggatggctatcagcggcgacgactgtgtggtcaagcccattgatgacagatttgccaccgcgcttacagccctgaacgatatggggaaagtgcgcaaggacatccctcaatgggaaccctccaaaggctggaatgattggcagcaggttcctttctgcagccaccattttcaccagctcattatgaaggacggacgggagatcgtggtcccctgtagaaaccaagatgagctggtgggccgcgctcgggtctctcagggggccggatggtccctgagagaaaccgcttgcctcggcaagagctatgcccagatgtggcaactgatgtacttccatcgccgggaccttagactggctgccaatgcgatttgttctgccgtgccggttgattgggtgcctacatcccgcaccacgtggagcatccacgctcaccatcagtggatgacaaccgaggacatgctctccgtctggaaccgggtgtggatcgaagagaatccctggatggaagataaaacccacgtttctagctgggaggaggtgccctatctggggaagagagaagaccagtggtgcggatcccttattggcctgacagcccgggccacctgggctacaaacatccaggtcgccattaatcaagtgagacgcctcatcgggaacgagaattacctggactacatgacgagcatgaaacggtttaagaacgaatctgatcctgagggcgcgctgtggtga

SEQ ID NO: 18801 - RNA, 9879 nt, synthetic construct
  misc_feature 1..9879: note = derived and/or modified CDS sequence (opt5) from DENV-1__GU056029__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgtccaggggaagaaaatgatcagaccgcaacccatggaacacaagtactcctggaaatcttggggaaaggctaagattatcggcgccgacattcagaacaccaccttcatcatcgatgggcctgacacacccgagtgtcctgatggacagcgcgcctggaatatttgggaggttgaagactatggctttggcgtgttcaccacgaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacactgtggtctaacggagtgctggagtccgagatgatcatcccgaaaatttacggcgggcctatcagccaacataattatcggcccggatactttacccagacggctggcccttggcacctcgggaagctggaacttgatttcgacctgtgcgagggaaccacagttgtggtcgatgaacactgcggcaacagaggcccctctctccggaccacaaccgtgacggggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggatctggcgaagtggattccttcagcctcgggatcctgtgtgtttccatcatgattgaggaggtgatgcggtctagatggagccgcaagatgctgatgaccggaacactcgcggtctttctgcttctgatcatgggccagctcacctggaacgacctgattagactgtgcatcatggtgggcgctaatgcctccgaccggatggggatgggaaccacatatcttgccctgatggctacgttcaagatgcgccctatgtttgccgtgggcctcctgttcagacggctcacctctcgcgaagtcctgcttctgacaattgggctcagcctggttgcgtccgtggagctgcccaactctcttgaagagctgggagatggcctcgctatggggatcatgatgctgaaactcctgaccgaatttcaaccccaccagctttggacaaccctgctcagcctgacgttcgtgaagacagccctgtcccttgactacgcctggaaaaccaccgctatggtcctgagcattgtgtctctctttcctctgtgtctctccacaaccagccagaagacaacgtggctgccggttcttctgggatctttcggctgcaaacccctgaccatgtttctcatcacagagaacaagatctggggcagaaagtcctggcctctgaatgaggggattatggccatcggaattgtgagcatccttctgtcttccctcctgaaaaacgatgtccccctcgctggccctctgattgccgggggaatgcttatcgcgtgttatgtgatcagcggctccagcgccgacctgtctctggaaaaggctgccgaggttagctgggaacaggaggctgaacattccggggcctctcacaatattctcgtggaggtccaagatgacggaaccatgaaaatcaaggatgaggaacgggacgatacactgaccattcttctgaaagccacgctcctggctgtgagcggcgtctaccccatgtccatccctgcgaccctcttcgtgtggtatttctggcagaagaaaaagcagcgctctggcgttctgtgggacacacccagcccgcctgaggtggaaagagccgtccttgataacgggatttaccggatcctgcagcgcggactgctcggcagatcccaagtgggggttggagtgtttcaggacggcgtcttccataccatgtggcacgtgacacggggggctgtgctgatgtatcagggaaagagacttgagccctcttgggccagcgttaaaaaggatctgatctcctacggcggcgggtggcgctttcagggaagctggaataccggcgaggaagtccaagtgattgccgtggagcctgggaaaaaccccaagaatgtccagacaacgccgggaaccttcaaaacacctgaaggcgaggtgggggctatcgccctcgactttaagcccggaacctctggctcccctattgttaaccgggaaggcaagatcgtggggctgtacggaaatggcgtcgtgaccacaagcgggacgtatgtttctgcgattgctcaggccaaagcctcccaagagggacccctccccgagatcgaagacgaggtgttcaagaaaagaaacctgaccattatggatcttcaccctggcagcgggaagacacgccggtacctgccggctatcgtcagagaagccatcaaacgcaagctgcggaccctcattctggcgcccacaagagtggttgcttccgagatggccgaagcccttaagggcatgcctatccgctatcagaccacggctgtgaaatctgagcatacaggacgggagattgtcgacctgatgtgccacgccacctttaccatgagactcctgagccccgtgcgggtgcctaattacaacatgatcattatggatgaagctcatttcacagaccccgcctccatcgcggcccgcggctatatcagcaccagagtcgggatgggagaggctgccgctatttttatgacagccacccctccgggctctgttgaagccttcccccagtccaatgctgtgatccaggatgaggaacgggacattcctgagcgcagctggaactctgggtacgattggatcacggactttcccggaaagacagtgtggttcgtccctagcattaaatccggcaatgatatcgcgaactgtctgagaaagaacgggaaacgggtgatccaactctctagaaagaccttcgacacagagtatcagaagaccaaaaataacgattgggactacgttgtgacgaccgacattagcgaaatgggcgccaattttcgcgctgatcgggtcatcgaccccagacgctgccttaagccggtgattctgaaagatggacctgagcgggttatcctggccggccccatgcccgtgacagtcgcctccgctgcccagagacgcgggcggattggaagaaaccagaataaggaaggcgaccaatacgtgtatatggggcagcctctcaacaatgatgaggaccacgcgcattggaccgaggctaaaatgctgcttgataacatcaatacacccgaaggaattatccctgccctgttcgagccggaacgcgagaagtctgccgctatcgacggcgaatacagactccggggggaggcccgcaagacctttgtcgagctgatgagacggggcgatctgcccgtgtggctcagctataaagttgcgtccgaaggattccagtacagcgaccgcagatggtgctttgatggcgagcggaacaatcaggtgcttgaagagaacatggacgtggaaatttggacaaaggagggggagagaaaaaagctgcgccctcggtggctggatgccagaacctattctgaccccctcgctctgcgcgaattcaaagagtttgccgctggacggagatccgtcagcggcgaccttatcctggaaattgggaagctccctcaacacctgacgctgcgggcccagaatgctctcgataaccttgttatgctgcacaattccgagcagggaggcaaagcctaccgccatgcgatggaagagctgcccgacacaatcgagaccctcatgctgcttgccctgattgctgtgctcaccggcggggtgacactgttctttctgtctggaaagggcctcgggaagaccagcatcggacttctgtgtgtcacagcctcctctgctctgctctggatggccagcgtggaaccgcactggatcgccgcttccattatcctggagttctttcttatggttctgctcattcctgaacccgatagacagcggacgcctcaagacaaccagctggcgtatgtggtcatcggcctgctcttcatgattcttaccgtggccgctaacgagatggggctgctggagacaaccaaaaaggatctcggaatcggctacgtcgccgccgaaaatcatcagcacgctacaatgctggacgtggatcttcaccccgccagcgcgtggaccctgtacgccgttgctacgaccgtgatcacacctatgatgcgccataccattgagaacacaaccgccaatatctctctcacggctattgccaaccaagcggccatcctgatgggcctggacaaagggtggcccatttccaagatggatatcggagtcccgctccttgctctgggctgctatagccaggtgaatcctctgacactcaccgccgctgttctgatgcttgtggcccactacgctattatcgggcccggactgcaggccaaagcgacaagagaagcccagaagcggaccgctgccggcatcatgaagaaccccaccgtcgacgggattgtggctatcgatctcgaccctgtggtttatgatgccaaatttgagaagcaactgggacagattatgctgctcatcctttgtacatctcagattctgctgatgcgcacgacctgggccctctgcgaatccatcacactggcgaccggcccgcttacaaccctgtgggagggcagccccgggaaattctggaatacgacaatcgctgtctctatggccaacattttcagaggaagctacctcgctggcgccgggctggccttttccctgatgaagtctctcggaggcgggcggcgcggaaccggcgctcagggcgagacccttggggaaaaatggaagagacaactgaatcagctgagcaagtccgagttcaacacatataaacggagcggaatcatggaagtggacagatccgaggccaaggaaggcctcaaacgcggggagaccacaaagcatgcggtgtctcggggaacggccaaactgagatggtttgtcgagcgcaatcttgttaagcctgaaggcaaggtgattgacctggggtgtggacggggcggctggagctactattgcgctgggctcaaaaaggtgaccgaggtcaaaggatacacaaagggcgggcccggacacgaagagcctatccccatggccacctacggctggaacctggtgaaactgcattccgggaaggatgttttctttatgcctccggaaaaatgtgacacactcctttgcgatattggagagtctagccccaatcctaccatcgaggaaggcagaacgctgcgcgtgctgaagatggtcgagccctggctccggggcaaccagttctgtatcaagattctgaatccttatatgccctccgtggttgaaacccttgagcagatgcaaagaaaacacgggggaatgctggtgcgcaacccgctctctcggaatagcacacacgagatgtactgggtctcctgcggcaccgggaacatcgtgagcgctgtgaacatgacatctagaatgctgctgaatcgctttaccatggcccatcggaagcctacatatgaaagagacgtcgatctcggagcgggcacccgccacgttgccgtggagcccgaagtggctaacctggacattatcgggcagagaattgagaatatcaaaaacgaacataagtccacgtggcactacgatgaggacaatccctataaaacatgggcctaccacggaagctatgaggtcaagccttctggctccgctagctctatggtgaacggcgttgtgcggcttctgaccaagccctgggatgtcattcctatggtgacccagatcgccatgacagacacgaccccgttcgggcaacagcgcgtttttaaagaaaaggtggatacaagaaccccccgggctaaaagaggaacaacccagatcatggaggtcacagccaagtggctctggggcttcctgtcccggaataaaaagcctcgcatttgtaccagagaagagtttacgcggaaggtgcgcagcaacgcggccatcggggctgttttcgtggacgaaaatcagtggaactccgccaaagaggctgtcgaggacgaaagattttgggatcttgtgcatcgggagcgcgaactgcacaagcaaggaaaatgcgccacctgcgtctacaatatgatgggcaagagagagaaaaagctcggggaattcggcaaggccaaaggaagccgggcgatttggtacatgtggctgggcgctcgcttcctggagtttgaggccctcgggttcatgaacgaagaccattggttttctagagagaatagcctgtccggagtggaaggcgaggggcttcacaagctgggatatatcctccgggatatttctaaaatccccggcgggaacatgtacgccgacgatacagctggctgggacacccgcatcacagaggatgacctgcagaatgaagccaagattaccgatatcatggagcctgaacatgctcttctggccacgagcattttcaaactcacatatcagaacaaggttgtgagagtccagcggcccgcgaaaaacggaaccgtgatggacgtgatctcccgcagagatcaacggggctctgggcaggttggaacatacggcctgaatacctttacgaacatggaggtgcagctgattagacagatggaaagcgaggggatcttcctcccgtccgagctggaaacccctaatcttgccgagcgcgctctggactggctcgaaaagcacggagccgagcggctgaagagaatggctatctctggcgatgactgtgtcgtgaaacccattgacgatcgctttgccacagcgcttaccgccctgaacgacatggggaaggttcggaaagatatccctcaatgggaacccagcaagggctggaatgactggcagcaggtgcctttctgctcccaccattttcaccagctcattatgaaagatggaagagagatcgtcgtgccctgtcgcaaccaagacgagctggtcggccgggctagagtgagccagggggccggatggtctctgcgcgaaacagcttgcctcggcaagtcctatgcccagatgtggcaactgatgtacttccatcggagagatcttcgcctggctgccaatgcgatttgtagcgccgttccggtggactgggtccctacctctcggacaacctggtccatccacgctcaccatcagtggatgacgacagaggatatgctcagcgtgtggaacagagtttggatcgaagagaatccctggatggaagacaagacccacgtgtcctcttgggaggaggtcccctatctggggaaacgggaagatcagtggtgcggaagccttattggcctgaccgccagagccacatgggctaccaacatccaggtggccattaatcaagtgcgccggctcatcgggaacgagaattacctggactacatgacatccatgaagagatttaaaaacgaaagcgactctgagggcgcgctgtggtga

SEQ ID NO: 18802 - RNA, 9879 nt, synthetic construct
  misc_feature 1..9879: note = derived and/or modified CDS sequence (opt5) from DENV-1__GU056030__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgcggtacgaaggcaccgacgcgccgtgcaagattcctttttctacacaagatgagaaaggggtcacccagaacggaagacttatcacagctaatcccatcgtgacggacaaggaaaaacctgtgaacattgagaccgagccccccttcggcgaatcctatatcgttgtcggggccggagagaaggccctcaaactgagctggtttaagcgcggctctagcattgggaagatgttcgaagctacagcccggggcgctagacgcatggccatcctgggagataccgcgtgggactttggctccattgggggagtgttcacatctgtgggcaaactcgtccatcaggtgtttgggaccgcctacggagttctgttcagcggcgtgtcctggacgatgaagatcgggatcggcattcttctgacctggctcggactgaatagccggtctacatccctgagcatgacctgtatcgctgtcggcatggtgacactttacctcggggttatggtgcaggccgattctggatgcgtcattaactggaaaggcagagagctgaagtgtgggtccggaatctttgtgaccaacgaagttcacacatggaccgagcaatataaattccaggctgacagccctaagcgcctgtccgccgcgattggcaaggcctgggaggaaggggtgtgcggcatccggtctgctacgagactcgagaatattatgtggaaacagatcagcaacgaactgaatcatatccttctggagaacgatatgaagtttacagtcgtggtgggagacgccaatggcattctcgctcaggggaaaaagatgatccgcccgcaacccatggaacacaaatactcctggaagtcttggggaaaagccaagattatcggcgccgacattcagaacaccaccttcatcatcgatgggcctgacacacccgagtgtcctgatggacagcgggcttggaatatttgggaggtcgaagactatggctttggcatcttcaccacgaacatttggctgaagctgagagatagctacacacagatgtgcgaccaccgccttatgtccgcggccatcaaagatagcaaggctgttcatgccgacatggggtattggattgagtctgaaaaaaatgagacctggaagctcgcccgggcttccttcatcgaagtgaaaacatgtacctggcccaagagccacacactgtggtctaacggagtgctggagtccgagatgatcattccgaagatctacggcgggcctattagccaacataattatagacccggatactacacccagacggccggcccttggcacctcgggaaactggaacttgattttgacctgtgcgagggaaccacagtcgtggttgatgaacactgcggcaaccggggcccctctctccgcaccacaaccgtgacggggaagatcattcatgagtggtgttgcagaagctgtacactgcctcccctgcggttcagaggagaggacggctgctggtatgggatggaaatccgcccggtcaaagagaaggaagagaatcttgtgcggtccatggttagcgcgggatctggcgaagtggataacttttccctcgggatcctgtgtgtcagcattatgatcgaggaggtgatgagatcccgctggtctagaaaaatgctgatgaccggaacactcgctgttttcctgcttctgattatgggccagctcacctggaatgacctgatccggctgtgcattatggtgggcgccaacgccagcgacgggatgggaatgggcaccacataccttgctctgatggccacgtttaagatgcgccctatgttcgcggtcgggctcctgtttagacggctcacctcccgcgaagtgctgcttctgacaatcggactctctctggtggctagcgtcgagctgcccaactcccttgaagagctgggcgatgggctcgccatgggaattatgatgctgaagctcctgaccgaattccaaccccaccagctttggacaaccctgctctctctgacgtttgttaaaacaaccctgagccttgactatgcctggaagaccacagctatggtgctgtccatcgtgagcctcttccctctgtgtctctctaccacatcccagaaaacgacctggctgccggtccttctgggcagctttggctgcaagcccctgacaatgttcctcatcaccgagaataaaatttgggggagaaagtcttggcctctgaacgagggaatcatggccattggcatcgtgtccattcttctgagctctctcctgaagaatgatgttcccctcgctgggcctctgatcgccggaggcatgcttatcgcgtgttacgtgatttccgggagctccgccgacctgagcctggataaagctgccgaagtctcttgggagcaggaagctgagcatagcggagcctcccacaacatctctgtggaagttcaagacgatggcacaatgaagattaaagacgaggagcgggatgacaccctcacgatcctgcttaaggccaccctgctcgctgtgagcggcgtctatcccatgtccattcctgcgacactgtttgtgtggtacttctggcagaaaaagaaacagcgctctggggtcctctgggatacccccagcccgcctgaagtggagagagccgttctggacgatggaatctatcggatccttcagcgcggcctgctggggagatcccaagtgggagtcggcgtgttccaggacggggtttttcatacaatgtggcacgtgacccggggagctgtcctcatgtaccagggcaagagactggaaccctcttgggcctgcgtgaagaaagaccttattagctacggcgggggatggcgcttccagggctcctggaatacaggggaggaggtgcaagttatcgccgtcgaacctggaaagaaccccaaaaatgtgcagacgaccccgggcacatttaagacccctgagggggaagtgggagctattgccctggatttcaaacccggcaccagcggctctcctatcgtcaaccgggaggggaagattgtgggactctatggcaatggggttgtgacaacgtccggaacctacgtcagcgcgatcgctcaggccaaggcctctcaagaaggccccctgcccgagattgaggacgaagtgtttaaaaagagaaacctcacaatcatggatctgcaccctgggtccggcaaaacccgccggtatcttccggctatcgttagagaggccattaagcgcaaactgcggacactgatcctcgcgcccaccagagtggtcgctagcgaaatggccgaggccctgaagggaatgcctattcgctaccagacgacagctgtgaagtccgaacataccggccgggagatcgttgaccttatgtgtcacgccaccttcacaatgagactgctctctcccgtgcgggtccctaattataacatgattatcatggatgaggctcattttaccgaccccgccagcatcgcggcccgcgggtacatttccacaagagtgggaatgggcgaagctgccgctatcttcatgaccgccacgcctccggggagcgtggaggcctttccccagtctaatgctgtcattcaggatgaagagcgggacatccctgaacgctcctggaacagcggatatgattggattacagacttccccggcaaaaccgtttggtttgtgccttctatcaagagcgggaatgatatcgcgaactgcctgagaaaaaacggcaagcgggtgattcaactgtccagaaaaacattcgacaccgagtaccagaagacgaagaataacgactgggattacgtcgtgaccacagacatctctgagatgggagccaatttccgcgctgatcgggttattgaccccagacgctgcctcaaaccggtgatccttaaggatggccctgaacgggtcattctggccgggcccatgcccgtgaccgttgccagcgctgcccagagacgcggacggatcggcagaaaccagaataaagagggggaccaatatgtgtacatgggacagcctctgaacaatgatgaagaccacgcgcattggacagaggctaagatgctcctggataacattaatacccccgagggcatcatccctgccctttttgaaccggagcgcgaaaaatccgccgctattgacggggagtatagactgcggggcgaagcccgcaagacattcgtcgagctcatgagacggggagatctgcccgtgtggctgtcttacaaggtcgcgagcgagggctttcagtattccgaccgcagatggtgtttcgatggggaacggaacaatcaggtgctcgaggaaaacatggacgttgagatctggaccaaagaaggagagagaaagaaacttcgccctcggtggctggacgccagaacgtacagcgatcccctggctctccgcgagtttaaggaattcgccgctggccggagatctgtgtccggggacctgattcttgagatcggaaaactgcctcaacacctcacactgcgggcccagaatgctctggataacctcgtgatgcttcacaatagcgaacagggcggcaaggcctatcgccatgcgatggaggaactgcccgacaccattgagaccctgatgctcctggcccttatcgctgtcctgacagggggagttaccctctttttcctgtccggcaaagggctgggaaagacatctatcggcctcctttgcgtgacggccagctccgctctgctgtggatggcctctgtggagccgcactggattgccgctagcatcattctcgaatttttcctgatggtccttctgatccctgagcccgatagacagcggacccctcaagacaaccagctcgcgtacgtggttattgggctgctgtttatgatcctcacagtggccgctaacgaaatgggacttctggagaccacaaagaaagatctgggcatcggctacgtcgccgccgagaatcatcagcacgctaccatgctcgacgtggatctgcaccccgcctccgcgtggacgctttatgccgtcgctaccacagtgattacccctatgatgcgccatacaatcgaaaacaccacggccaatattagcctgacagctatcgccaaccaagcggccattctcatggggctggacaagggatggcccatctctaaaatggatattggcgttccgctgctcgctcttgggtgttactcccaggtgaatcctctgaccctgacagccgctgtcctcatgctggtggcccactatgctatcatcggacccggccttcaggccaaggcgaccagagaggcccagaaacggaccgctgccgggattatgaagaaccccacagttgacggaatcgtggctattgatctggaccctgtcgtgtacgacgtgaagttcgaaaaacaactcggccagatcatgctgctgattctctgcacgagccagatccttctgatgcgcaccacatgggccctgtgtgagtctatcaccctcgccacaggcccgctgaccacgctttgggaagggtcccccggaaagttttggaatacaaccattgcggttagcatggctaacatcttcagaggctcttatctggccggggctggactcgccttcagcctgatgaaatccctgggcgggggacggcgcggcaccggcgcccagggggagacactcggagagaagtggaaaagacaacttaatcagctgtctaagagcgaatttaacacctacaagcggtccggcattatggaggtcgatagaagcgaagctaaagaggggctgaagcgcggagaaacaacgaatcatgccgtgtcccggggcaccgcgaaactcagatggttcgtggagcgcaacctggtcaagcctgaggggaaagttatcgaccttggatgcggccggggcgggtggtcttattactgtgccggactgaagaaggtgacagaagtgaaaggctacaccaaggggggacccggccacgaggaacctattcccatggctacatatgggtggaatctcgtcaaactgcatagcggaaaggatgtgtttttcatgcctccggagaaatgcgacaccctgctctgtgatatcggcgaatcctctcccaaccctacgatcgaggagggcagaacccttcgcgttctgaagatggtggaaccctggctgcgggggaatcagttttgcattaaaatcctcaacccttacatgcccagcgtcgtggagacactggaacagatgcaaagaaagcacggaggcatgcttgttcgcaatccgctgtcccggaactctacccacgagatgtattgggtgagctgtgggacaggaaacattgtctccgccgtgaatatgaccagcagaatgctcctgaaccgcttcacaatggctcatcggaagcctacctacgagagagacgtggatctgggcgccgggacgcgccacgtcacagttgaacccgaggtggcgaatctcgacatcattggacagagaatcgaaaacattaaaaatgagcataagtctacctggcactatgatgaagacaacccctacaaaacctgggcctatcacggctcctacgaggtgaagcctagcggctctgcttccagcatggtcaatggggtggttcggctgcttacaaaaccctgggatgtgatccctatggtcacgcagatcgccatgaccgacacaaccccgtttggacaacagcgcgtgttcaaggagaaggttgacacaagaaccccccgggctaaaagaggcacaacccagattatggaagtgacggccaagtggctgtgggggtttctctctcggaacaaaaagcctcgcatctgcaccagagaggaattcacacggaaagtccgctccaatgctgccattggagcggtgtttgttgatgagaaccagtggaatagcgccaaggaagctgtggaggacgagagattctgggatctggtccatcgggaacgcgagcttcacaagcaaggcaaatgcgccacctgtgtgtacaacatgatggggaagagagaaaaaaagctgggcgagtttggaaaagctaagggctcccgggccatctggtatatgtggctcggggcccgcttcctggaattcgaggcgctgggatttatgaatgaggaccattggttcagcagagaaaactctctcagcggcgtcgagggggaaggactgcacaagcttggctacattctgcgggatatctccaaaatccccgggggcaatatgtatgctgacgatacagccggatgggacacccgcattacggaggatgacctccagaacgaggccaagatcacagatattatggaacctgagcatgctctgcttgccacctctatctttaaactgacataccagaacaaggtggttagagtgcagcggcccgctaaaaatggcaccgtcatggacgtgattagccgcagagatcaacgggggtccggacaggtgggcacgtatgggctcaacaccttcacaaatatggaagttcagctgatcagacagatggagtctgaaggaatctttctgccgagcgagctcgagacccctaacctggccgaacgcgtgcttgactggctggagaagcacggcgcggaacggctcaaaagaatggccatttccggggacgattgcgtcgtgaagcccatcgacgatcgcttcgctacagccctgaccgctcttaatgacatgggcaaggttcggaaagatattcctcaatgggagccctctaagggatggaacgactggcagcaggtgcctttttgtagccaccatttccaccagctgatcatgaaagatggcagagaaattgtcgtgccctgccgcaatcaagacgagctcgtcgggcgggccagagtgtcccagggagcgggctggagcctgcgcgagacagcctgtctggggaagtcttacgctcagatgtggcaactcatgtattttcatcggagagatctgcgccttgccgctaacgccatctgctccgctgttccggtggactgggtccctaccagccggacgacatggtctatccacgcccaccatcagtggatgaccaccgaagatatgctgtccgtgtggaatagagtttggattgaggaaaacccctggatggaggacaaaacacacgtgagctcctgggaagaggtcccctacctcggaaagcgggaggaccagtggtgtggctctctgatcgggcttaccgcgagagccacatgggctacgaatattcaggtggccatcaaccaagtgcgccggctgattggcaatgaaaactacctcgattatatgaccagcatgaagagattcaaaaatgagtccgaccctgaaggagccctgtggtga

SEQ ID NO: 18803 - RNA, 9879 nt, synthetic construct
  misc_feature 1..9879: note = derived and/or modified CDS sequence (opt5) from DENV-1__GU056031__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccccccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcaacctgtgcgagggaaccacagtggttgtggacgaacactgcggcaatagaggcccctctctccggaccacaaccgtcacggggaaaattatccatgagtggtgttgccgcagctgtacactgcctcccctgagatttcggggagaggatggctgctggtacgggatggaaattagaccggtgaaggagaaagaagagaaccttgttcgctccatggtgagcgcgggatctggcgaagtcgactccttcagcctcgggatcctgtgtgtgtccatcatgattgaggaggttatgcggtctagatggagccgcaagatgctgatgaccggaacactcgctgtgtttctgcttctgatcatgggccagctcacctggaatgatctgattagactgtgcatcatggtcggcgccaacgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagagctgggagacggcctcgccatggggatcatgatgctgaaactcctgaccgaatttcaaccccaccagctttggacaaccctgctcagcctgacgttcgtgaagacaaccctgtcccttgattacgcctggaaaaccacagctatggtgctgagcattgtctctctctttcctctgtgtctctccaccacaagccagaagacgacctggctgccggtgcttctgggatctttcggctgcaaaccctccacaatgtttctgatcaccgagaataagatctggggcagaaagagctggcctctcaacgaggggattatggccatcggaattgtttctatcctgctttccagcctgctcaaaaatgacgtgcccctggctggccctctcattgccgggggaatgctgatcgcgtgttatgtcatctccggcagctctgccgatcttagcctggaaaaggctgccgaggtgtcctgggaacaggaggctgaacattctggggccagccacaacattctggttgaggtgcaagacgatggaacaatgaaaatcaaggacgaggaacgggatgacaccctcacgattctgcttaaagccaccctgctcgctgtctccggcgtgtaccccatgtctatccctgcgacactgttcgtctggtatttctggcagaagaaaaagcagcgcagcggcgtgctctgggataccccctccccgcctgaggttgaaagagccgtgctggacgatgggatttaccggatccttcagcgcggactgctgggcagatctcaagtcggggtgggagtttttcaggacggcgtgttccatacaatgtggcacgtcacccggggggctgtgctcatgtatcagggaaagagactggagcccagctgggcctccgtgaaaaaggatcttatcagctacggcggcgggtggcgctttcagggatcttggaatacaggcgaggaagttcaagtcattgccgtggagcctgggaaaaaccccaagaatgtgcagacgaccccgggaacattcaaaacccctgaaggcgaggtcggggctatcgccctggactttaagcccggaacctccggcagccctattgtgaaccgggaaggcaagatcgttgggctctacggaaatggcgtggtcacaacgtctgggacctatgtgtccgcgattgctcaggccaaagccagccaagagggacccctgcccgagatcgaagacgaggttttcaagaaaagaaacctcacaattatggatctgcaccctggctccgggaagacccgccggtaccttccggctatcgtgagagaagccatcaaacgcaagctgcggacactgattctcgcgcccaccagagtcgtggcttctgagatggccgaagccctgaagggcatgcctatccgctatcagacgacagctgttaaaagcgagcataccggacgggagattgtggaccttatgtgccacgccacctttacaatgagactgctctcccccgtccgggtgcctaattacaacatgatcattatggatgaagctcatttcaccgaccccgccagcatcgcggcccgcggctatatctctacaagagtggggatgggagaggctgccgctatttttatgaccgccacgcctccgggctccgtcgaagccttcccccagagcaatgctgttatccaggatgaggaacgggacattcctgagcgctcttggaacagcgggtacgattggatcacagactttcccggaaagaccgtgtggttcgtgccttccattaaatctggcaatgatatcgcgaactgtctgagaaagaacgggaaacgggtcatccaactgagcagaaagacattcgacaccgagtatcagaagacgaaaaataacgattgggactacgtggttaccacagacatttccgaaatgggcgccaattttcgcgctgatcgggtgatcgaccccagacgctgcctcaagccggtcattcttaaagatggacctgagcgggtgatcctggccggccccatgcccgttaccgtggcctctgctgcccagagacgcgggcggattggaagaaaccagaataaggaaggcgaccaatacgtctatatggggcagcctctgaacaatgatgaggaccacgcgcattggacagaggctaaaatgctcctggataacatcaatacccccgaaggaattatccctgcccttttcgagccggaacgcgagaagagcgccgctatcgacggcgaatacagactgcggggggaggcccgcaagacatttgtggagctcatgagacggggcgatctgcccgtctggctgtcctataaagtggcgagcgaaggattccagtactctgaccgcagatggtgctttgatggcgagcggaacaatcaggttctcgaagagaacatggacgtggaaatttggaccaaggagggggagagaaaaaagcttcgccctcggtggctggatgccagaacgtattccgaccccctggctctccgcgaattcaaagagtttgccgctggacggagaagcgtgtccggcgacctgatccttgaaattgggaagctgcctcaacacctcacactgcgggcccagaatgctctggataacctcgtcatgcttcacaattctgagcagggaggcaaagcctaccgccatgcgatggaagagctgcccgacaccatcgagaccctgatgctcctggcccttattgctgttctgacaggcggggtgaccctcttctttctgagcggaaagggcctggggaagacatccatcggactcctttgtgtgacggcctctagcgctctgctgtggatggcctccgtcgaaccgcactggatcgccgctagcattatcctcgagttctttctgatggtgcttctgattcctgaacccgatagacagcggacccctcaagacaaccagctcgcgtatgttgtgatcggcctgctgttcatgattctcacagtcgccgctaacgagatggggcttctggagaccacaaaaaaggatctgggaatcggctacgtggccgccgaaaatcatcagcacgctaccatgctcgacgtcgatctgcaccccgcctctgcgtggacgctttacgccgtggctaccacagttatcacccctatgatgcgccatacaattgagaacaccacggccaatatctccctgacagctattgccaaccaagcggccatcctcatgggcctggacaaagggtggcccattagcaagatggatatcggagtgccgctgctcgctcttggctgctattctcaggtcaatcctctgaccctgacagccgctgtgctcatgctggttgcccactacgctattatcgggcccggacttcaggccaaagcgaccagagaagcccagaagcggaccgctgccggcatcatgaagaaccccacagtggacgggattgtcgctatcgatctggaccctgtggtgtatgatgccaaatttgagaagcaactcggacagattatgctgctgatcctctgtacgtcccagattcttctgatgcgcaccacatgggccctgtgcgaaagcatcaccctcgcgacaggcccgctgaccacgctttgggagggctctcccgggaaattctggaatacaaccatcgctgttagcatggccaacattttcagaggatcctacctggctggcgccgggctcgccttttctctgatgaagagcctgggaggcgggcggcgcggaaccggcgctcagggcgagacactcggggaaaaatggaagagacaacttaatcagctgtccaagagcgagttcaacacctataaacggtccggaatcatggaagtcgacagatctgaggccaaggaaggcctgaaacgcggggagacaacgaagcatgcggtgagccggggaaccgccaaactcagatggtttgtggagcgcaatctggtcaagcctgaaggcaaggttattgaccttgggtgtggacggggcggctggtcctactattgcgctgggctgaaaaaggtgacagaggtgaaaggatacaccaagggcgggcccggacacgaagagcctatccccatggccacatacggctggaacctcgtcaaactgcattctgggaaggatgtgttctttatgcctccggaaaaatgtgacaccctgctctgcgatattggagagagctcccccaatcctacgatcgaggaaggcagaacccttcgcgttctgaagatggtggagccctggctgcggggcaaccagttctgtatcaagattctcaatccttatatgccctctgtcgtggaaacactggagcagatgcaaagaaaacacgggggaatgcttgttcgcaacccgctgagccggaattccacccacgagatgtactgggtgagctgcggcacagggaacatcgtctctgctgtgaacatgacctccagaatgctcctgaatcgctttacaatggcccatcggaagcctacctatgaaagagacgtggatctgggagcgggcacgcgccacgtcgccgttgagcccgaagtggctaacctcgacattatcgggcagagaattgagaatatcaaaaacgaacataagagcacatggcactacgatgaggacaatccctataaaacctgggcctaccacggatcttatgaggtgaagccttccggcagcgcttcttccatggtcaacggcgtggttcggctgcttaccaagccctgggatgtgattcctatggtcacacagatcgccatgacggacaccacaccgttcgggcaacagcgcgtgtttaaagaaaaggttgataccagaacaccccgggctaaaagaggaaccacacagatcatggaggtgaccgccaagtggctgtggggcttcctcagccggaataaaaagcctcgcatttgtacgagagaagagtttacccggaaggtccgctccaacgcggccatcggggctgtgttcgttgacgaaaatcagtggaacagcgccaaagaggctgtggaggacgaaagattttgggatctggtccatcgggagcgcgaacttcacaagcaaggaaaatgcgccacatgcgtgtacaatatgatgggcaagagagagaaaaagctgggggaattcggcaaggccaaaggatctcgggcgatttggtacatgtggctcggcgctcgcttcctggagtttgaggccctggggttcatgaacgaagaccattggtttagcagagagaattccctctctggagtcgaaggcgaggggctgcacaagcttggatatatcctgcgggatattagcaaaatccccggcgggaacatgtacgccgacgataccgctggctgggacacacgcatcaccgaggatgacctccagaatgaagccaagattacggatatcatggagcctgaacatgctctgcttgccacatccattttcaaactgacctatcagaacaaggtggttagagtgcagcggcccgcgaaaaacggaacagtcatggacgtgatctctcgcagagatcaacggggcagcgggcaggtgggaacctacggcctcaatacgtttaccaacatggaggttcagctgattagacagatggaatccgaggggatcttcctgccgtctgagctcgaaacacctaatctggccgagcgcgctcttgactggctggaaaagcacggagccgagcggctcaagagaatggctatcagcggcgatgactgtgtggtcaaacccattgacgatcgctttgccaccgcgctgacagcccttaacgacatggggaaggtgcggaaagatatccctcaatgggaaccctccaagggctggaatgactggcagcaggttcctttctgcagccaccattttcaccagctgattatgaaagatggaagagagatcgtggtcccctgtcgcaaccaagacgagctcgtgggccgggctagagtctctcagggggccggatggtccctgcgcgaaaccgcttgcctgggcaagagctatgcccagatgtggcaactcatgtacttccatcggagagatctgcgccttgctgccaatgcgatttgttctgccgtgccggttgactgggtgcctacatcccggaccacgtggagcatccacgctcaccatcagtggatgacaaccgaggatatgctgtccgtctggaacagagtgtggatcgaagagaatccctggatggaagacaagacccacgtttctagctgggaggaggtgccctatctcgggaaacgggaagatcagtggtgcggatccctgattggccttacagccagagccacctgggctacaaacatccaggtcgccattaatcaagtgcgccggctgatcgggaacgagaattacagcgactacatgacgtctatgaagagatttaaaaacgaatccgaccctgagggcgcgctctggtga

SEQ ID NO: 18804 - RNA, 9879 nt, synthetic construct
  misc_feature 1..9879: note = derived and/or modified CDS sequence (opt5) from DENV-1__GU056032__SS-prME
  source 1..9879: mol_type = other RNA
agcgtggccatgctgctcatgctgcttcccaccgctctggccttccacctcacaacgagaggcggggagcctcatatgatcgtctccaagcaggaacggggaaaatctctgctttttaagaccagcgcgggcgttaacatgtgcacactgattgctatggacctcggggagctgtgtgaagataccatgacatacaaatgcccgcgcatcaccgaggccgaacccgacgatgtggactgttggtgcaatgccacagatacctgggtgacgtatggaacctgttcccaaacaggcgagcacagacgggacaagcgctctgtcgctctggcccctcatgtggggctcggactggagaccagaacagaaacctggatgagctccgagggcgcttggaaacagattcagcgggttgaaacgtgggcccttcgccaccccggcttcacagtgatcgcgctgtttctcgcccatgctattgggacctctatcacacagaagggaatcattttcatcctgcttatgctggtcacccctagcatggccatgagatgcgtgggcattgggaaccgggattttgttgagggactctccggcgctacctgggtggacgtcgtgctggagcacgggagctgtgtgacaacgatggccaagaataaacccaccctggatatcgaactcctgaagacagaggtcaccaaccctgcggttcttcgcaaactgtgcattgaagccaagatctctaatacaaccacggactccagatgtccgacacaaggagaggctaccctcgtggaagagcaggatgccaacttcgtgtgccggcgcacctttgtcgacagaggctggggcaatgggtgtggactgttcggcaaagggagccttctgacatgcgctaagtttaagtgcgtgaccaaactcgagggaaagattgttcagtacgaaaacctgaaatattctgtgatcgtcacagtgcacacgggcgatcagcatcaagttgggaatgagaccacagaacacggaaccatcgccacaattaccccccaggcccctacgtccgagatccagctgaccgactacggcgctctcacactggactgtagcccccggaccggccttgatttcaacgaaatggtgctgctcacaatgaaggagaaatcttggctggtccataagcagtggtttcttgacctgcctctcccctggacctccggggcgagcacgtcccaagagacatggaatcgccaggatctgctggtgaccttcaaaacagcccacgctaagaagcaggaagtcgtggttctcggatctcaagagggcgccatgcacaccgccctgaccggggctacagaaattcagacgagcggaaccacaaccatctttgccggccatcttaaatgcagactgaagatggacaaactcacactgaaggggacctcctatgtgatgtgtacgggcagcttcaaactggagaaggaagtcgcggagacacagcacggaaccgtgcttgttcaggtgaagtacgagggcaccgatgctccgtgcaaaattcctttctctacacaagacgaaaagggggtcacccagaacggacggctcatcacagccaatcccatcgtgacggataaagagaagcctgtgaacattgaaaccgagcccccctttggcgagtcctatatcgttgtcggggccggagaaaaagctctgaagctgagctggttcaagaaaggctctagcattgggaagatgtttgaggccacagctagaggcgcccgccggatggcgatcctcggagacaccgcctgggatttcggctccattgggggagtgtttacatctgtgggcaaactggtccatcaggtgttcgggaccgcttacggagttctttttagcggcgtgtcctggacgatgaagatcgggatcggcattctgctcacctggctgggactgaatagcagatctacatcccttagcatgacctgtatcgccgtcggcatggtgacactctacctgggggttatggtgcaggctgactctggatgcgtcattaactggaaaggccgcgaactgaagtgtgggtccggaatcttcgtgaccaacgaggttcacacatggaccgaacaatataagtttcaggccgatagccctaaacggctctccgcggccattggcaaggcttgggaggagggggtgtgcggcatcagatctgccacgcgcctggaaaatattatgtggaaacagatcagcaacgagcttaatcatatcctgctcgaaaacgacatgaagttcacagtcgtggtgggagacgctaatggcattctggcccaggggaaaaagatgatccggccgcaacccatggagcacaaatactcctggaagtcttggggaaaggccaaaattatcggcgctgatattcagaacaccacctttatcatcgacgggcctgatacacccgaatgtcctgacgatcagagagcgtggaatatttgggaggtcgaggactatggattcggcatctttaccacgaacatttggctgaagcttcgcgatagctacacacagatgtgcgaccaccggctcatgtccgccgctatcaaagatagcaaggccgttcatgccgacatgggctattggattgaatctgagaaaaatgaaacctggaagctggctagagcctccttcatcgaggtgaagacatgtacctggcccaaaagccacacactgtggtctaacggggtgctcgaatccgagatgatcattccgaagatctacggaggccctattagccaacataattatcgccccgggtacttcacccagacggcgggaccttggcacctgggcaaacttgagctggattttgacctctgcgaagggaccacagtcgtggttgatgagcactgcggaaaccggggcccctctctgagaaccacaaccgtgacgggcaagatcattcatgaatggtgttgccggagctgtacactgcctccccttcgcttcagaggggaggacggatgctggtacggcatggagatccggccggtcaaagaaaaggaggaaaatctcgtgagatccatggttagcgctgggtctggagaggtggactcctttagcctgggcatcctgtgtgtctccattatgatcgaagaggtgatgcgctctcggtggagcagaaagatgctcatgaccgggacactggccgttttccttctgctcattatgggacagctgacctggaacgatctgatccgcctttgcattatggtgggcgccaatgcttccgacagaatgggcatggggaccacatatctggccctcatggcgacgtttaaaatgcggcctatgttcgctgtcggactgctctttcgcagactgacctctcgggaggtgcttctgctcacaatcggcctgagcctggtggcctccgtcgaacttcccaactctctggaggaactcggggatggactggccatgggcattatgatgctcaagctgcttaccgagttccaaccccaccagctgtggacaaccctcctgagcctgacgtttatcaaaacaaccctttccctggactacgcttggaagaccacagccatggttctcagcatcgtgtctctgttccctctctgtctgtccaccacaagccagaaaacgacctggcttccggtgctgctggggtcttttggatgcaagcccctcacaatgttcctgattaccgaaaacaagatctggggccgcaaatcctggcctcttaatgagggcattatggctgtcgggatcgtgagcatgctgctctcttccctgctcaagaacgatgttcccctggccggacctcttattgcgggcgggatgctgatcgcctgttatgtgatcagcggatccagcgctgacctgtctctcgagaaagccgctgaagtcagctgggagcaggaagccgagcattccggcacatctcacaatattctggtggaagttcaagatgacgggaccatgaagatcaaagatgaggagagagacgatacgcttaccattctgctcaaggccacactgctcgctgtgagcggagtctaccccatgtccatccctgcgaccctgtttgtgtggtatttctggcagaaaaagaagcagcggtctggcgtcctttgggacacacccagcccgcctgaagtggagcgcgccgttctggatgacggcatttacagaatcctgcagcgggggctcctgggacgctcccaagtgggcgtcggggtgttccaggacggagtttttcataccatgtggcacgtgacaagaggcgctgtccttatgtatcaggggaaacggctggaaccctcttgggccagcgtgaagaaagatctcatctcctacggaggcggctggagattccaggggagctggaacacgggagaggaggtgcaagttattgccgtcgaacctggcaagaatcccaaaaacgtgcagaccacaccggggacctttaagacccctgagggagaagtgggcgctatcgccctggacttcaagcccgggacatctggatcccctattgtcaatcgcgagggcaaaatcgtgggcctctacgggaacggagttgtgacgaccagcggcacatatgtctctgcgattgctcaggccaaggcctcccaagaagggcccctgcccgagatcgaggatgaagtgtttaaaaagcggaatcttaccattatggacctgcaccctggaagcggcaaaacaagacgctacctgccggctatcgttcgggaggccatcaagagaaagctccgcaccctgattcttgcgcccacgcgggtggtcgcttccgaaatggccgaggccctgaaagggatgcctatcagatatcagacaaccgctgtgaagtctgaacataccggccgcgagattgttgatctcatgtgccacgccacattcaccatgcggctgctgagccccgtgagagtccctaactacaatatgatcattatggacgaggctcattttacagatcccgcctccatcgcggcccggggatatatcagcacccgcgtgggcatgggggaagctgccgctattttcatgacggccacacctccgggatctgtggaggcctttccccagtccaacgctgtcatccaggacgaagagagagatattcctgaacggagctggaattctggctacgactggatcaccgatttccccgggaaaacagtttggtttgtgcctagcattaagtccggaaacgacatcgcgaattgtctccgcaaaaacggcaagagagtgatccaactttctcggaagaccttcgacacggagtatcagaaaaccaagaacaatgattgggactacgtcgtgacaaccgatattagcgagatgggggccaacttcagagctgaccgcgttatcgatccccggagatgcctgaaaccggtgattctgaaggacggccctgaacgcgtcatcctcgccggacccatgcccgtgacagttgcctccgctgcccagcggagaggccgcattgggcggaatcagaacaaagagggagatcaatacgtgtatatgggccagcctctgaataacgacgaagatcacgcgcattggaccgaggctaagatgcttctggacaatatcaacacacccgaggggattatccctgccctctttgaaccggagagagaaaagtctgccgctatcgatggagagtaccgcctgagaggcgaagcccggaaaaccttcgtcgagctgatgcgcagaggggacctccccgtgtggcttagctataaggtcgcgtccgagggctttcagtacagcgatcggcgctggtgcttcgacggagaaagaaataaccaggtgctggaggaaaatatggacgttgagatttggacgaaagaaggcgagcggaagaaactgagacctcgctggctcgatgcccggacatattctgaccccctggctcttagagagtttaaggaattcgccgctgggcgccggtccgtgagcggagatctgatcctcgagattggcaaactgcctcaacacctgaccctcagagcccagaacgctcttgacaatctggtgatgctgcacaactccgaacaggggggaaaggcctaccggcatgcgatggaggaactccccgataccatcgagacactgatgcttctggccctcattgctgtcctgaccggcggcgttacactgtttttcctctctgggaagggacttggcaaaacgagcatcgggctgctgtgtgtgaccgcctcctctgctctcctgtggatggccagcgtggagccgcactggatcgccgcttccattatccttgaatttttcctgatggtcctcctgattcctgagcccgaccgccagagaacacctcaagataatcagctggcgtatgtggttatcggactcctttttatgattctgaccgtggccgctaacgaaatgggcctgctcgagacaaccaagaaagacctggggatcggacatgtcgccgccgagaaccaccagcacgctacgatgcttgatgtggacctgcggcccgccagcgcgtggaccctctacgccgtcgctacaaccgtgatcacacctatgatgcgccataccattgaaaatacgacagccaacatctctctgaccgctattgccaatcaagcggccatcctgatgggcctcgataagggctggcccatttccaaaatggacatcggggttccgcttctggctctgggatgctacagccaggtgaaccctctcacactgaccgccgctgtccttatgctggtggcccactatgctattatcggccccgggctccaggccaaggcgaccagagaggcccagaagcggacagctgccggaatcatgaaaaatcccacggttgatggcattgtggctatcgacctggaccctgtcgtgtacgatgccaagttcgaaaaacaactggggcagattatgctccttatcctgtgtacctctcagattctgctcatgcgcacaacctgggccctgtgcgagtccatcacacttgcgaccggaccgctgacgacactctgggaaggcagccccggcaagttttggaacaccaccatcgctgtgtctatggccaatattttcagagggagctatctggctggagccggcctggccttctccctcatgaaatctcttgggggaggccggcgcgggacaggagctcagggcgagaccctgggcgagaagtggaagagacaactgaaccagctcagcaaatccgaatttaatacatacaagcggagcgggatcatggaggttgacagatccgaagccaaagagggactgaagcgcggcgaaacgaccaaacatgcggtctctcgggggacagccaagcttagatggttcgtggagcgcaacctggtgaagcctgagggaaaagtcattgatctcggctgtgggcggggaggctggagctattactgcgctggcctgaagaaagttaccgaagtgaaggggtatacaaaaggaggccccgggcacgaggaacctatccccatggccacctacggatggaatctggtgaagctccattccggcaaagacgtctttttcatgcctccggagaagtgtgatacgcttctgtgcgacattggggaatctagccccaaccctaccatcgaggagggaagaacactgcgcgtgctcaagatggttgaaccctggctgcggggcaatcagttttgtatcaaaattcttaacccttacatgccctccgtggtcgagaccctggaacagatgcaaagaaagcacggcgggatgctcgtgcgcaatccgctgtctcggaacagcacacacgagatgtattgggtttcctgcggaaccggcaatatcgtgagcgctgtcaacatgacatctagaatgctgctcaaccgcttcaccatggcccatcggaaacctacgtacgagagagatgtggacctgggggcgggaacacgccacgtggccgtcgaacccgaggttgctaatcttgatattatcggccagagaattgaaaacatcaagaatgagcataaatccacctggcactatgacgaagataacccctacaagacctgggcctatcacgggagctacgaggtgaagccttctggatccgctagctctatggtgaatggcgtcgtgcggctgctcacaaaaccctgggacgttattcctatggtgacgcagatcgccatgaccgacacaaccccgtttggccaacagcgcgtcttcaaggagaaagtggatacaagaaccccccgggctaagagagggacaacccagatcatggaagttacggccaaatggctgtggggatttctttcccggaacaagaagcctcgcatttgtaccagagaggaattcacacggaaagtgcgcagcaatgcggccatcggcgctgtctttgtggacgagaaccagtggaattccgccaaggaagctgttgaggatgagagattctgggacctggtgcatcgggaacgcgagctccacaaacaagggaagtgcgccacctgcgtctataacatgatgggaaaaagagaaaagaagctgggcgagtttgggaaagccaagggcagccgggcgatttggtacatgtggctgggagctcgcttcctcgaattcgaggccctgggctttatgaatgaggatcattggttctctagagaaaacagcctttccggggtggagggagaaggcctgcacaaactcgggtacatcctgcgggacatttctaagatccccggaggcaatatgtatgccgatgacacagctgggtgggatacccgcatcacggaggacgatcttcagaacgaggccaaaattacagacatcatggaacctgagcatgctctgctcgccaccagcatttttaagctgacataccagaataaagtcgtgagagttcagcggcccgcgaagaacggcaccgtgatggatgtcatctcccgcagagaccaacggggatctggccaggtggggacgtatggactgaacaccttcacaaatatggaagtgcagctcattagacagatggagagcgaaggcatctttctgccgtccgagcttgagacccctaacctggccgaacgcgttctcgactggctggagaagcacggggctgaacggcttaaaagaatggccatctctggagatgactgtgtggtcaagcccattgatgaccgcttcgctacagccctgaccgcgctcaatgatatgggcaaaatccggaaggacattcctcaatgggagcccagcaaagggtggaacgattggcagcaggtgcctttttgctcccaccatttccaccagctgatcatgaaggacggcagagaaattgttgtgccctgtcgcaatcaagatgagctggtcggacgggccagagtgagccagggcgctgggtggtctctccgcgagacagcctgcctgggaaagtcctacgctcagatgtggcaacttatgtattttcatcggagagacctgcgcctcgccgctaacgccatctgtagcgcggtcccggtggattgggttcctacctctcggacgacatggtccatccacgcccaccatcagtggatgaccaccgaagacatgctgagcgtgtggaatagagtctggattgaggaaaacccctggatggaggacaaaacacacgtgtcctcttgggaagaggttccctaccttggcaagcgggaggatcagtggtgcgggagcctgatcggactcaccgctagagccacatgggccacgaatattcaggtggctatcaaccaagtccgccggctgattggcaatgaaaactatctggactacatgacctccatgaaaagattcaagaatgagagcgatacagaaggggccctctggtga

SEQ ID NO: 18805 - RNA, 9879 nt, synthetic construct
  misc_feature 1..9879: note = derived and/or modified CDS sequence (opt5) from DENV-1__GU056033__SS-prME
  source 1..9879: mol_type = other RNA
agcgtgacaatgctgctcatgctgcttcccacagccctggctttccacctcacgaccagaggaggggaacctcatatgatcgtctccaagcaggaacggggaaaatctctgctttttaagacaagcgttggcgtgaacatgtgcaccctgattgccatggacctcggggaactgtgtgaagatacaatgacctacaaatgcccccgcatcacagaagcggaacccgacgatgtggactgttggtgcaatgctaccgatacgtgggtcacctatggaacatgttcccagaccggcgagcacagacgggacaagcgctctgtggccctggcccctcatgttgggctcggactggagacaagaaccgaaacgtggatgagctccgagggcgcttggaaacagattcagcgggtggaaacatgggcccttcgccaccccggcttcaccgtcatcgctctgtttctcgcccatgcgattgggacatctatcacccagaagggaatcattttcatcctgcttatgctggtgacccctagcatggccatgagatgcgttggcattgggaaccgggattttgtggagggactctccggcgctacatgggtcgacgtggtgctggagcacgggagctgtgtcacgaccatggccaagaataaacccacactggatatcgaactcctgaagaccgaggttacaaaccctgctgtgcttcgcaaactgtgcattgaagccaagatctctaataccacgacagactccagatgtccgacccaaggagaggcgaccctcgtggaagaacaggatgccaacttcgtctgccggcgcacatttgtggacagaggctggggcaatgggtgtggactgttcggcaaagggagccttctgacctgcgctaagtttaagtgcgttacaaaactcgagggaaagattgtgcagtacgaaaacctgaaatattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggccagcacatcccaagagacctggaatcgccaggatctgctggtcacattcaaaaccgctcacgcgaagaagcaggaagtggttgtgctcggatctcaagagggcgccatgcacaccgctctgacaggggccacggaaattcagaccagcggaacaaccacaatctttgccggccatcttaaatgcagactgaagatggacaaactcaccctgaaggggatgtcctatgtcatgtgtacgggcagcttcaaactggagaaggaagtggctgagacacagcacggaaccgttcttgtgcaggtcaagtacgagggcaccgatgccccgtgcaaaattcctttctctacacaagacgaaaagggggtgacccagaacggacggctcatcacagcgaatcccatcgtgacggataaagagaagcctgttaacattgaaaccgagccgccctttggcgagtcctatatcgtcgtgggggctggagaaaaagccctgaagctgagctggttcaagaaaggctctagcattgggaagatgtttgaggccacagctagaggcgcccgccggatggctatcctcggagacaccgcctgggatttcggctccattgggggagtgtttacatctgtcggcaaactggtgcatcaggttttcgggaccgcgtacggagtgctttttagcggcgtctcctggacgatgaagatcgggatcggcattctgctcacctggctgggactgaatagcagatctacatcccttagcatgacctgtatcgccgtgggcatggttacactctacctgggggtgatggtccaggctgactctggatgcgtgattaactggaaaggccgcgaactgaagtgtgggtccggaatcttcgttaccaacgaggtgcacacatggaccgaacaatataagtttcaggccgatagccctaaacggctctccgctgccattggcaaggcgtgggaggagggggtctgcggcatcagatctgccacgcgcctggaaaatattatgtggaaacagatcagcaacgagcttaatcatatcctgctcgaaaacgacatgaagttcacagtggtggtcggagacgttaatggcattctggctcaggggaaaaagatgatccggccgcaacccatggagcacaaatactcctggaagtcttggggaaaggccaaaattatcggcgctgatattcagaacaccacctttatcatcgacgggcctgatacacccgaatgtcctgacgatcagagagcctggaatatttgggaggtggaggactatggattcggcatctttaccacgaacatttggctgaaacttcgcgatagctacacacagatgtgcgaccaccggctcatgtccgccgctatcaaagatagcaaggcggtgcatgccgacatgggctattggattgaatctgagaaaaatgaaacctggaagctggctaaggcctccttcatcgaggtcaaaacatgtatctggcccaagagccacaccctgtggtctaacggggtgctcgaatccgagatgattatcccgaaaatttacggaggccctatcagccaacataattatagacccgggtacttcacacagaccgccggaccttggcacctgggcaaacttgagctggattttgacctctgcgaagggacgaccgttgtggtcgatgagcactgcggaaaccgcggcccctctctgcggacaaccacagtgaccggcaaaattatccatgaatggtgttgcagaagctgtacgctgcctccccttcggttccgcggggaggacggatgctggtacggcatggagatcagaccggttaaggaaaaggaggaaaatctcgtgcggtccatggtcagcgctgggtctggagaggtggactcctttagcctgggcattctgtgtgtttccatcatgattgaagaggtgatgagatctcgctggagccggaaaatgctcatgacagggaccctggccgtcttccttctgctcatcatgggacagctgacatggaacgatctgattagactttgcatcatggtgggcgcgaatgcttccgaccgcatgggcatggggaccacctatctggccctcatggccacatttaagatgagacctatgttcgctgtgggactgctctttcggcgcctgacgtctagagaggtccttctgctcaccattggcctgagcctggttgcctccgtggaacttcccaactctctggaggaactcggggatggactggcgatgggcatcatgatgctcaaactgcttacagagttccaaccccaccagctgtggaccacactcctgagcctgacctttatcaagacgacactttccctggactacgcttggaaaaccaccgccatggccctcagcattgtgtctctgttccctctctgtctgtccacaaccagccagaagacaacgtggcttccggtcctgctggggtcttttggatgcaagcccctcaccatgttcctgatcacagaaaacaaaatttggggccggaagtcctggcctcttaatgagggcatcatggctattgggatcgtgagcatcctgctctcttccctgctcaaaaacgatgttcccctggccggacctcttattgctggcgggatgctgatcgcctgttatgtgattagcggatccagcgcggacctgtctctcgagaaggccgctgaagtcagctgggagcaggaagccgagcattccggcacctctcacaatatcctggtggaagttcaagatgacgggacaatgaaaattaaggatgaggagcgcgacgatacccttacgatcctgctcaaagctaccctgctcgccgtgagcggagtctaccccatgtccatccctgccacactgtttgtgtggtatttctggcagaagaagaaacagagatctggcgtcctttgggacacccccagcccgcctgaagtggagcgggctgttctggatgacggcatttaccgcatctcccagagagggctgctcggacggtctcaagtgggcgtcggggtgttccaggacggagtttttcatacaatgtggcacgtgacccgcggcgcggtcctgatgtatcaggggaagagacttgaacccagctgggcctccgtgaaaaaggatctgattagctacggaggcggctggcggttccaggggtcttggaacacaggagaggaggtgcaagttatcgctgtcgaacctggcaaaaatcccaagaacgtgcagacgaccccggggacatttaagacccctgagggagaagtgggcgccattgccctcgacttcaaacccgggacctccggaagccctatcgtcaatagagagggcaagattgtgggcctgtacgggaacggagttgtgacaacgtctggcacctatgtctccgctatcgcccaggcgaaagctagccaagaagggcccctccccgagatcgaggatgaagtgtttaagaaacgcaatctgacaattatggaccttcaccctggatccggcaagacccggagatacctgccggccatcgttcgcgaggccattaagcggaaactgagaacactcatcctggctcccacccgcgtggtcgcctctgaaatggcggaggctcttaaggggatgcctattcggtatcagacgacagccgtgaaaagcgaacataccggcagagagatcgttgatctgatgtgccacgccaccttcacaatgcgcctcctgtcccccgtgcgggtccctaactacaatatgatcattatggacgaggctcattttaccgatcccgccagcatcgctgccagaggatatatttctacacgggtgggcatgggggaagcggccgctatcttcatgaccgccacgcctccgggatccgtggaggcttttccccagagcaacgccgtcattcaggacgaagaaagagatatccctgaaagatcttggaatagcggctacgactggatcacagatttccccgggaagaccgtttggtttgtgccttccattaaatctggaaacgacatcgccaattgtctgcggaagaacggcaagcgcgtgattcaactcagcagaaaaacattcgacaccgagtatcagaagacgaaaaacaatgattgggactacgtcgtgaccacagatatctccgagatgggggctaacttccgggcggacagagttattgatccccgccggtgccttaagccggtgatcctgaaagacggccctgaaagagtcattctggccggacccatgcccgtgaccgttgcttctgccgcccagcgccggggcagaatcgggcgcaatcagaacaaggagggagatcaatacgtgtatatgggccagcctctcaataacgacgaagatcacgctcattggacagaggccaagatgctgcttgacaatatcaacacccccgaggggattatccctgcgctgtttgaaccggagcgggaaaagagcgctgccattgatggagagtacagactccgcggcgaggccagaaagacattcgtcgagctgatgcggcgcggggacctgcccgtgtggctctcctataaagtcgctagcgagggctttcagtactctgatagacggtggtgcttcgacggagaacgcaataaccaggtgcttgaggaaaatatggacgttgagatctggaccaaggaaggcgagcgcaagaagctgcggcctagatggctggatgcccgcacgtattccgaccccctcgcgctgcgggagtttaaagagttcgccgctgggagacgcagcgtgtccggagatcttattctggagatcggcaagctccctcaacacctgacactgcgggcccagaacgctctcgacaatcttgtgatgctgcacaactctgaacaagggggaaaggcctacagacatgctatggaggaactgcccgataccatcgagaccctcatgctgcttgccctgattgcggtcctcacaggcggcgttaccctgtttttcctgagcgggaaaggactcggcaagacatccatcgggcttctgtgtgtgacggcctctagcgctctgctctggatggcctccgtggagccgcactggattgctgccagcatcattctggaatttttccttatggtcctgctcatccctgagcccgaccggcagcgcacccctcaagataatcagctggcctatgtggttatcggactgctctttatgattcttacagtggctgcgaacgaaatgggcctgctggagaccaccaaaaaggacctcgggatcggacatgtcgccgctgagtctcaccagcacgccaccatgctggatgtggaccttagacccgcctccgcttggacgctgtacgccgtcgcgaccacagtgattacccctatgatgcggcatacaatcgaaaacaccacggccaatattagcctcacagctatcgccaaccaagctgccattctgatgggcctggataaaggctggcccatctctaagatggacatcggggttccgctccttgcgctgggatgctactcccaggtgaatcctctgaccctcacagccgctgtcctgatgcttgtggcccactatgctattatcggccccgggctgcaggccaaggctacccgcgaggcccagaaaagaaccgcggccggaattatgaagaaccccacagttgatggcatcgtggctattgacctcgaccctgtcgtgtacgatgccaaattcgaaaagcaactggggcagatcatgctgctcatcctttgtacgagccagattctgctgatgcggaccacatgggctctctgcgagtctatcaccctggccacaggaccgcttaccacgctgtgggaaggcagccccggcaaattttggaatacaaccattgccgtgtccatggcgaacatcttccgcgggtcttatctcgctggagccggcctggctttcagcctgatgaagtccctcgggggaggcagacgggggaccggagcccagggcgagacacttggcgagaagtggaaacgccaactgaatcagctgagcaagaccgaatttaacacatacaaaagatccgggattatggaggttgaccggtctgaagccaaggagggactcaaaagaggcgaaacgaccaagcatgctgtcagccgcgggacagccaagctgcggtggttcgtggagagaaatcttgtgaaacctgagggaaaggtcatcgatctgggctgtgggcgcggaggctggtcctattactgcgcgggcctcaaaaaggttaccgaagtgaaagggtatacaaagggaggcctggggcacgaggaacccatccctatggccacctacggatggaacctggtgaaactccattctggcaaggacgtctttttcatgccccctgagaagtgtgatacgcttctgtgcgacattggggaaagctccccgaatcccaccatcgaggagggacggacactgagagtgctcaaaatggttgaaccttggctgcgcggcaaccagttttgtattaagatccttaatccctacatgccttctgtggtcgagaccctggaacagatgcaacggaaacacggcgggatgctcgtgagaaaccccctgagccgcaattccacacacgagatgtattgggttagctgcggaaccggcaacattgtgtctgctgtcaatatgacatcccggatgctgctcaacagattcaccatggcccatcgcaagccgacgtacgagcgggatgtggacctgggggctggaacaagacacgtggccgtcgaacctgaggttgcgaaccttgatatcattggccagcgcatcgaaaatatcaaaaacgagcataagagcacctggcactatgacgaagataatccctacaagacctgggcctatcacgggtcttacgaggtgaaaccctccggaagcgcttcttccatggtgaacggcgtcgtgaagctgctcacaaaaccttgggacgttattcccatggtgacgcagatcgccatgaccgacacaaccccttttggccaacagagagtcttcaaggagaaagtggatacacggaccccgcgcgctaagagagggacaacccagattatggaagttacggccaagtggctgtggggatttcttagccggaataaaaagcccagaatctgtacccgggaggagttcacacgcaaagtgagatccaacgctgccattggcgcggtctttgtggacgagaatcagtggaacagcgccaaggaagctgttgaggatgagcggttctggaatctggtgcatcgcgaaagagagctccacaaacaagggaagtgcgctacctgcgtctataacatgatgggaaagcgggagaaaaagctgggcgagtttgggaaagccaagggctctcgcgccatctggtacatgtggctgggagccagattcctcgagttcgaggcgctgggctttatgaatgaggaccattggttcagccgggaaaactccctttctggggtggagggagaaggcctgcacaaactcgggtacatcctgcgcgatattagcaagatccctggaggcaatatgtatgctgacgatacagccgggtgggacaccagaattacggaggatgaccttcagaacgaggccaaaatcacagatattatggaacccgagcatgctctgctcgccacctccatctttaagctgacataccagaataaggtcgtgcgggttcagcgccctgctaaaaacggcaccgtgatggacgtcatctctagacgggatcaacgcggaagcggccaggtggggacgtatggactgaacaccttcacaaatatggaagtgcagctcattagacagatggagtccgaaggcatctttctgccctctgagcttgagaccccgaacctggccgaacgggttctcgactggctggagaagcacggggcggaaagacttaaacgcatggccattagcggagacgattgtgtggtcaagcctatcgacgatcggttcgctacagccctgaccgctctcaatgacatgggcaaagtgagaaaggatattccccaatgggagccttccaaggggtggaacgactggcagcaggttcccttttgcagccaccatttccaccagctgatcatgaaagatggccgcgaaatcgtggtcccttgtcggaatcaagacgagctggtgggcagagcccgcgtctctcagggcgcggggtggtccctccgggagacagcctgcctgggaaagagctacgctcagatgtggcaacttatgtattttcatagacgcgatctgcggctcgccgctaacgccatttgttctgctgtgcccgttgactgggtgccgacctccagaacgacatggagcatccacgcccaccatcagtggatgaccaccgaagatatgctgtccgtctggaatcgcgtgtggattgaggaaaacccttggatggaggacaaaacacacgtttctagctgggaagaggtgccctaccttggcaagcgggaggaccagtggtgcgggtccctgatcggactcaccgcgagagccacatgggctacgaatattcaggtcgccatcaaccaagtgcggagactgattggcaatgaaaactatctggattacatgaccagcatgaaacgcttcaagaatgagtctgaccccgaaggggccctctggtga

SEQ ID NO: 18806 - RNA, 9879 nt, synthetic construct
  misc_feature 1..9879: note = derived and/or modified CDS sequence (opt5) from DENV-1__GU131833__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggacgtcctatgtgatgtgtacaggcagcttcaaactggagaaggaagtcgccgagacccagcacggaaccgtgcttgttcaggtgaagtacgagggcacagatgcgccgtgcaaaattcctttcctcacccaagacgaaaagggggtcacacagaacggacggctgatcacggctaatcccatcgtgaccgataaagagaagcctgtgaacattgaaacagagcccccctttggcgagtcttatatcgttgtcggggccggagaaaaagccctgaagctctcctggttcaagaaaggcagctctattgggaagatgtttgaggctaccgccagaggcgctcgccggatggccatcctgggagacacagcgtgggatttcggcagcattgggggagtgtttacctccgtgggcaaacttgtccatcaggtgttcgggacggcctacggagttctgttttctggcgtgagctggaccatgaagatcgggatcggcattctcctgacatggctgggacttaattccagaagcacctctctctccatgacatgtatcgctgtcggcatggtgaccctgtacctgggggttatggtgcaggccgacagcggatgcgtcattaactggaaaggccgcgaactcaagtgtgggtctggaatcttcgtgacaaacgaggttcacacctggacggaacaatataagtttcaggctgattcccctaaacggctgagcgccgcgattggcaaggcctgggaggagggggtgtgcggcatcagatccgctacacgccttgaaaatattatgtggaaacagatctctaacgagctgaatcatatcctcctggaaaacgacatgaagttcaccgtcgtggtgggagacgccaatggcattctggctcaggggaaaaagatgatccggccgcaacccatggagcacaaatacagctggaagtcctggggaaaggccaaaattatcggcgccgatattcagaacaccacatttatcatcgacgggcctgatacccccgaatgtcctgacgatcagagagcttggaatatttgggaggtcgaggactatggattcggcatctttacgacaaacatttggcttaagctccgcgattcttacacccagatgtgcgaccaccggctgatgagcgcggccatcaaagattccaaggctgttcatgccgacatgggctattggattgaaagcgagaaaaatgaaacatggaagctggccagagcttctttcatcgaggtgaagacctgtacatggcccaaatcccacaccctctggagcaacggggtgctggaatctgagatgatcattccgaagatctacggaggccctatttcccaacataattatcgccccgggtacttcacgcagaccgccggaccttggcaccttggcaaactggagctcgattttgacctgtgcgaagggacaaccgtcgtggttgatgagcactgcggaaaccggggccccagcctgagaacaaccacggtgacaggcaagatcattcatgaatggtgttgccggtcttgtacccttcctcccctccgcttcagaggggaggacggatgctggtacggcatggagatccggccggtcaaagaaaaggaggaaaatctggtgagaagcatggtttccgcggggagcggagaggtggactctttttccctgggcatcctctgtgtcagcattatgatcgaagaggtgatgcgctcccggtggtctagaaagatgctgatgacagggacccttgctgttttcctgctcctgattatgggacagctgacctggaacgatcttatccgcctgtgcattatggtgggcgccaatgccagcgacagaatgggcatggggacaacgtatctcgctctgatggccacctttaaaatgcggcctatgttcgcggtcggactcctgtttcgcagacttacatcccgggaggtgctgctcctgaccatcggcctgtctcttgtggctagcgtcgaactgcccaactccctcgaggaactgggggatggactcgccatgggcattatgatgctgaagcttctgacagagttccaaccccaccagctctggaccacgctgctgtctcttacatttatcaaaaccaccctgagcctcgactacgcctggaagacaaccgctatggccctgtccatcgttagcctcttccctctgtgtctttctacaacgtcccagaaaaccacatggctgccggtgctgctcgggagctttggatgcaagcccctgaccatgttccttattacagaaaacaagatctggggccgcaaatcttggcctctgaatgagggcattatggctatcgggattgtgtccatcctcctgagctctctcctgaagaacgatgtcccccttgccggacctctgatcgcgggcgggatgctgattgcctgttatgtgatctccggaagctccgctgacctcagcctggagaaagccgctgaagtttcttgggagcaggaagccgagcatagcggcacctcccacaatattcttgtggaagtccaagatgacgggacgatgaagatcaaagatgaggagaaggacgataccctgacaattctcctgaaagccaccctcctggctgtgtctggagtttaccccatgagcatccctgcgacactttttgtgtggtatttctggcagaagaagaaacagagatccggcgtcctgtgggacaccccctctccgcctgaagtggagcgggccgtcctggatgacggcatctaccgcattctccagagagggctgcttggacggagccaagtgggcgttggggtgttccagaacggagtctttcatacaatgtggcacgtgacgcgcggcgctgttctgatgtatcaggggaagagactcgaaccctcctgggcctctgtgaaaaaggacctgatcagctacggaggcggctggcggttccaggggtcctggaataccggagaggaggtccaagtgattgccgtggaacctggcaaaaaccccaagaatgttcagacaaccccggggacctttaagacacctgagggagaagtcggcgctatcgccctcgatttcaaacccgggacgagcggatctcctattgtgaacagagagggcaagatcgtgggcctgtacgggaatggagtcgtgaccacatccggcacctatgttagcgcgattgctcaggccaaagcctctcaagaagggccccttcccgagatcgaggacgaagtgtttaagaaacgcaacctgacaatcatggatctgcaccctggatccggcaagacccggagatacctcccggctattgtccgcgaggccatcaagcggaaactgagaacgcttattctggcgcccacacgcgtggttgctagcgaaatggccgaggccctcaaggggatgcctatccggtatcagaccaccgctgtgaaatccgaacatacaggcagagagattgtcgacctgatgtgccacgccaccttcacaatgcgcctgctctctcccgtgcgggttcctaattacaacatgatcatcatggatgaggctcattttaccgaccccgccagcattgcggccagaggatatatctccacgcgggtgggcatgggggaagctgccgctattttcatgacagccacccctccgggaagcgtcgaggcctttccccagtctaatgctgtgatccaggatgaagagcgcgacattcctgaaagatcctggaacagcggctacgattggatcacagacttccccgggaagaccgtgtggtttgtcccttctatcaaaagcggaaatgatattgcgaactgtcttcggaagaacggcaagcgcgttatccaactgtccagaaaaacgttcgacaccgagtatcagaagacaaaaaataacgactgggattacgtggtgaccacagacatttctgagatgggggccaatttccgggctgatagagtcatcgacccccgccggtgcctgaagccggtgattctcaaagatggccctgaaagagttatcctggccggacccatgcccgtgaccgtcgccagcgctgcccagcgccggggcagaattgggcgcaaccagaataaggagggagaccaatacgtgtatatgggccagcctcttaacaatgatgaagaccacgcgcattggacagaggctaagatgctgctcgataacatcaatacccccgaggggatcattcctgccctgtttgaaccggagcgggaaaaatccgccgctatcgacggagagtacagactgcgcggcgaagccagaaagacgttcgttgagctcatgcggcgcggggatcttcccgtgtggctgtcttataaagtcgcgagcgagggctttcagtactccgacagacggtggtgcttcgatggagaacgcaacaatcaggtgctggaggaaaacatggacgtcgagatttggacaaaggaaggcgagagaaaaaagctccggcctagatggctggacgcccgcacctatagcgatccccttgctctgcgggagtttaaagaattcgccgctgggagacgctctgtgtccggagacctcatcctggagattggcaagctgcctcaacacctcacccttcgggcccagaatgctctggataacctggttatgctccacaatagcgaacaggggggaaaggcctacagacatgcgatggaggaactgcccgacacaatcgagacccttatgctgctcgccctgatcgctgtgctgacaggcggcgtgacgctctttttcctttccgggaaaggactgggcaagacctctattgggctgctctgtgtcacagccagctccgctctgctttggatggcctctgttgagccgcactggatcgccgctagcattatcctggaatttttcctcatggtgctgctgattcctgagcccgatcggcagcgcacccctcaagacaaccagctcgcgtatgtggtcatcggacttctgtttatgatcctgacagtggccgctaacgaaatgggcctcctggagaccacgaaaaaggatcttgggattggacatgttgccgccgagaatcaccagcacgctaccatgctggacgtggatctcagacccgcctccgcgtggacactgtacgccgtcgctaccacagtgatcacccctatgatgcggcatacgattgaaaacacaaccgccaatatcagcctgacagctattgccaaccaagcggccatcctcatgggccttgacaaaggctggcccatttctaagatggatatcggggtcccgctgctggctctcggatgctactcccaggtgaatcctctgacccttaccgccgctgttctgatgctcgtggcccactatgctatcattggccccgggctgcaggccaaggcgacacgcgaggcccagaaaagaacggctgccggaatcatgaagaaccccaccgtcgacggcattgtggctatcgatctggaccctgttgtgtacgacgccaaattcgaaaagcaactcgggcagattatgcttctgatcctgtgtacaagccagatcctcctgatgcggaccacatgggccctttgcgagtctattaccctggcgacgggaccgctcacaaccctgtgggaaggctcccccggcaaattttggaataccacaatcgctgtcagcatggccaacattttccgcgggtcttatctggctggagccggcctcgccttcagccttatgaagtccctggggggaggcagacgggggaccggagctcagggcgagacactgggcgagaagtggaaacgccaactcaatcagctgtctaagagcgaatttaacacgtacaaaagatccgggatcatggaggtggatcggagcgaagccaaggagggacttaaaagaggcgaaaccacaaagcatgcggtgtcccgcgggaccgccaagctgcggtggttcgttgagagaaatctcgtcaaacctgagggaaaggtgattgacctgggctgtgggcgcggaggctggtcttattactgcgctggcctgaaaaaggtgacagaagtcaaagggtataccaagggaggccccgggcacgaggaacctatccccatggccacgtacggatggaacctcgttaaacttcatagcggcaaggatgtgtttttcatgcctccggagaagtgtgacaccctgctgtgcgatatcggggaatcctctcccaatcctacaattgaggagggacggaccctcagagtgctgaaaatggtcgaaccctggcttcgcggcaaccagttttgtatcaagattctgaatccttacatgcccagcgtggttgagacactcgaacagatgcaacggaaacacggcgggatgctggtgagaaacccgctgtcccgcaattctacccacgagatgtattgggtcagctgcggaacaggcaacatcgtgtccgctgttaacatgaccagccggatgctcctgaatagattcacgatggcccatcgcaagcctacatacgagcgggacgtggatcttggggcgggaaccagacacgtcgccgtggaacccgaggtggctaacctggacattatcggccagcgcattgaaaatatcaaaaacgagcataagtctacctggcactatgatgaagacaatccctacaagacatgggcctatcacgggtcctacgaggtcaaacctagcggatctgcttccagcatggttaacggcgtggtgagactcctgacgaagccctgggatgtcatccctatggtgacccagattgccatgacagacaccacaccgtttggccaacagcgggttttcaaagagaaggtggacacccgcacacccagagctaaacgggggaccacgcagatcatggaagtcaccgccagatggctttggggatttctgtctcggaataagaagcctcgcatttgtacaagagaggaattcacccggaaagtgcgctccaacgcggccatcggcgctgtttttgtggatgagaatcagtggaacagcgccaaggaagctgtcgaggacgagagattctgggatctcgtgcatcgggaacgcgagctgcacaaacaagggaagtgcgccacatgcgtttataatatgatgggaaaaagagaaaagaagctgggcgagtttgggaaagccaagggctcccgggcgatttggtacatgtggctcggagctcgcttcctggaattcgaggcccttggctttatcaacgaggaccattggttcagcagagaaaattctctgagcggggtggagggagaaggcctccacaaactggggtacatccttcgggatatttccaagatccccggaggcaacatgtatgccgacgataccgctgggtgggacacgcgcattacagaggatgacctgcagaatgaggccaaaatcaccgatattatggaacctgagcatgctctcctggccacatctatctttaagctgacctaccagaacaaagtcgtgagagtccagcggcccgcgaagaacggcacggtgatggacgttatcagccgcagagatcaacggggatccggccaggtggggacctatggactcaatacattcaccaacatggaagtccagctgattagacagatggagtctgaaggcatctttcttccgagcgagctggagacacctaatctcgccgaacgcgtgctggactggcttgagaagcacggggctgaacggctgaaaagaatggccatttccggagacgattgtgtggttaagcccatcgacgatcgcttcgctaccgccctcacagcgctgaacgacatgggcaaagtgcggaaggatattcctcaatgggagccctctaaagggtggaatgactggcagcaggtccctttttgcagccaccatttccaccagctgatcatgaaggatggcagagaaatcgtggttccctgtcgcaaccaagacgagctcgtgggacgggccagagtctcccagggcgctgggtggagcctgcgcgagaccgcctgccttggaaagtcttacgctcagatgtggcaactgatgtattttcatcggagagatctccgcctggccgctaatgccatttgttccgcggtgccggtcgactgggtgcctacgagccggacaacctggtctatccacgcccaccatcagtggatgaccacagaagatatgctttccgtttggaacagagtgtggattgaggaaaatccctggatggaggacaaaacccacgtcagctcctgggaagaggtgccctacctgggcaagcgggaggaccagtggtgcgggtctctcatcggactgacagctagagccacgtgggccaccaacattcaggttgctatcaatcaagtgcgccggctgattggcaacgaaaattatctcgattacatggccagcatgaaaagattcaagaacgagtccgaccctgaaggggcgctgtggtga

SEQ ID NO: 18807 - RNA, 9879 nt, synthetic construct
  misc_feature 1..9879: note = derived and/or modified CDS sequence (opt5) from DENV-1__GU131834__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaaacactgaagctgagctggttcaagaaaggctctagcattgggaagatgtttgaggccaccgctagaggcgcccgccggatggctatcctcggagacacagcctgggatttcggctccattgggggagtgtttacctctgtgggcaaactggtccatcaggtgttcgggacggcgtacggagttctttttagcggcgtgtcctggaccatgaagatcgggatcggcattctgctcacatggctgggactgaatagcagatctacctcccttagcatgacatgtatcgccgtcggcatggtgaccctctacctgggggttatggtgcaggctgactctggatgcgtcattaactggaaaggccgcgaactgaagtgtgggtccggaatcttcgtgacaaacgaggttcacacctggacggaacaatataagtttcaggccgatagccctaaacggctctccgctgccattggcaaggcgtgggaggagggggtgtgcggcatcagatctgccacacgcctggaaaatattatgtggaaacagatcagcaacgagcttaatcatatcctgctcgaaaacgacatgaagttcaccgtcgtggtgggagacgctaatggcattctggcccaggggaaaaagatgatccggccgcaacccatggagcacaaatactcctggaagtcttggggaaaggctaaaattatcggcgccgatattcagaacaccacatttatcatcgacgggcctgatacccccgaatgtcctgacggacagagagcctggaatatttgggaggtcgaggattatggcttcggcatctttacgacaaacatttggctgaagcttcgcgacagctacacccagatgtgcgatcaccggctcatgtccgctgcgatcaaagacagcaaggccgttcatgctgatatggggtattggattgaatctgagaaaaatgaaacatggaagctggccagagcctccttcatcgaggtgaagacctgtacatggcccaaaagccacaccctgtggtctaacggagtgctcgaatccgagatgatcattccgaagatctacggcgggcctattagccaacataattatcgccccggatacttcacgcagaccgctggcccttggcacctggggaaacttgagctggactttgatctctgcgaaggaacaaccgtcgtggttgacgagcactgcggcaaccggggcccctctctgagaacaaccacggtgacagggaagatcattcatgaatggtgttgccggagctgtaccctgcctccccttcgcttcagaggagaggatggctgctggtacgggatggagatccggccggtcaaagaaaaggaggaaaatctcgtgagatccatggttagcgccggatctggcgaggtggactcctttagcctggggatcctgtgtgtctccattatgatcgaagaggtgatgcgctctcggtggagcagaaagatgctcatgacaggaaccctggcggttttccttctgctcattatgggccagctgacctggaacgacctgatccgcctttgcattatggtgggcgctaatgcctccgatagaatggggatgggaacaacgtatctggccctcatggctacctttaaaatgcggcctatgttcgccgtcggcctgctctttcgcagactgacatctcgggaggtgcttctgctcaccatcgggctgagcctggtggcgtccgtcgaacttcccaactctctggaggaactcggagacggcctggctatggggattatgatgctcaagctgcttacagagttccaaccccaccagctgtggaccacgctcctgagcctgacatttgttaaaaccaccctttccctggattacgcctggaagacaaccgccatggtgctcagcatcgtgtctctgttccctctctgtctgtccacaacgagccagaaaaccacatggcttccggtcctgctgggatcttttggctgcaagcccctcaccatgttctttatcacagaaaacaagatttggggccgcaaatcctggcctctgaatgaggggatcatggctattggaatcgtgagcattcttctgtcttccctcctgaagaacgacgttcccctcgccggccctctgatcgctgggggaatgcttatcgcctgttatgtgattagcggctccagcgcggatctgtctctggagaaagccgctgaagtcagctgggagcaggaagccgagcattccggggcttctcacaatatcctcgtggaagttcaagacgatggaaccatgaagattaaagacgaggagagagatgacacgctgaccatccttctgaaggccacactcctggccgtgagcggcgtctaccccatgtccattcctgctaccctcttcgtgtggtatttctggcagaaaaagaagcagcggtctggcgtcctgtgggatacacccagcccgcctgaagtggagcgcgcggttcttgacgatgggatctacagaatcctgcagcggggactgctcggccgctcccaagtgggggtcggagtgtttcaggacggcgttttccataccatgtggcacgtgacaagaggggccgtcctgatgtatcagggaaaacggcttgaaccctcttgggctagcgtgaagaaagacctgatttcctacggcggcgggtggagatttcagggaagctggaacacgggcgaggaggtgcaagttatcgccgtcgaacctgggaagaatcccaaaaacgtgcagaccacaccgggaaccttcaagacccctgagggcgaagtgggggccattgctctcgattttaagcccggaacatctggctcccctatcgtcaatcgcgagggcaaaattgtggggctgtacggaaacggcgttgtgacgaccagcgggacatatgtctctgccatcgcgcaggctaaggcctcccaagaaggacccctccccgagattgaggacgaagtgttcaaaaagcggaatctgaccatcatggatcttcaccctggcagcgggaaaacaagacgctacctgccggccatcgttcgggaggctattaagagaaagctgcgcaccctcatcctggcccccacgcgggtggtcgcgtccgaaatggctgaggcccttaaaggcatgcctattagatatcagacaaccgccgtgaagtctgaacataccggacgcgagatcgttgacctgatgtgccacgctacatttaccatgcggctcctgagccccgtgagagtccctaactacaatatgattatcatggatgaggcccatttcacagaccccgcttccatcgccgcgcggggctatattagcacccgcgtggggatgggagaagccgctgccatctttatgacggctacacctccgggctctgtggaggccttcccccagtccaacgccgtcattcaggatgaagagagagacatccctgaacggagctggaattctgggtacgattggattaccgactttcccggaaaaacagtttggttcgtgcctagcatcaagtccggcaacgatatcgctaattgtctgcgcaaaaacgggaagagagtgattcaactctctcggaagaccttcgacacggagtatcagaaaaccaagaacaatgactgggattacgtcgtgacaaccgacatcagcgagatgggcgcgaactttagagccgatcgcgttattgacccccggagatgccttaaaccggtgatcctgaaggatggacctgaacgcgtcattctggctggccccatgcccgtgacagttgcctccgccgctcagcggagagggcgcatcggacggaatcagaacaaagagggcgaccaatacgtgtatatggggcagcctctcaataacgatgaagaccacgcccattggaccgaggcgaagatgctgcttgataatattaacacacccgagggaatcatccctgctctgttcgaaccggagagagaaaagtctgccgccattgacggcgagtaccgcctcagaggggaagctcggaaaacctttgtcgagctgatgcgcagaggcgatctgcccgtgtggctcagctataaggtcgcctccgagggattccagtacagcgaccggcgctggtgctttgatggcgaaagaaataaccaggtgcttgaggaaaatatggacgttgagatctggacgaaagaaggggagcggaagaaactgagacctcgctggctggacgcgcggacatattctgatcccctcgccctgagagagttcaaggaatttgctgccggacgccggtccgtgagcggcgaccttattctggagatcgggaaactccctcaacacctgaccctgagagctcagaacgccctcgataatcttgtgatgctgcacaactccgaacagggaggcaaggcttaccggcatgccatggaggaactgcccgacaccattgagacactcatgctgcttgcgctgatcgccgtcctcaccggcggggttacactgttctttctgtctggaaagggcctcgggaaaacgagcatcggacttctgtgtgtgaccgcttcctctgccctgctctggatggctagcgtggagccgcactggattgccgcctccatcattctggaattctttcttatggtcctgctcatccctgagcccgatcgccagagaacacctcaagacaatcagctggcttatgtggttattggcctgctcttcatgatccttaccgtggcggccaacgaaatggggctgctggagacaaccaagaaagatctcggaatcggctacgtcgctgccgagaaccatcagcacgccacgatgctggacgtggatcttcggcccgctagcgcctggaccctgtacgcggtcgccacaaccgtgattacacctatgatgcgccacaccatcgaaaatacgacagctaacatttctctcaccgccatcgctaatcaagccgcgattctgatgggcctggacaaggggtggcccatctccaaaatggatattggagttccgctccttgccctgggctgctatagccaggtgaaccctctgacactcaccgctgccgtcctgatgcttgtggctcattacgccatcatcgggcccggactgcaggctaaggccaccagagaggcgcagaagcggacagccgctggcattatgaaaaatcccacggttgacgggatcgtggccattgatctcgaccctgtcgtgtatgacgctaagtttgaaaaacaactgggacagatcatgctgctcattctttgtacctctcagatcctgctgatgcgcacaacctgggccctctgcgagtccatcacactggccaccggcccgcttacgacactgtgggaaggcagccccgggaagttctggaacaccaccattgcggtgtctatggctaatatcttcagaggaagctacctcgccggcgctgggctggccttttccctgatgaaatctctcggaggcgggcggcgcggaacaggcgcccagggcgagacccttggggagaagtggaagagacaactgaaccagctgagcaaatccgaattcaatacatataagcggagcggaattatggaggttgatagatccgaagctaaagagggcctcaagcgcggggaaacgaccaaacacgccgtctctcggggaacagcgaagctgagatggtttgtggagcgcaaccttgtgaagcctgagggcaaagtcatcgacctggggtgtggacggggcggctggagctactattgcgccgggctcaagaaagttaccgaagtgaagggatacacaaaaggcgggcccggacatgaggaacctattcccatggctacctacggctggaatctggtgaagctgcactccgggaaagatgtcttctttatgcctccggagaagtgtgacacgctcctttgcgatatcggagaatctagccccaaccctaccatcgaggagggcagaacactgcgcgtgctgaagatggttgaaccctggctccggggcaatcagttctgtattaaaatcctgaacccttatatgccctccgtggtcgagacccttgaacagatgcaaagaaagcatgggggaatgctggtgcgcaatccgctctctcggaacagcacacacgagatgtactgggtttcctgcggcaccgggaatattgtgagcgccgtcaacatgacatctagaatgctgctgaaccgctttaccatggctcaccggaaacctacgtatgagagagacgtggatctcggagccggcacacgccatgtggcggtcgaacccgaggttgccaatctggacatcattgggcagagaatcgaaaacattaagaatgagcacaaatccacctggcattacgatgaagacaacccctataagacctgggcttaccacggaagctatgaggtgaagccttctggctccgccagctctatggtgaatggcgtcgtgcggcttctgacaaaaccctgggatgttatccctatggtgacgcagatcgctatgaccgacacaaccccgttcgggcaacagcgcgtctttaaggagaaagtggacacaagaaccccccgggccaagagaggaacaacccagattatggaagttacggctaaatggctctggggcttcctgtcccggaacaagaagcctcgcatctgtaccagagaggaatttacacggaaagtgcgcagcaatgccgcgattggggccgtcttcgtggatgagaaccagtggaattccgctaaggaagccgttgaggacgagagattttgggatcttgtgcaccgggaacgcgagctgcataaacaaggaaagtgcgctacctgcgtctacaacatgatgggcaaaagagaaaagaagctcggggagttcggcaaagccaagggaagccgggccatctggtacatgtggctgggcgcgcgcttcctggaatttgaggctctcgggttcatgaatgaggaccactggttttctagagaaaacagcctgtccggagtggagggcgaagggcttcataaactgggatatattctccgggatatctctaagatccccggcgggaatatgtacgccgacgatacagccggctgggacacccgcattacggaggatgacctgcagaacgaggctaaaatcacagatattatggaacctgagcacgcccttctggctaccagcatcttcaagctcacatatcagaataaagtcgtgagagttcagcggcccgccaagaacggaaccgtgatggacgtcatttcccgcagagatcaacggggctctgggcaggtgggaacgtacggcctgaacacctttacaaatatggaagtgcagctgatcagacagatggagagcgaagggatcttcctcccgtccgagctggagacccctaaccttgcggaacgcgttctggactggctcgagaagcatggagccgaacggctgaaaagaatggctatttctggcgacgattgtgtggtcaagcccatcgacgatcgctttgccacagctcttaccgccctgaatgacatggggaaagtgcggaaggatattcctcaatgggagcccagcaaaggctggaacgactggcagcaggttcctttctgctcccaccactttcatcagctcatcatgaaggatggaagagaaattgtggtcccctgtcgcaatcaagacgagctggtgggccgggcgagagtcagccagggggccggatggtctctgcgcgagacagcttgcctcggcaagtcctatgcccagatgtggcaactgatgtacttccaccggagagatcttcgcctggctgccaacgctatctgtagcgccgtgccggttgactgggtgcctacctctcggacgacatggtccatccatgcgcaccaccagtggatgaccaccgaagatatgctcagcgtctggaatagagtgtggattgaggaaaacccctggatggaggacaaaacacatgtttcctcttgggaagaggtgccctatctggggaagcgggaggaccagtggtgcggaagccttatcggcctgaccgccagagctacatgggccacgaatattcaggtcgccatcaaccaagtgcgccggctcattgggaatgaaaactacctggattacatgacctccatgaaaagatttaagaatgagagcgaccctgaaggcgctctgtggtga

SEQ ID NO: 18808 - RNA, 9879 nt, synthetic construct
  misc_feature 1..9879: note = derived and/or modified CDS sequence (opt5) from DENV-1__GU131835__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggtgcttcgccaccccggcttcaccgtcatcgcttttttcctggcccatgcgattgggacatctatcacccagaagggaatcatttttatcctcctgatgcttgtgacccctagcatggccatgagatgcgttggcattgggaaccgggatttcgtggagggactgtccggcgctacatgggtcgacgtggtgctcgagcacgggagctgtgtcacgaccatggccaagaataaacccacactggatatcgaactgctcaagaccgaggttacaaaccctgctgtgctgcgcaaactttgcattgaagccaagatctctaataccacgacagactccagatgtccgacccaaggagaggcgaccctggccgaagagcaggatgctaactttgtgtgccggcgcacattcgtcgacagaggctggggcaatgggtgtggactctttggcaaagggagcctgcttacctgcgccaagttcaagtgcgtgacaaaactggagggaaagattgttcagtacgaaaacctcaaatattctgtgatcgtcacggtgcacaccggcgatcagcatcaagttgggaatgagacaaccgaacacggaacaatcgctaccattacgccccaggcccctacctccgagatccagctgacagactacggcgccctgaccctcgactgtagcccccggacaggcctggattttaacgaaatggtgcttctgaccatgaaggagaaatcttggctcgtccataagcagtggttcctggaccttcctctgccctggacgtccggggctagcacatcccaagagacctggaatcgccaggatctcctggtgacatttaaaaccgcgcacgccaagaagcaggaagtcgtggttctgggatctcaagagggcgctatgcacaccgccctcacaggggccacggaaattcagaccagcggaacaaccacaatcttcgctggccatctgaaatgcagacttaagatggacaaactgaccctcaaggggacgtcctatgtgatgtgtacaggcagcttcaaactggagaaggaagtcgccgagacccagcacggaaccgtgctggttcaggtgaagtacgagggcacagatgcgccgtgcaaaattcctttttctacccaagacgaaaagggggtcacacagaacggacggcttatcacggctaatcccatcgtgaccgataaagagaagcctgtgaacattgaaacagagccccccttcggcgagtcctatatcgttgtcggggccggagaaaaagccctcaagctgagctggtttaagaaaggctctagcattgggaagatgttcgaggctaccgccagaggcgctcgccggatggccatcctgggagacacagcgtgggattttggctccattgggggagtgttcacctctgtgggcaaactcgtccatcaggtgtttgggacggcctacggagttctgttcagcggcgtgtcctggaccatgaagatcgggatcggcattcttctgacatggctcggactgaatagcagatctacctccctgagcatgacatgtatcgctgtcggcatggtgaccctttacctcggggttatggtgcaggccgactctggatgcgtcattaactggaaaggccgcgaactgaagtgtgggtccggaatctttgtgacaaacgaggttcacacctggacggaacaatataagttccaggctgatagccctaaacggctgtccgccgcgattggcaaggcctgggaggagggggtgtgcggcatcagatctgctacacgcctcgaaaatattatgtggaaacagatcagcaacgagctgaatcatatccttctggaaaacgacatgaagtttaccgtcgtggtgggagacgccaatggcattctcgctcaggggaaaaagatgatccggccgcaacccatggagcacaaatactcctggaagtcttggggaaaggccaaaattatcggcgccgatattcagaacaccacattcatcatcgacgggcctgatacccccgaatgtcctgacgatcagagagcttggaatatttgggaggtcgaggactatggatttggcatcttcacgacaaacatttggctgaagctgcgcgatagctacacccagatgtgcgaccaccggcttatgtccgcggccatcaaagatagcaaggctgttcatgccgacatgggctattggattgaatctgagaaaaatgaaacatggaagctcgccagagcttccttcatcgaggtgaagacctgtacatggcccaaaagccacaccctgtggtctaacggggtgctggaatccgagatgatcattccgaagatctacggaggccctattagccaacataattatcgccccgggtactttacgcagaccgccggaccttggcacctcggcaaactggagcttgatttcgacctgtgcgaagggacaaccgtcgtggttgatgagcactgcggaaaccggggcccctctctcagaacaaccacggtgacaggcaagatcattcatgaatggtgttgccggagctgtaccctgcctcccctgcgctttagaggggaggacggatgctggtacggcatggagatccggccggtcaaagaaaaggaggaaaatcttgtgagatccatggttagcgcggggtctggagaggtggactccttcagcctcggcatcctgtgtgtctccattatgatcgaagaggtgatgcgctctcggtggagcagaaagatgctgatgacagggaccctcgctgtttttctgcttctgattatgggacagctcacctggaacgatctgatccgcctgtgcattatggtgggcgccaatgcctccgacagaatgggcatggggacaacgtatcttgctctgatggccaccttcaaaatgcggcctatgtttgcggtcggactcctgttccgcagactcacatctcgggaggtgctgcttctgaccatcggcctcagcctggtggcttccgtcgaactgcccaactctcttgaggaactgggggatggactcgccatgggcattatgatgctgaagctcctgacagagtttcaaccccaccagctttggaccacgctgctcagcctgacattcatcaaaaccaccctgtcccttgactacgcctggaagacaaccgctatggttctgagcatcgtgtctctctttcctctgtgtctctccacaacgagccagaaaaccacatggctgccggtgcttctggggtctttcggatgcaagcccctgaccatgtttctcattacagaaaacaagatctggggccgcaaatcctggcctctgaatgagggcattatggccatcgggattgtcagcatccttctgtcttccctcctgaagaacgatgtgcccctcgctggacctctgatcgccggcgggatgcttattgcgtgttatgttatcagcggatccagcgccgacctgtctctggagaaagctgccgaagtgagctgggagcaggaagctgagcattccggcacctctcacaatattctcgtcgaagtgcaagatgacgggacgatgaagatcaaagatgaggagagagacgataccctgacaattcttctgaaggccaccctcctggccgttagcggagtgtaccccatgtccatccctgctacactcttcgtctggtatttctggcagaaaaagaagcagcggtctggcgtgctgtgggacacccccagcccgcctgaagtcgagcgcgcggtgcttgatgacggcatctacagaattctgcagcgggggctgctcggacgctcccaagttggcgtgggggtctttcaggacggagtgttccatacaatgtggcacgttacgagaggcgccgtgctgatgtatcaggggaaacggcttgaaccctcttgggctagcgtcaagaaagatctgatctcctacggaggcggctggagatttcaggggagctggaacaccggagaggaggtgcaagtgattgccgttgaacctggcaagaatcccaaaaacgtccagacaaccccggggaccttcaagacacctgagggagaagtgggcgccatcgctctcgactttaagcccgggacgtctggatcccctattgtgaatcgcgagggcaaaatcgtcggcctgtacgggaacggagtggttaccacaagcggcacctatgtgtctgccattgcgcaggctaaggcctcccaagaagggcccctccccgagatcgaggatgaagtcttcaaaaagcggaatctgacaatcatggaccttcaccctggaagcggcaaaaccagacgctacctgccggccattgtgcgggaggctatgaagagaaagctgcgcacgctcatcctggcccccacacgggttgtggcgtccgaaatggctgaggcccttaaagggatgcctattagatatcagaccaccgccgtcaagtctgaacatacaggccgcgagatcgtggatctgatgtgccacgctacctttacaatgcggctcctgagccccgttagagtgcctaactacaatatgattatcatggacgaggcccatttcaccgatcccgcttccatcgccgcgcggggatatattagcacgcgcgtcggcatgggggaagccgctgccatctttatgacagctacccctccgggatctgtggaggccttcccccagtccaacgccgtgattcaggacgaagagagagatatccctgaacggagctggaattctggctacgagtggattacagactttcccgggaaaaccgtctggttcgttcctagcatcaagtccggaaacgatatcgctaattgtctgcgcaaaaacggcaagagagtgattcaactctctcggaagacgttcgacaccgagtatcagaaaacaaagaacaatgactgggattacgtggtcaccacagacatcagcgaaatgggggcgaactttagagccgatcgcgtgattgacccccggagatgccttaaaccggttatcctgaaggatggccctgagcgcgtgattctggctggacccatgcccgtcaccgtggcctccgccgctcagcggagaggccgcatcgggcggaatcagaacaaagaaggagaccaatacgtttatatgggccagcctctcaataacgatgaggaccacgcccattggacagaggcgaagatgctgcttgataatattaacacccccgaagggatcatccctgctctgttcgagccggaaagagagaagtctgccgccattgacggagaataccgcctcagaggcgaggctcggaaaacgtttgtggagctgatgcgcagaggggatctgcccgtctggctcagctataaggtggcctccgaaggcttccagtacagcgaccggcgctggtgctttgatggagagagaaataaccaggtccttgaagagaatatggacgtggaaatctggacaaaagagggcgagcggaagaaactgagacctcgctggctggacgcgcggacctattctgatcccctcgccctgagagaattcaaggagtttgctgccgggcgccggtccgttagcggagaccttattctggaaatcggcaaactccctcaacacctgaccctgagagctcagaacgccctcgataatcttgtgatgctgcacaactccgagcaggggggaaaggcttaccggcatgccatggaagagctgcccgacacaattgagaccctcatgctgcttgcgctgatcgccgtgctcacaggcggcgtcatgctgttctttctgtctgggaagggactcggcaaaacgagcatcgggcttctgtgtgttaccgcttcctctgccctgctctggatggctagcgtggaaccgcactggattgccgcctccatcgtgctggagttctttcttatggtcctgctcattcctgaacccgatcgccagagaacacctcaagacaatcagctggcttatgtggttatcggactgctcttcatgattcttaccgtggcggccaacgagatgggcctgctggagacaaccaagaaagatctcgggatcggacatgctgccgccgaaaaccaccagcacgctacgatgctggacgtcgatcttcggcccgccagcgcgtggaccctgtacgccgtggctacaaccgtcatcacacctatgatgcgccataccattgagaatacgacagccaacatctctctcaccgctattgccaatcaagcggccatcctgatgggcctggacaagggctggcccatttccaaaatggatatcggggtgccgctccttgctctgggatgctacagccaggttaaccctctgacactcaccgccgctgtgctgatgcttgtcgcccactatgctattatcggccccgggctgcaggccaaggcgaccagagaagcccagaagcggacagctgccggaatcatgaaaaatcccacggtggacggcattgttgctatcgatctcgaccctgtggtctacgacgccaagtttgagaaacaactggggcagattatgctgctcatcctttgtacctctcagattctgctgatgcgcacaacctgggccctctgcgaatccatcacactggcgaccggaccgcttacgacactgtgggagggcagccccggcaagttctggaacaccaccatcgctgtgtctatggccaatattttcagagggagctatctcgctggagccggcctggccttttccctgatgaaatctctcgggggaggccggcgcgggacaggagctcagggcgagacccttggcgaaaagtggaagagacaactgaaccagctgagcaaacctgagttcaatacatacaagcggtccgggatcatggaagtggatagaagcgaggccaaagaaggactcaagcgcggcgagacgaccaaacatgcggtttcccgggggacagccaagctgagatggtttgtcgagcgcaaccttgtgaagcccgaaggaaaagtgattgacctgggctgtgggcggggaggctggtcttattactgcgctggcctcaagaaagtcaccgaggttaaggggtatacaaaaggaggccctgggcacgaagagcccatccctatggccacctacggatggaatctggtgaagctgcatagcggcaaagatgtgttctttatgccgcccgaaaagtgtgacacgctcctttgcgatattggggagtcctctcctaaccccaccatcgaggaaggaagaacactgcgcgtcctgaagatggtggagccttggctccggggcaatcagttctgtatcaaaattctgaacccctacatgccgaccgttgtggaaacacttgagcagatgcaaagaaagcacggcgggatgctggtccgcaatcctctcagccggaactccacccacgagatgtattgggtgtcttgcggaacaggcaatatcgttagcgctgtgaacatgacctccagaatgctgctgaaccgctttacgatggcccatcggaaacccacatacgaaagagacgtcgatctcggggcgggaacccgccacgtggccgtggagcccgaagtcgctaatctggacattatcggccagagaattgagaacatcaagaatgaacataaaagcacctggcactatgatgaggacaacccttacaagacatgggcctatcacgggtcttacgaggttaagccctccggaagcgcttcttccatggtgaatggcgtggtccggcttctgacgaaaccttgggatgtgattccgatggttacccagatcgccatgacagacaccacacccttcggccaacagcgcgtgtttaaggaaaaagtcgacaccagaacacctcgggctaagagagggaccacgcagatcatggaggtgaccgccaaatggctctggggattcctgagccggaacaagaagccccgcatttgtacaagagaagagtttacccggaaagttcgctctaatgcggccatcggcgctgtgttcgtcgatgaaaaccagtggaattccgccaaggaggctgtggaggacgaaagattttgggatcttgttcatcgggagcgcgaactgcacaaacaagggaagtgcgccacatgcgtgtataacatgatgggaaaaagagagaagaagctcggcgaattcgggaaagccaagggcagccgggcgatttggtacatgtggctgggagctcgcttcctggagtttgaggccctcggcttcatgaatgaagaccattggttttccagagagaacagcctgtctggggtcgaaggagagggccttcacaaactggggtacatcctccgggatattagccgcatccctggaggcaatatgtatgccgacgataccgctgggtgggacacgagaatcacagaggatgacctgcagaacgaagccaagattaccgatatcatggagcccgaacatgctcttctggccacatccattttcaaactcacctaccagaataaggtggtccgggtgcagcgcccggcgaaaaacggcacggttatggacgtgatctctagacgggatcaaagaggaagcggccaggtcgggacctatggactgaacacatttaccaatatggaggtgcagctgattcgccagatggaatccgagggcatcttcctcccttctgagctggaaacacccaaccttgccgagcgggtgctggactggctcgaaaagcacggggctgagagactgaagcgcatggccatcagcggagacgattgtgttgtgaaacctattgacgatcggtttgctacctcccttacagccctgaatgacatgggcaaggtcagaaaagatatcccccaatgggaaccttctaaggggtggaacgactggcagcaggtgcccttctgcagccaccattttcaccagctcattatgaaagatggccgcgagatcgttgtgccgtgtcggaatcaagacgagctggtcggaagagcgcgcgtgtcccagggcgccgggtggagcctgcgggaaaccgcttgcctcggaaagtcttacgcccagatgtggcaactgatgtatttccatagacgcgatcttcggctggctgccaacgctatttgttccgccgtccctgtggactgggttcccacgagcagaacaacctggtctatccacgcgcaccatcagtggatgaccacagaggatatgctctccgtgtggaatcgggtctggatcgaagagaacccctggatggaagacaagacccacgtgagctcctgggaggaggttccttacctgggcaaaagagaagaccagtggtgcgggtctcttattggactgacagcccgcgctacgtgggccaccaatatccaggtggccattaaccaagtccggagactcatcggcaatgagaactatctggattacatgacaagcatgaagcgctttaaaaatgaatccgacctggagggggctctctggtga

SEQ ID NO: 18809 - RNA, 9879 nt, synthetic construct
  misc_feature 1..9879: note = derived and/or modified CDS sequence (opt5) from DENV-1__GU131836__SS-prME
  source 1..9879: mol_type = other RNA
agcgtgacaatgctgctcatgctgcttcccacagccctggctttccacctcacgaccagaggcggggaacctcatatgatcgtctccaagcaggaacggggaaaatctctgctttttaagacaagcgccggcgttaacatgtgcaccctgattgcgatggacctcggggaactgtgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctcggactggagacaagaaccgaaacgtggatgagctccgagggcgcctggaaacagattcagcgggttgaaacatgggctcttagacaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccagggagaggccaccctcgtggaagaacaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggacgtcctatgtgatgtgtacaggcagcttcaaactggagaaggaagtcgccgagacccagcacggaaccgtgcttgttcaggtgaagtacgagggcacagatgcgccgtgcaaaattcctttctctacccaagacgaaaagggggtcacacagaacggacggctcatcacggctaatcccatcgtgaccgataaagagaagcctgtgaacattgaaacagagccgccctttggcgagtcctatatcgttgtcggggccggagaaaaagccctgaagctgagctggttcaagaaaggctctagcattgggaagatgtttgaggctaccgccagaggcgctcgccggatggccatcctcggagacacagcgtgggatttcggctccattgggggagtgtttacctctgtgggcaaactggtccatcaggtgttcgggacggcctacggagttctttttagcggcgtgtcctggaccatgaagatcgggatcggcattctgctcacatggctgggactgaatagcagatctacctcccttagcatgacatgtatcgctgtcggcatggtgaccctctacctgggggttatggtgcaggccgactctggatgcgtcattaactggaaaggccgcgaactgaagtgtgggtccggaatcttcgtgacaaacgaggttcacacctggacggaacaatataagtttcaggctgatagccctaaacggctctccgccgcgattggcaaggcctgggaggagggggtgtgcggcatcagatctgctacacgcctggaaaatattatgtggaaacagatcagcaacgagcttaatcatatcctgctcgaaaacgacatgaagttcaccgtcgtggtgggagacgccaatggcattctggtccaggggaaaaagatgatccggccgcaacccatggagcacaaatactcctggaagtcttggggaaaggctaaaattatcggcgccgatattcagaacaccacatttatcatcgacgggcctgatacccccgaatgtcctgacgatcagagagcctggaatatttgggaggttgaggactatggattcggcatctttacgacaaacatttggctgaaacttcgcgatagctacacccagatgtgcgaccaccggctcatgtccgctgcgatcaaagatagcaaggccgtgcatgctgacatgggctattggattgaatctgagaaaaatgaaacatggaagctgtccagagccagcttcatcgaggtgaagacctgtacatggcccaaatctcacaccctgtggtccaacggggtcctcgaaagcgagatgatcattccgaagatctacggaggccctatttctcaacataattatcgccccgggtacttcacgcagaccgccggaccttggcacctgggcaaacttgagctggattttgacctctgcgaagggacaaccgtggttgtggatgagcactgcggaaaccggggccccagcctgagaacaaccacggtcacaggcaagatcattcatgaatggtgttgccggtcctgtaccctgcctccccttcgcttcagaggggaggacggatgctggtacggcatggagatccggccggtgaaagaaaaggaggaaaatctcgttagaagcatggtgtctgctgggtccggagaggtcgacagcttttccctgggcatcctgtgtgtgtctattatgatcgaagaggttatgcgcagccggtggtccagaaagatgctcatgacagggaccctggccgtgttccttctgctcattatgggacagctgacctggaacgatctgatccgcctttgcattatggtcggcgcgaatgcttctgacagaatgggcatggggacaacgtatctggccctcatggccacctttaaaatgcggcctatgttcgctgtgggactgctctttcgcagactgacaagccgggaggtgcttctgctcaccatcggcctgtccctggtcgcctctgttgaacttcccaacagcctggaggaactcggggatggactggcgatgggcattatgatgctcaagctgcttacagagttccaaccccaccagctgtggaccacgctcctgtccctgacatttatcaaaaccacccttagcctggactacgcttggaagacaaccgccatggccctctctatcgtgtccctgttccctctctgtctgagcacaacgtctcagaaaaccacatggcttccggtgctgctggggtcctttggatgcaagcccctcaccatgttcctgattacagaaaacaagatctggggccgcaaaagctggcctcttaatgagggcattatggctatcgggattgtctctatcctgctctccagcctgctcaagaacgatgtgcccctggccggacctcttatcgctggcgggatgctgattgcctgttatgttatctccggaagctctgcggacctgagcctcgagaaagccgctgaagtgtcctgggagcaggaagccgagcattctggcaccagccacaatattctggtcgaagtgcaagatgacgggacgatgaagatcaaagatgaggagaaggacgatacccttacaattctgctcaaagctaccctgctcgccgtttccggagtgtaccccatgtctatccctgccacactgtttgtctggtatttctggcagaagaagaaacagagaagcggcgtgctttgggacaccccctccccgcctgaagtcgagcgggctgtgctggatgacggcatctaccgcattctgcagagagggctcctgggacggtctcaagttggcgtgggggtcttccaggacggagtgtttcatacaatgtggcacgttacgcgcggcgcggtgcttatgtatcaggggaagagactggaacccagctgggcctccgtcaaaaaggatctcatcagctacggaggcggctggcggttccaggggtcttggaacaccggagaggaggtgcaagtgattgctgttgaacctggcaaaaatcccaagaacgtccagacaaccccggggacctttaagacacctgagggagaagtgggcgccatcgccctggacttcaaacccgggacgtccggaagccctattgtgaatagagagggcaagatcgtcggcctctacgggaacggagtggttaccacatctggcacctatgtgtccgctattgcccaggcgaaagctagccaagaagggcccctgcccgagatcgaggatgaagtctttaagaaacgcaatcttacaatcatggacctgcaccctggatccggcaagacccggagatacctgccggccattgtgcgcgaggccatcaagcggaaactcagaacgctgattcttgctcccacacgcgttgtggcctctgaaatggcggaggctctgaaggggatgcctatccggtatcagaccaccgccgtcaaaagcgaacatacaggcagagagattgtggatctcatgtgccacgccaccttcacaatgcgcctgctgtcccccgttcgggtgcctaactacaatatgatcatcatggacgaggctcattttaccgatcccgccagcattgctgccagaggatatatctctacgcgggtcggcatgggggaagcggccgctattttcatgacagccacccctccgggatccgtggaggcttttccccagagcaacgccgtgatccaggacgaagaacgcgatattcctgaaagatcttggaatagcggctacgactggatcacagatttccccgggaagaccgtctggtttgttccttccatcaaatctggaaacgacattgccaattgtctccggaagaacggcaagcgcgtgatccaacttagcagaaaaacgttcgacaccgagtatcagaagaccaagaacaatgattgggactacgtggtcaccacagatatttccgagatgggggctaacttccgggcggacagagtgatcgatccccgccggtgcctgaagccggttattctgaaagacggccctgaaagagtgatcctcgccggacccatgcccgtcaccgtggcttctgccgcccagcgccggggcagaattgggcgcaatcagaacaaggagggagatcaatacgtttatatgggccagcctctgaataacgacgaagatcacgctcattggacagaggccaagatgcttctggacaatatcaacacccccgaggggatcattcctgcgctctttgaaccggagcgggaaaagagcgctgccatcgatggagagtacagactgcgcggcgaggccagaaagacgttcgtggagctgatgcggcgcggggacctccccgtctggctttcctataaagtggctagcgagggctttcagtactctgatagacggtggtgcttcgacggagaacgcaataaccaggtcctggaggaaaatatggacgtggagatttggacaaaggaaggcgagcgcaagaagctgcggcctagatggctcgatgcccgcacctattccgaccccctggcgcttcgggagtttaaagagttcgccgctgggagacgcagcgtttccggagatctgatcctcgagattggcaagctgcctcaacacctgaccctccgggcccagaacgctcttgacaatctggtgatgctgcacaactctgaacaagggggaaaggcctacagacatgctatggaggaactccccgatacaatcgagaccctgatgcttctggccctcatcgcggtgctgacaggcggcgtcacgctgtttttcctcagcgggaaaggacttggcaagacctccattgggctgctgtgtgttatggcctctagcgctctcctgtggatggcctccgtggagccgcactggatcgctgccagcattatccttgaatttttcctgatggtgctcctgattcctgagcccgaccggcagcgcacacctcaagataatcagctggcctatgtcgtgatcggactcctttttatgatcctgaccgttgctgcgaacgaaatgggcctgctcgagacaaccaaaaaggacctggggattggacatgtggccgctgagaaccaccagcacgccacgatgcttgatgtcgacctgagacccgcctctgcttggaccctctacgccgtggcgacaaccgtcatcacacctatgatgcggcataccattgaaaatacgacagccaacatctccctgaccgctattgccaatcaagctgccatcctgatgggcctcgataaaggctggcccattagcaagatggacatcggggtgccgcttctggcgctgggatgctactctcaggttaaccctctcacactgaccgccgctgtgcttatgctggtcgcccactatgctatcattggccccgggctccaggccaaggctacccgcgaggcccagaaaagaacagcggccggaatcatgaagaatcccacggtggatggcattgttgctatcgacctggaccctgtggtctacgatgccaaattcgaaaagcaactggggcagattatgctccttatcctgtgtacctcccagatcctgctcatgcggacaacctgggctctgtgcgagagcattacacttgccaccggaccgctgacgacactctgggaaggctctcccggcaaattttggaacaccaccatcgccgtgagcatggcgaatattttccgcgggtcctatctggctggagccggcctggctttctctctcatgaaaagccttgggggaggcagacgggggacaggagcccagggcgagaccctgggcgagaagtggaaacgccaactgaaccagctctccaagagcgaatttaatacatacaaaagatccgggatcatggaggtggaccggtctgaagccaaggagggactgaaaagaggcgaaacgaccaagcatgctgttagccgcgggacagccaaacttcggtggttcgtcgagagaaacctggtgaaacctgagggaaaggtgattgatctcggctgtgggcgcggaggctggtcctattactgcgcgggcctgaaaaaggtcaccgaagttaaagggtatacaaagggaggccccgggcacgaggaacctatccccatggccacctacggatggaatctggtgaaactccattctggcaaggacgtgtttttcatgcctccggagaagtgtgatacgcttctgtgcgacatcggggaaagctcccccaaccctaccattgaggagggacggacactgagagtcctcaaaatggtggaaccctggctgcgcggcaatcagttttgtatcaagattcttaacccttacatgccctctgttgtggagaccctggaacagatgcaacggaaacacggcgggatgctcgtcagaaatccgctgagccgcaactccacacacgagatgtattgggtgagctgcggaaccggcaatatcgtttctgctgtgaacatgacatcccggatgctgctcaacagattcaccatggcccatcgcaagcctacgtacgagcgggatgtcgacctgggggctggaacaagacacgtggccgtggaacccgaggtccccaatcttgatattatcggccagcgcattgaaaacatcaaaaatgagcataagagcacctggcactatgacgaagataacccttacaagacctgggcgtatcacgggtcttacgaggttaaaccctccggaagcgcctcttccatggtgaatggcgtggtcagactgctcacaaagccttgggacgtgatcccgatggttacgcagattgctatgaccgacacaaccccctttggccaacagcgggtgttcaaagagaaggtcgatacacgcacccctagagccaaacgggggacaacccagatcatggaagtgacggctaagtggctgtggggatttcttagcagaaacaagaaaccccggatttgtacccgcgaggagttcacaagaaaggttcggtccaatgccgctatcggcgccgtgtttgtcgacgagaaccagtggaatagcgcgaaagaagccgtggaggatgagcgcttctgggacctggttcatagagaacgggagctccacaagcaagggaaatgcgctacctgcgtgtataacatgatgggaaagcgcgaaaagaaactgggcgagtttgggaaggccaaaggctctagagctatttggtacatgtggctgggagcccggttcctcgagttcgaggccctgggctttatgaatgaggatcattggttcagccgcgaaaactccctttctggggtcgagggagaaggcctgcacaagctcgggtacatcctgagagacatcagcaaaattcctggaggcaatatgtatgcggatgacacagctgggtgggatacccggatcacggaggacgatcttcagaacgaggccaagattacagacatcatggaacccggccatgccctgctcgctacctccatttttaaactgacataccagaataaggtggtccgcgtgcagagaccggccaagaacggaaccgttatggatgtgatctctcggcgcgaccaaagaggcagcgggcaggtcggaacgtatggcctgaacaccttcacaaatatggaggtgcagctcatccggcagatggaatccgaggggatttttctgccttctgaacttgagacccccaacctggctgagagagtgctcgactggctggaaaaacacggagccgagcgccttaagcggatggcgatcagcggcgatgactgtgttgtgaaacctattgatgacagattcgccacagctctgaccgccctcaatgatatggggaaggtccgcaaagacatcccccaatgggaaccttccaagggctggaacgattggcaacaggtgcccttttgcagccaccatttccaccagctgattatgaaggacggacgggagatcgttgtgccgtgtagaaatcaagatgaactggtcggccgcgctcgggtgtctcagggggccggatggtccctcagagagacagcgtgcctgggcaaaagctacgcccagatgtggcaacttatgtattttcatcgccgggacctgagactcgctgccaacgctatctgttctgccgtccctgtggattgggttcccacctcccgcacgacatggagcattcacgctcaccatcagtggatgaccaccgaggacatgctgtccgtgtggaatcgggtctggatcgaagagaacccctggatggaagacaagacacacgtgtctagctgggaggaagttccttaccttgggaaaagagaggatcagtggtgcggatccctgattggcctcaccgcccgggcgacatgggccacgaatatccaggtggctattaaccaagtcagacgcctgatcgggaatgagaactatctggactacatgaccagcatgaagcggttcaaaaatgaatctgatccggagggcgccctctggtga

SEQ ID NO: 18810 - RNA, 9879 nt, synthetic construct
  misc_feature 1..9879: note = derived and/or modified CDS sequence (opt5) from DENV-1__GU131837__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgatcgccctgtttctcgcgcatgccattgggacatctatcacccagaagggaatcattttcatcctgcttatgctggtcacccctagcatggctatgagatgcgtgggcattgggaaccgggattttgttgagggactctccggcgccacatgggtggacgtcgtgctggagcacgggagctgtgtgacgaccatggctaagaataaacccacactggatatcgaactcctgaagaccgaggtcacaaaccctgccgttcttcgcaaactgtgcattgaagcgaagatctctaataccacgacagactccagatgtccgacccaaggagaggccaccctcgtggaagagcaggatgctaacttcgtgtgccggcgcacatttgtcgacagaggctggggcaatgggtgtggactgttcggcaaagggagccttctgacctgcgccaagtttaagtgcgtgacaaaactcgagggaaagattgttcagtacgaaaacctgaaatattctgtgatcgtcacggtgcacaccggcgatcagcatcaagttgggaatgagacaaccgaacacggaacaatcgctaccattacgccccaggcccctacctccgagatccagctgacagactacggcgccctcaccctggactgtagcccccggacaggccttgatttcaacgaaatggtgctgctcaccatgaaggagaaatcttggctggtccataagcagtggtttcttgacctgcctctcccctggacgtccggggctagcacatcccaagagacctggaatcgccaggatctgctggtgacattcaaaaccgcgcacgccaagaagcaggaagtcgtggttctcggatctcaagagggcgctatgcacaccgccctgacaggggccacggaaattcagaccagcggaacaaccacaatctttgctggccatcttaaatgcagactgaagatggacaaactcaccctgaaggggatgtcctatgtgatgtgtacgggcagcttcaaactggagaaggaagtcgccgagacacagcacggaaccgtgcttgttcaggtgaagtacgagggcaccgatgcgccgtgcaaaattcctttctctacacaagacgaaaagggggtcacccagaacggacggctcatcacagctaatcccatcgtgacggataaagagaagcctgtgaacattgaaaccgagcccccctttggcgagtcctatatcgttgtcggggccggagaaaaagccctgaagctgagctggttcaagaaaggctctagcattgggaagatgtttgaggctacagccagaggcgctcgccggatggccatcctcggagacaccgcgtgggatttcggctccattgggggagtgtttacatctgtgggcaaactggtccatcaggtgttcgggaccgcctacggagttctttttagcggcgtgtcctggacgatgaagatcgggatcggcattctgctcacctggctgggactgaatagcagatctacatcccttagcatgacctgtatcgctgtcggcatggtgacactctacctgggggttatggtgcaggccgactctggatgcgtcattaactggaaaggccgcgaactgaagtgtgggtccggaatcttcgtgaccaacgaggttcacacatggaccgaacaatataagtttcaggctgatagccctaaacggctctccgccgcgattggcaaggcctgggaggagggggtgtgcggcatcagatctgctacgcgcctggaaaatattatgtggaaacagatcagcaacgagcttaatcatatcctgctcgaaaacgacatgaagttcacagtcgtggtgggagacgccaatggcattctggctcaggggaaaaagatgatccggccgcaacccatggagcacaaatactcctggaagtcttggggaaaggccaaaattatcggcgccgatattcagaacaccacctttatcatcgacgggcctgatacacccgaatgtcctgacggacagagagcttggaatatttgggaggtcgaggattatggcttcggcatctttaccacgaacatttggctgaagcttcgcgacagctacacacagatgtgcgatcaccggctcatgtccgcggccatcaaagacagcaaggctgttcatgccgatatggggtattggattgaatctgagaaaaatgaaacctggaagctggccagagcttccttcatcgaggtgaagacatgtacctggcccaaaagccacacactgtggtctaacggagtgctcgaatccgagatgatcattccgaagatctacggcgggcctattagccaacataattatcgccccggatacttcacccagacggccggcccttggcacctggggaaacttgagctggactttgatctctgcgaaggaaccacagtcgtggttgacgagcactgcggcaaccggggcccctctctgagaaccacaaccgtgacggggaagatcattcatgaatggtgttgccggagctgtacactgcctccccttcgcttcagaggagaggatggctgctggtacgggatggagatccggccggtcaaagaaaaggaggaaaatctcgtgagatccatggttagcgcgggatctggcgaggtggactcctttagcctggggatcctgtgtgtctccattatgatcgaagaggtgatgcgctctcggtggagcagaaagatgctcatgaccggaacactggctgttttccttctgctcattatgggccagctgacctggaacgacctgatccgcctttgcattatggtgggcgccaatgcctccgatagaatggggatgggaaccacatatctggctctcatggccacgtttaaaatgcggcctatgttcgcggtcggcctgctctttcgcagactgacctctcgggaggtgcttctgctcacaatcgggctgagcctggtggcttccgtcgaacttcccaactctctggaggaactcggagacggcctggccatggggattatgatgctcaagctgcttaccgagttccaaccccaccagctgtggacaaccctcctgagcctgacgtttgttaaaacaaccctttccctggattacgcctggaagaccacagctatggtgctcagcatcgtgtctctgttccctctctgtctgtccaccacaagccagaaaacgacctggcttccggtcctgctgggatcttttggctgcaagcccctcacaatgttcctgatcaccgaaaacaagatttggggccgcaaatcctggcctcttaatgaggggatcatggccattggaatcgtgagcattctgctctcttccctgctcaagaacgacgttcccctggctggccctcttatcgccgggggaatgctgatcgcgtgttatgtgattagcggctccagcgccgatctgtctctcgagaaagctgccgaagtcagctgggagcaggaagctgagcattccggggcctctcacaatatcctggtggaagttcaagacgatggaacaatgaagattaaagacgaggagagagatgacacccttacgatcctgctcaaggccaccctgctcgctgtgagcggcgtctaccccatgtccattcctgcgacactgtttgtgtggtatttctggcagaaaaagaagcagcggtctggcgtcctttgggatacccccagcccgcctgaagtggagcgcgccgttctggacgatgggatctacagaatcctgcagcggggactcctgggccgctcccaagtgggggtcggagtgttccaggacggcgtttttcatacaatgtggcacgtgaccagaggggctgtccttatgtatcagggaaaacggctggaaccctcttgggccagcgtgaagaaagacctcatttcctacggcggcgggtggagattccagggaagctggaacacaggcgaggaggtgcaagttatcgccgtcgaacctgggaagaatcccaaaaacgtgcagacgaccccgggaacatttaagacccctgagggcgaagtgggggctattgccctggatttcaagcccggaacctctggctcccctatcgtcaatcgcgagggcaaaattgtggggctctacggaaacggcgttgtgacaacgagcgggacctatgtctctgcgatcgctcaggccaaggcctcccaagaaggacccctgcccgagattgaggacgaagtgtttaaaaagcggaatcttacaatcatggatctgcaccctggcagcgggaaaaccagacgctacctgccggctatcgttcgggaggccattaagagaaagctccgcacactgatccttgcgcccacccgggtggtcgcttccgaaatggccgaggccctgaaaggcatgcctattagatatcagacgacagctgtgaagtctgaacataccggacgcgagatcgttgacctcatgtgccacgccaccttcacaatgcggctgctgagccccgtgagagtccctaactacaatatgattatcatggatgaggctcattttaccgaccccgcctccatcgcggcccggggctatattagcacacgcgtggggatgggagaagctgccgctatcttcatgaccgccacgcctccgggctctgtggaggcctttccccagtccaacgctgtcattcaggatgaagagagagacatccctgaacggagctggaattctgggtacgattggattacagacttccccggaaaaaccgtttggtttgtgcctagcatcaagtccggcaacgatatcgcgaattgtctccgcaaaaacgggaagagagtgattcaactttctcggaagacattcgacaccgagtatcagaaaacgaagaacaatgactgggattacgtcgtgaccacagacatcagcgagatgggcgccaacttcagagctgatcgcgttattgacccccggagatgcctgaaaccggtgatcctgaaggatggacctgaacgcgtcattctcgccggccccatgcccgtgaccgttgcctccgctgcccagcggagagggcgcatcggacggaatcagaacaaagagggcgaccaatacgtgtatatggggcagcctctgaataacgatgaagaccacgcgcattggacagaggctaagatgcttctggataatattaacacccccgagggaatcatccctgccctctttgaaccggagagagaaaagtctgccgctattgacggcgagtaccgcctgagaggggaagcccggaaaacattcgtcgagctgatgcgcagaggcgatctccccgtgtggcttagctataaggtcgcgtccgagggatttcagtacagcgaccggcgctggtgcttcgatggcgaaagaaataaccaggtgctggaggaaaatatggacgttgagatctggaccaaagaaggggagcggaagaaactgagacctcgctggctcgacgcccggacgtattctgatcccctggctcttagagagtttaaggaattcgccgctggacgccggtccgtgagcggcgacctgattctcgagatcgggaaactgcctcaacacctgacactcagagcccagaacgctcttgataatctggtgatgctgcacaactccgaacagggaggcaaggcctaccggcatgcgatggaggaactccccgacaccattgagaccctgatgcttctggccctcatcgctgtcctgacaggcggggttaccctgtttttcctctctggaaagggccttgggaaaacaagcatcggactgctgtgtgtgacggcctcctctgctctcctgtggatggccagcgtggagccgcactggattgccgcttccatcattcttgaatttttcctgatggtcctcctgatccctgagcccgatcgccagagaacccctcaagacaatcagctggcgtatgtggttattggcctcctttttatgatcctgacagtggccgctaacgaaatggggctgctcgagaccacaaagaaagatctgggaatcggctacgtcgccgccgagaaccatcagcacgctaccatgcttgacgtggatctgcggcccgccagcgcgtggacgctctacgccgtcgctaccacagtgattacccctatgatgcgccacacaatcgaaaataccacggccaacatttctctgacagctatcgccaatcaagcggccattctgatgggcctcgacaaggggtggcccatctccaaaatggatattggagttccgcttctggctctgggctgctatagccaggtgaaccctctcaccctgacagccgctgtccttatgctggtggcccattacgctatcatcgggcccggactccaggccaaggcgaccagagaggcccagaagcggaccgctgccggcattatgaaaaatcccacagttgacgggatcgtggctattgatctggaccctgtcgtgtatgacgccaagttcgaaaaacaactgggacagatcatgctccttattctgtgtacgtctcagatcctgctcatgcgcaccacatgggccctgtgcgagtccatcacccttgcgacaggcccgctgaccacgctctgggaaggcagccccgggaagttttggaacacaaccattgctgtgtctatggccaatatcttcagaggaagctacctggctggcgccgggctggccttctccctcatgaaatctcttggaggcgggcggcgcggaaccggcgctcagggcgagacactgggggagaagtggaagagacaactgaaccagctcagcaaatccgaatttaatacctataagcggagcggaattatggaggttgatagatccgaagccaaagagggcctgaagcgcggggaaacaacgaaacacgcggtctctcggggaaccgccaagcttagatggttcgtggagcgcaacctggtgaagcctgagggcaaagtcatcgacctcgggtgtggacggggcggctggagctactattgcgctgggctgaagaaagttacagaagtgaagggatacaccaaaggcgggcccggacatgaggaacctattcccatggccacatacggctggaatctggtgaagctccactccgggaaagatgtctttttcatgcctccggagaagtgtgacacccttctgtgcgatatcggagaatctagccccaaccctacgatcgaggagggcagaaccctgcgcgtgctcaagatggttgaaccctggctgcggggcaatcagttttgtattaaaatccttaacccttatatgccctccgtggtcgagacactggaacagatgcaaagaaagcatgggggaatgctcgtgcgcaatccgctgtctcggaacagcacccacgagatgtactgggtttcctgcggcacagggaatattgtgagcgctgtcaacatgacctctagaatgctgctcaaccgcttcacaatggcccaccggaaacctacctatgagagagacgtggatctgggagcgggcacgcgccatgtggccgtcgaacccgaggaagctaatcttgacatcattgggcagagaatcgagaacattaagaatgaacacaaatccacatggcattacgatgaggacaacccctataagacctgggcctaccacggaagctatgaggttaagccttctggctccgctagctctatggtgaatggcgtggtccggctgctcaccaaaccctgggatgtgatccctatggttacacagatcgccatgacggacaccacaccgtttgggcaacagcgcgtgttcaaggaaaaagtcgacaccagaacaccccgggctaagagaggaaccacacagattatggaggtgaccgccaaatggctgtggggctttctttcccggaacaagaagcctcgcatctgtacgagagaagagttcacccggaaagttcgcagcaatgcggccattggggctgtgtttgtcgatgaaaaccagtggaattccgccaaggaggctgtggaggacgaaagattctgggatctggttcaccgggagcgcgaactccataaacaaggaaagtgcgccacatgcgtgtacaacatgatgggcaaaagagagaagaagctgggggaatttggcaaagccaagggaagccgggcgatctggtacatgtggctgggcgctcgcttcctcgagttcgaggccctggggtttatgaatgaagaccactggttctctagagagaacagcctttccggagtcgaaggcgaggggctgcataaactcggatatattctgcgggatatctctaagatccccggcgggaatatgtacgccgacgataccgctggctgggacacacgcattaccgaggatgaccttcagaacgaagccaaaatcacggatattatggagcctgaacacgctctgctcgccacaagcatctttaagctgacctatcagaataaagtggtcagagtgcagcggcccgcgaagaacggaacagttatggacgtgatttcccgcagagatcaacggggctctgggcaggtcggaacctacggcctgaacacgttcaccaatatggaggtgcagctcatcagacagatggaaagcgaggggatctttctgccgtccgagcttgaaacacctaacctggccgagcgcgtgctcgactggctggaaaagcatggaaccgagcggcttaaaagaatggctatttctggcgacgattgtgttgtgaagcccatcgacgatcgcttcgccacagctctgaccgccctcaatgacatggggaaagtccggaaggatattcctcaatgggaacccagcaaaggctggaacgactggcagcaggtgcctttttgctcccaccacttccatcagctgatcatgaaggatggaagagagattgttgtgccctgtcgcaatcaagacgagctggtcggccgggcgagagtgagccagggggccggatggtctctccgcgaaacagcttgcctgggcaagtcctatgcccagatgtggcaacttatgtactttcaccggagagatctgcgcctcgctgccaacgctatctgtagcgccgtcccggtggactgggttcctacctctcggacgacatggtccatccatgcgcaccaccagtggatgaccaccgaggatatgctgagcgtgtggaatagagtctggattgaagagaacccctggatggaagacaaaacacatgtgtcctcttgggaggaggttccctatcttgggaagcgggaagaccagtggtgcggaagcctgatcggcctcaccgccagagctacatgggccacgaatattcaggtggccatcaaccaagtccgccggctgattgggaatgagaactacctggattacatgacctccatgaaaagattcaagaatgaaagcgaccctgagggcgctctctggtga

SEQ ID NO: 18811 - RNA, 9879 nt, synthetic construct
  misc_feature 1..9879: note = derived and/or modified CDS sequence (opt5) from DENV-1__JN819415__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctcttcgccaccccggcttcaccgtgacagccctgtttctcgcgcatgccatcgggacctctattacccagaagggaatcatcttcattctgcttatgctggtcacacctagcatggctatgagatgcgtgggcatcgggaaccgggattttgttgagggactctccggcgccacgtgggtggacgtcgtgctggagcacgggagctgtgtgaccacaatggctaagaataaacccaccctggatattgaactcctgaagacagaggtcaccaaccctgccgttcttcgcaaactgtgcatcgaagcgaagatttctaatacgacaaccgactccagatgtccgacccaaggagaggccacactcgtggaagagcaggatgctaacttcgtgtgccggcgcacctttgtcgacagaggctggggcaatgggtgtggactgttcggcaaagggagccttctgacatgcgccaagtttaagtgcgtgacgaaactcgagggaaagatcgttcagtacgaaaacctgaaatattctgtgattgtcaccgtgcacacaggcgatcagcatcaagttgggaatgagaccacagaacacggaaccatcgctacgatcaccccccaggcccctacatccgagattcagctgaccgactacggcgccctcacactggactgtagcccccggaccggccttgatttcaacgaaatggtgctgctcacgatgaaggagaaatcttggctggtccataagcagtggtttcttgacctgcctctcccctggacatccggggctagcacctcccaagagacatggaatcgccaggatctgctggtgaccttcaaaaccgcgcacgccaagaagcaggaagtcgtggttctcggatctcaagagggcgctatgcacacagccctgacgggggccaccgaaatccagacaagcggaaccacaaccatttttgctggccatcttaaatgcagactgaagatggacaaactcacgctgaaggggacatcctatgtgatgtgtaccggcagcttcaaactggagaaggaagtcgccgagacccagcacggaacagtgcttgttcaggtgaagtacgagggcaccgatgcgccgtgcaaaatccctttctctacacaagacgaaaagggggtcacgcagaacggacggctcattaccgctaatcccatcgtgacagataaagagaagcctgtgaacatcgaaaccgagcccccctttggcgagtcctatattgttgtcggggccggagaaaaagccctgaagctgagctggttcaagaaaggctctagcatcgggaagatgtttgaggctacagccagaggcgctcgccggatggccattctcggagacaccgcgtgggatttcggctccatcgggggagtgtttacgtctgtgggcaaactggtccatcaggtgttcgggaccgcctacggagttctttttagcggcgtgtcctggacaatgaagattgggatcggcatcctgctcacctggctgggactgaatagcagatctacatcccttagcatgacctgtattgctgtcggcatggtgacactctacctgggggttatggtgcaggccgactctggatgcgtcatcaactggaaaggccgcgaactgaagtgtgggtccggaattttcgtgaccaacgaggttcacacgtggacagaacaatataagtttcaggctgatagccctaaacggctctccgccgcgatcggcaaggcctgggaggagggggtgtgcggcattagatctgctacccgcctggaaaatatcatgtggaaacagattagcaacgagcttaatcatatcctgctcgaaaacgacatgaagttcaccgtcgtggtgggagacgccaatggcatcctggctcaggggaaaaagatgattcggccgcaacccatggagcacaaatactcctggaagtcttggggaaaggccaaaatcattggcgccgatatccagaacacaacctttattatcgacgggcctgatacgcccgaatgtcctgacgatcagagagcttggaatatctgggaggtcgaggactatggattcggcatttttacaaccaacatctggctgaagcttcgcgatagctacacacagatgtgcgaccaccggctcatgtccgcggccattaaagatagcaaggctgttcatgccgacatgggctattggatcgaatctgagaaaaatgaaacctggaagctggccagagcttccttcattgaggtgaagacatgtacctggcccaaaagccacacgctgtggtctaacggggtgctcgaatccgagatgatcatcccgaagatttacggaggccctatcagccaacataattatcgccccgggtacttcacccagacagccggaccttggcacctgggcaaacttgagctggattttaacctctgcgaagggaccacagtcgtggttgacgagcactgcggaaatcggggcccctctctgagaaccacgacagtgaccggcaagattatccatgaatggtgttgccggagctgtacactgcctccccttcgcttcagaggggaggatggatgctggtacggcatggagattcggccggtcaaagaaaaggaggaaaacctcgtgagatccatggttagcgcggggtctggagaggtggactcctttagcctgggcatcctgtgtgtctccatcatgattgaagaggtgatgcgctctcggtggagcagaaagatgctcatgaccgggaccctggctgttttccttctgctcatcatgggacagctgacatggaatgacctgattcgcctttgcatcatggtgggcgccaacgcctccgatagaatgggcatggggacgacctatctggctctcatggccacatttaaaatgcggcctatgttcgcggtcggactgctctttcgcagactgacctctcgggaggtgcttctgctcacaattggcctgagcctggtggcttccgtcgaacttcccaactctctggaggaactcggggacggactggccatgggcatcatgatgctcaagctgcttaccgagttccaaccccaccagctgtggacgacactcctgagcctgacctttattaaaaccacactttccctggattacgcctggaagaccacagctatggccctcagcatcgtttctctgttccctctctgtctgtccacgaccagccagaaaacaacctggcttccggtgctgctggggtcttttggatgcaagcccctcacaatgttcctgatcaccgaaaataagatttggggccgcaaatcctggcctcttaacgagggcatcatggctattgggatcgtgagcattctgctctcttccctgctcaagaatgacgtccccctggccggacctcttatcgcgggcgggatgctgatcgcctgttatgtgattagcggatccagcgctgatctgtctctcgagaaagccgctgaagttagctgggagcaggaagccgagcattccggcacgtctcacaacatcctggtggaagtccaagacgatgggaccatgaagattaaagacgaggagaaggatgacacacttaccatcctgctcaaagccacactgctcgctgtgagcggagtttaccccatgtccattcctgcgaccctgtttgtgtggtatttctggcagaagaagaaacagagatctggcgtcctttgggatacacccagcccgcctgaagtggagcgggccgtcctggacgatggcatctaccgcatcctgcagagagggctcctgggacggtcccaagtgggcgttggggtgttccaggacggagtctttcatacgatgtggcacgtgacccgcggcgctgttcttatgtatcaggggaagagactggaaccctcttgggccagcgtgaaaaaggacctcatttcctacggaggcggctggcggttccaggggagctggaatacaggagaggaggtccaagtgatcgccgtggaacctggcaaaaaccccaagaatgttcagaccaccccggggacatttaagacgcctgagggagaagtcggcgctattgccctggatttcaaacccgggacctctggatcccctatcgtgaacagagagggcaagattgtgggcctctacgggaatggagtcgtgacaaccagcggcacatatgtttctgcgatcgctcaggccaaagcctcccaagaagggcccctgcccgagattgaggacgaagtgtttaagaaacgcaaccttaccatcatggatctgcaccctggaagcggcaagacgcggagatacctgccggctatcgtccgcgaggccattaagcggaaactcagaacactgatccttgcgcccacccgcgtggttgcttccgaaatggccgaggccctgaaggggatgcctattcggtatcagaccacagctgtgaaatctgaacataccggcagagagatcgtcgacctcatgtgccacgccacattcaccatgcgcctgctgagccccgtgcgggttcctaattacaacatgattatcatggatgaggctcattttacggaccccgcctccatcgcggccagaggatatattagcacacgggtgggcatgggggaagctgccgctatcttcatgaccgccacacctccgggatctgtcgaggcctttccccagtccaatgctgtgattcaggatgaagagcgcgacatccctgaaagaagctggaactctggctacgattggattaccgacttccccgggaagacggtgtggtttgtccctagcatcaaatccggaaatgatatcgcgaactgtctccggaagaacggcaagcgcgttattcaactttctagaaaaaccttcgacacagagtatcagaagaccaaaaataacgactgggattacgtggtgacaaccgacatcagcgagatgggggccaatttccgggctgatagagtcattgacccccgccggtgcctgaagccggtgatcctgaaagatggccctgaaagagttattctcgccggacccatgcccgtgacagtcgcctccgctgcccagcgccggggcagaatcgggcgcaaccagaataaggagggagaccaatacgtgtatatgggccagcctctgaacaatgatgaagaccacgcgcattggaccgaggctaagatgcttctggataacattaatacgcccgaggggatcatccctgccctctttgaaccggagcgggaaaaatctgccgctattgacggagagtacagactgcgcggcgaagccagaaagacattcgttgagctgatgcggcgcggggatctccccgtgtggcttagctataaagtcgcgtccgagggctttcagtacagcgacagacggtggtgcttcgatggagaacgcaacaatcaggtgctggaggaaaacatggacgtcgagatctggaccaaggaaggcgagagaaaaaagctgcggcctagatggctcgacgcccgcacctattctgatcccctggctcttcgggagtttaaagaattcgccgctgggagacgctccgtgagcggagacctgattctcgagatcggcaagctgcctcaacacctgacactccgggcccagaatgctcttgataacctggttatgctgcacaattccgaacaggggggaaaggcctacagacatgcgatggaggaactccccgacaccattgagacactgatgcttctggccctcatcgctgtgctgacgggcggcgtgaccctgtttttcctctctgggaaaggacttggcaagacaagcatcgggctgctgtgtgtcaccgcctcctctgctctcctgtggatggccagcgttgagccgcactggattgccgcttccatcattcttgaatttttcctgatggtgctcctgatccctgagcccgatcggcagcgcacacctcaagacaaccagctggcgtatgtggtcattggactcctttttatgatcctgaccgtggccgctaacgaaatgggcctgctcgagacgaccaaaagagatctggggatcggacatgttgccgccgagaatcaccagcacgctacaatgcttgacgtggatctgcggcccgccagcgcgtggaccctctacgccgtcgctacaaccgtgattacgcctatgatgcgccatacaatcgaaaacaccacagccaatatttctctgaccgctatcgccaaccaagcggccattctgatgggcctcgacaagggctggcccatctccaaaatggatattggggtcccgcttctggctctgggatgctacagccaggtgaatcctctcaccctgacagccgctgttcttatgctggtggcccactatgctatcatcggccccgggctccaggccaaggcgacgagagaggcccagaagcggaccgctgccggaattatgaaaaaccccacagtcgacggcatcgtggctattgatctggaccctgttgtgtacgacgccaagttcgaaaaacaactggggcagatcatgctccttattctgtgtacctctcagatcctgctcatgcgcacaacctgggccctgtgcgagtccatcacgcttgcgacaggaccgctgaccaccctctgggaaggcagccccggcaagttttggaatacaaccattgctgtctctatggccaacatcttcagagggagctatctggctggagccggcctggccttctccctcatgaaatctcttgggggaggccggcgcgggacaggagctcagggcgagacgctgggcgagaagtggaagagacaactgaatcagctcagcaaatccgaatttaacacctacaagcggagcgggattatggaggtggatagatccgaagccaaagagggactgaagcgcggcgaaacaaccaaacatgcggtgtctcgggggacagccaagcttagatggttcgttgagcgcaatctggtcaagcctgagggaaaagtgatcgacctcggctgtgggcggggaggctggagctattactgcgctggcctgaagaaagtgaccgaagtcaaggggtatacgaaaggaggccccgggcacgaggaacctattcccatggccacctacggatggaacctggttaagctccattccggcaaagatgtgtttttcatgcctccggagaagtgtgacacacttctgtgcgatatcggggaatctagccccaatcctaccatcgaggagggaagaacactgcgcgtgctcaagatggtcgaaccctggctgcggggcaaccagttttgtattaaaatccttaatccttacatgccctccgtggttgagaccctggaacagatgcaaagaaagcacggcgggatgctcgtgcgcaacccgctgtctcggaatagcacacacgagatgtattgggtctcctgcggaaccggcaacattgtgagcgctgttaacatgacgtctagaatgctgctcaatcgcttcacaatggcccatcggaaacctacctacgagagagacgtggatctgggggcgggaacccgccacgtcgccgtggaacccgaggtggctaaccttgacatcattggccagagaatcgaaaatattaagaacgagcataaatccacatggcactatgatgaagacaatccctacaagacgtgggcctatcacgggagctacgaggtcaagccttctggatccgctagctctatggttaacggcgtggtgcggctgctcaccaaaccctgggatgtcatccctatggtgacacagatcgccatgaccgacacaaccccgtttggccaacagcgcgttttcaaggagaaagtggacacaagaaccccccgggctaagagagggacgacccagattatggaagtcacagccaaatggctgtggggatttctttcccggaataagaagcctcgcatctgtaccagagaggaattcacacggaaagtgcgcagcaacgcggccattggcgctgtttttgtggatgagaatcagtggaactccgccaaggaagctgtcgaggacgagagattctgggatctggtgcatcgggaacgcgagctccacaaacaagggaagtgcgccacctgcgtttataatatgatgggaaaaagagaaaagaagctgggcgagtttgggaaagccaagggcagccgggcgatctggtacatgtggctgggagctcgcttcctcgaattcgaggccctgggctttatgaacgaggaccattggttctctagagaaaatagcctttccggggtggagggagaaggcctgcacaaactcgggtacattctgcgggatatctctaagatccccggaggcaacatgtatgccgacgatacggctgggtgggacacacgcattaccgaggatgaccttcagaatgaggccaaaatcacagatattatggaacctgagcatgctctgctcgccaccagcatctttaagctgacgtaccagaacaaagtcgtgagagtccagcggcccgcgaagaacggcaccgtgatggacgttatttcccgcagagatcaacggggatctggccaggtggggacatatggactgaataccttcacaaacatggaagtccagctcatcagacagatggagagcgaaggcatctttctgccgtccgagcttgagacccctaatctggccgaacgcgtgctcgactggctggagaagcacggggctgaacggcttaaaagaatggccatttctggagacgattgtgtggttaagcccatcgacgatcgcttcgctacagccctgaccgcgctcaacgacatgggcaaagtgcggaaggatattcctcaatgggagcccagcaaagggtggaatgactggcagcaggtccctttttgctcccaccatttccaccagctgatcatgaaggatggcagagaaattgtggttccctgtcgcaaccaagacgagctggtgggacgggccagagtcagccagggcgctgggtggtctctccgcgagacggcctgcctgggaaagtcctacgctcagatgtggcaacttatgtattttcatcggagagatctgcgcctcgccgctaatgccatctgtagcgcggtgccggtcgactgggtgcctacatctcggaccacctggtccatccacgcccaccatcagtggatgacaaccgaagatatgctgagcgtttggaacagagtgtggattgaggaaaatccctggatggaggacaaaacacacgtctcctcttgggaagaggtgccctaccttggcaagcgggaggaccagtggtgcgggagcctgatcggactcacggctagagccacctgggccacaaacattcaggttgctatcaatcaagtgcgccggctgattggcaacgaaaattatctggattacatgacctccatgaaaagattcaagaacgagagcgaccctgaaggggccctctggtga

SEQ ID NO: 18812 - RNA, 9879 nt, synthetic construct
  misc_feature 1..9879: note = derived and/or modified CDS sequence (opt5) from DENV-1__GU131838__SS-prME
  source 1..9879: mol_type = other RNA
agcgtgaccatgctgctcatgctgcttcccaccgccctggctttccacctcacgacccggggcggggagcctcatatgatcgtctccaagcaggaacgggggaaatctctgctttttaagacaagcgccggcgttaatatgtgcaccctgattgcgatggacctcggggagctgtgtgaagatacaatgacctacaaatgcccccgcatcacagaggctgaacccgacgatgtggactgttggtgcaatgccaccgatacgtgggtgacctatggaacatgttcccaaaccggcgagcaccggcgggagaagcgctctgtcgccctggctcctcatgtggggctcggactggaaacaagaaccgagacgtggatgagctccgaaggcgcctggaaacagattcagcgggttgagacatgggctcttagacaccccggcttcaccgtgatcgcctttttcctggcgcatgccattgggacatctatcacccagaagggaatcatttttatcctcctgatgcttgtcacccctagcatggctatgagatgcgtgggcattgggaatcgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagattgttcagtacgagaacctcaaatattctgtgatcgtcacggtgcacaccggcgaccagcatcaagttgggaatgaaacaaccgagcacggaacaatcgctaccattacgccccaggcccctacctccgaaatccagctgacagattacggcgccctgaccctcgactgtagcccccggacaggcctggactttaacgagatggtgcttctgaccatgaaggagaaatcttggctcgtccataagcagtggttcctggatcttcctctgccctggacgtccggggctagcacatcccaagaaacctggaatcgccaggacctcctggtgacatttaaaaccgcgcacgccaagaagcaggaggtcgtggttctgggatctcaagaaggcgctatgcacaccgccctcacaggggccacggagattcagaccagcggaacaaccacaatcttcgctggccatctgaaatgcagacttaagatggataaactgaccctcaaggggatgtcctatgtgatgtgtacgggcagcttcaaactggaaaaggaggtcgccgagacacagcacggaaccgtgctggttcaggtgaagtacgaaggcaccgacgcgccgtgcaaaattcctttttctacacaagatgagaagggggtcacccagaacggacggcttatcacagctaatcccatcgtgacggacaaagaaaagcctgtgaacattgagaccgagccgcccttcggcgaatcctatatcgttgtcggggccggagagaaagccctcaagctgagctggtttaagagaggctctagcattgggaaaatgttcgaagctacagcccgcggcgctcggagaatggccatcctgggagataccgcgtgggactttggctccattgggggagtgttcacatctgtgggcaagctcgtccatcaggtgtttgggaccgcctacggagttctgttcagcggcgtgtcctggacgatgaaaatcgggatcggcattcttctgacctggctcggactgaatagccgctctacatccctgagcatgacctgtatcgctgtcggcatggtgacactttacctcggggttatggtgcaggccgattctggatgcgtcattaactggaagggccgggagctgaaatgtgggtccggaatctttgtgaccaacgaagttcacacatggaccgagcaatataagttccaggctgacagccctaagagactgtccgccgcgattggcaaagcctgggaggaaggggtgtgcggcatccgctctgctacgcggctcgagaatattatgtggaagcagatcagcaacgaactgaatcatatccttctggagaacgatatgaaatttacagtcgtggtgggagacgccaatggcattctcgctcaggggaagaaaatgatcagaccgcaacccatggaacacaagtactcctggaaatcttggggaaaggccaagattatcggcgccgacattcagaacaccaccttcatcatcgatgggcctgacacacccgagtgtcctgatggacagcgcgcttggaatatttgggaggtcgaagactatggctttggcgttttcaccacgaacatctggctgaaactgcgggatagctacacacagatgtgcgaccacagacttatgtccgcggccattaaggatagcaaagctgtgcatgccgacatggggtattggatcgagtctgaaaagaatgagacctggaaactcgcccgcgcttccttcattgaagtgaagacatgtacctggcccaagagccacacactgtggtctaacggagtcctggagtccgagatgatcatcccgaaaatttacggcgggcctatcagccaacataattatcggcccggatactttacccagacggccggcccttggcacctcgggaagctggaacttgatttcgacctgtgcgagggaaccacagtggttgtggatgaacactgcggcaacagaggcccctctctccggaccacaaccgtcacggggaaaattatccatgagtggtgttgccgcagctgtacactgcctcccctgagatttcggggagaggacggctgctggtacgggatggaaattagaccggtgaaggagaaagaagagaatcttgttcgctccatggtgagcgcgggatctggcgaagtcgattccttcagcctcgggatcctgtgtgtgtccatcatgattgaggaggttatgcggtctagatggagccgcaagatgctgatgaccggaacactcgctgtgtttctgcttctgatcatgggccagctcacctggaacgacctgattagactgtgcatcatggtcggcgccaatgcctccgaccggatggggatgggaaccacatatcttgctctgatggccacgttcaagatgcgccctatgtttgcggtgggcctcctgttcagacggctcacctctcgcgaagtgctgcttctgacaattgggctcagcctggtcgcttccgttgagctgcccaactctcttgaagaactgggagatggcctcgccatggggatcatgatgctgaaactcctgaccgaatttcaaccccaccagctttggacaaccctgctcagcctgacgttcgtgaagacaaccctgtcccttgactacgcctggaaaaccacagctatggtgctgagcattgtctctctctttcctctgtgtctctccaccacaagccagaagacgacctggctgccggtgcttctgggatctttcggctgcaaacccctgacaatgtttctcatcaccgagaacaagatctggggcagaaagtcctggcctctgaatgaggggattatggccatcggaattgttagcatccttctgtcttccctcctgaaaaacgatgtgcccctcgctggccctctgattgccgggggaatgcttatcgcgtgttatgtcatcagcggctccagcgccgacctgtctctggaaaagacagctgaggtgagctgggaacaggaggccgaacattccggggcttctcacaatattctcgttgaggtgcaagatgacggaaccatgaaaatcaaggatgaggaacgggacgatacgctgaccattcttctgaaagccacactcctggccgtcagcggcgtgtaccccatgtccatccctgctaccctcttcgtctggtatttctggcagaagaaaaagcagcgctctggcgtgctgtgggacacacccagcccgcctgaggttgaaagagcggtgcttgatgacgggatttaccggatcctgcagcgcggactgctcggcagatcccaagtcggggtgggagtttttcaggatggcgtgttccataccatgtggcacgtcacaagaggggccgtgctgatgtatcagggaaagagacttgagccctcttgggctagcgtgaaaaaggacctgatctcctacggcggcgggtggcgctttcagggaagctggaacacgggcgaggaagttcaagtcattgccgtggagcctgggaaaaatcccaagaacgtgcagaccacaccgggaaccttcaaaacccctgaaggcgaggtcggggccatcgctctcgactttaagcccggaacatctggctcccctattgtgaatcgggaaggcaagatcgttgggctgtacggaaacggcgtggtcacgaccagcgggacatatgtgtctgccattgcgcaggctaaagcctcccaagagggacccctccccgagatcgaagatgaggttttcaagaaaagaaatctgaccattatggaccttcaccctggcagcgggaagacacgccggtacctgccggccatcgtgagagaagctatcaaacgcaagctgcggaccctcattctggcccccacgagagtcgtggcgtccgagatggctgaagcccttaagggcatgcctatccgctatcagacaaccgccgttaaatctgagcataccggacgggagattgtggatctgatgtgccacgctacatttaccatgagactcctgagccccgtccgggtgcctaactacaatatgatcattatggacgaagcccatttcacagatcccgcttccatcgccgcgcgcggctatatcagcaccagagtggggatgggagaggccgctgccatttttatgacggctacacctccgggctctgtcgaagccttcccccagtccaacgccgttatccaggacgaggaacgggatattcctgagcgcagctggaactctgggtacgactggatcaccgattttcccggaaagacagtgtggttcgtgcctagcattaaatccggcaacgacatcgctaattgtctgagaaagaacgggaaacgggtcatccaactctctagaaagaccttcgatacggagtatcagaagaccaaaaacaatgactgggactacgtggttacaaccgatattagcgaaatgggcgcgaactttcgcgccgaccgggtgatcgatcccagacgctgccttaagccggtcattctgaaagacggacctgagcgggtgatcctggctggccccatgcccgttacagtggcctccgccgctcagagacgcgggcggattggaagaaatcagaacaaggaaggcgatcaatacgtctatatggggcagcctctcaataacgacgaggatcacgcccattggaccgaggcgaaaatgctgcttgacaatatcaacacacccgaaggaattatccctgctctgttcgagccggaacgcgagaagtctgccgccatcgatggcgaatacagactcagaggggaagctcgcaagacctttgtggagctgatgagacggggcgacctgcccgtctggctcagctataaagtggcctccgaaggattccagtacagcgatcgcagatggtgctttgacggcgagcggaataaccaggttcttgaagagaatatggatgtggaaatttggacgaaggagggggagcgcaagaaactgcgccctcggtggctggacgcgagaacatattctgaccccctcgccctgcgcgagttcaaagagtttgctgccggacggagatccgtgagcggcgatcttatcctggaaattgggaaactccctcaacacctgaccctgcgggctcagaacgccctcgacaatcttgtcatgctgcacaactccgagcagggaggcaaggcttaccgccatgccatggaggaactgcccgataccatcgagacactcatgctgcttgcgctgattgccgttctcaccggcggggtgacactgttctttctgtctggaaagggcctcgggaagacgagcatcggacttctgtgtgtgaccgcttcctctgccctgctctggatggctagcgtcgaaccgcactggatcgccgcctccattatcctggagttctttcttatggtgctgctcattcctgaacccgacagacagcggacacctcaagataatcagctggcttatgttgtgatcggcctcctgttcatgattcttaccgtcgcggccaacgagatggggctgctggagacaaccaaaaaggacctcggaatcggctacgtggctgccgaaaaccatcagcacgccacgatgctggatgtcgaccttcaccccgctagcgcctggaccctgtacgcggtggccacaaccgttatcacacctatgatgcgccataccattgagaatacgacagctaacatctctctcaccgccattgctaatcaagccgcgatcctgatgggcctggataaagggtggcccatttccaagatggacatcggagtgccgctccttgccctgggctgctatagccaggtcaaccctctgacactcaccgctgccgtgctgatgcttgttgctcactacgccattatcgggcccggactgcaggctaaagccaccagagaagcgcagaagcggacagccgctggcatcatgaagaatcccacggtggatgggattgtcgccatcgacctcgatcctgtggtgtatgacgctaaatttgagaagcaactgggacagattatgctgctcatcctttgtacctctcagattctgctgatgcgcacaacctgggccctctgcgaatccatcacactggccaccggcccgcttacgacactgtgggagggcagccccgggaaattctggaacaccaccatcgcggtttctatggctaatattttcagaggaagctacctcgccggcgctgggctggccttttccctgatgaagtctctcggaggcgggcggcgcggaacaggcgcccagggcgagacccttggggaaaaatggaagagacaactgaaccagctgagcaagtccgagttcaatacatataaacggagcggaatcatggaagtcgacagatccgaggctaaggaaggcctcaaacgcggggagacgaccaagcatgccgtgtctcggggaacagcgaaactgagatggtttgtggagcgcaaccttgtcaagcctgaaggcaaggttattgatctggggtgtggacggggcggctggagctactattgcgccgggctcaaaaaggtgaccgaggtgaaaggatacacaaagggcgggcccggacacgaggaacctatccccatggctacctacggctggaatctggtcaaactgcattccgggaaggacgtgttctttatgcctccggaaaaatgtgatacgctcctttgcgacattggagagtctagccccaaccctaccatcgaggaaggcagaacactgcgcgttctgaagatggtggagccctggctccggggcaatcagttctgtatcaagattctgaacccttatatgccctccgtcgtggaaacccttgagcagatgcaaagaaaacacgggggaatgctggttcgcaatccgctctctcggaacagcacacacgagatgtactgggtgtcctgcggcaccgggaatatcgtcagcgccgtgaacatgacatctagaatgctgctgaaccgctttaccatggctcatcggaagcctacgtatgaaagagatgtggacctcggagccggcacacgccacgtcgcggttgagcccgaagtggccaatctggatattatcgggcagagaattgagaacatcaaaaatgaacataagtccacctggcactacgacgaggataacccctataaaacctgggcttaccacggaagctatgaggtgaagccttctggctccgccagctctatggtcaatggcgtggttcggcttctgacaaagccctgggacgtgattcctatggtcacgcagatcgctatgaccgatacaaccccgttcgggcaacagcgcgtgtttaaagaaaaggttgacacaagaacaccccgggccaaaagaggaacaacccagatcatggaggtgacggctaagtggctctggggcttcctgtcccggaacaaaaagcctcgcatttgtaccagagaagagtttacacggaaggtccgcagcaatgccgcgatcggggccgtgttcgttgacgaaaaccagtggaactccgctaaagaggccgtggaggatgaaagattttgggaccttgtccatcgggagcgcgaactgcacaagcaaggaaaatgcgctacctgcgtgtacaacatgatgggcaagagagagaaaaagctcggggagttcggcaaggccaaaggaagccgggccatttggtacatgtggctgggcgcgcgcttcctggagtttgaggctctcgggttcatgaatgaagatcattggttttctagagagaacagcctgtccggagtcgaaggcgaggggcttcacaagctgggatatatcctccgggacatttctaaaatccccggcgggaatatgtacgccgatgacacagccggctgggatacccgcatcacggaggacgatctgcagaacgaagctaagattacagacatcatggagcctgaacatgcccttctggctaccagcattttcaaactcacatatcagaataaggtggttagagtgcagcggcccgccaaaaacggaaccgtcatggatgtgatctcccgcagagaccaacggggctctggacaggtgggaacgtacggcctgaacacctttacaaatatggaggttcagctgattagacagatggaaagcgaggggatcttcctcccgtccgagctggaaacccctaaccttgcggagcgcgccctggattggctcgaaaagcacggagctgagcggctgaagagaatggccatctctggcgacgactgtgtggtcaaacccattgatgaccgctttgctacagcccttaccgcgctgaatgatatggggaaggtgcggaaagacatccctcaatgggaacccagcaagggctggaacgattggcagcaggttcctttctgctcccaccattttcaccagctcattatgaaagacggaagagagatcgtggtcccctgtcgcaatcaagatgagctggtgggccgggccagagtcagccagggggctggatggtctctgcgcgaaacagcctgcctcggcaagtcctatgctcagatgtggcaactgatgtacttccatcggagagaccttcgcctggccgctaacgccatttgtagcgcggtgccggttgattgggtgcctacctctcggacgacatggtccatccacgcccaccatcagtggatgaccaccgaggacatgctcagcgtctggaatagagtgtggatcgaagagaacccctggatggaagataagacacacgtttcctcttgggaggaggtgccctatctggggaaacgggaagaccagtggtgcggaagccttattggcctgaccgctagagccacatgggccacgaatatccaggtcgctattaaccaagtgcgccggctcatcgggaatgagaactacctggactacatgacctccatgaagagatttaaaaatgaaagcgatcctgagggcgccctgtggtga

SEQ ID NO: 18813 - RNA, 9879 nt, synthetic construct
  misc_feature 1..9879: note = derived and/or modified CDS sequence (opt5) from DENV-1__GU131839__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgccggcgttaacatgtgcaccctgattgcgatggacctcggggagctgtgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctcggactggaaacaagaaccgagacgtggatgagctccgaaggcgcctggaaacagattcagcgggttgagacatgggctcttcgccaccccggcttcaccgtgatcgcctttttcctggcgcatgccattgggacatctatcacccagaagggaatcatttttatcctcctgatgcttgtcacccctagcatggctatgagatgcgtgggcattgggaaccgggacttcgttgagggactgtccggcgccacatgggtggatgtcgtgctcgaacacgggagctgtgtgacgaccatggctaagaataaacccacactggacatcgagctgctcaagaccgaagtcacaaaccctgccgttctgcgcaaactttgcattgaggcgaagatctctaataccacgacagattccagatgtccgacccaaggagaagccaccctggtggaggagcaggacgctaactttgtgtgccggcgcacattcgtcgatagaggctggggcaatgggtgtggactctttggcaaagggagcctgcttacctgcgccaagttcaagtgcgtgacaaaactggaaggaaagacggttcagtacgagaacctcaaatattctgtgattgtcaccgtgcacacaggcgaccagcatcaagttgggaatgaaaccacagagcacggaaccatcgctacgatcaccccccaggcccctacatccgaaattcagctgaccgattacggcgccctgacactcgactgtagcccccggaccggcctggactttaacgagatggtgcttctgacgatgaaggagaaatcttggctcgtccataagcagtggttcctggatcttcctctgccctggacatccggggctagcacctcccaagaaacatggaatcgccaggacctcctggtgacctttaaaaccgcgcacgccaagaagcaggaggtcgtggttctgggatctcaagaaggcgctatgcacacagccctcacgggggccaccgagatccagacaagcggaaccacaaccattttcgctggccatctgaaatgcagacttaagatggataaactgacgctcaaggggatgtcctatgtgatgtgtacaggcagcttcaaactggaaaaggaggtcgccgagacccagcacggaaccgtgctggttcaggtgaagtacgaaggcacagacgcgccgtgcaaaatccctttttctacccaagatgagaagggggtcacacagaacggacggcttattacggctaatcccatcgtgaccgacaaagaaaagcctgtgaacatcgagacagagccccccttcggcgaatcctatattgttgtcggggccggagagaaagccctcaagctgagctggtttaagagaggctctagcatcgggaaaatgttcgaagctaccgcccgcggcgctcggagaatggccattctgggagatacagcgtgggactttggctccatcgggggagtgttcacctctgtgggcaagctcgtccatcaggtgtttgggacggcctacggagttctgttcagcggcgtgtcctggaccatgaaaattgggatcggcatccttctgacatggctcggactgaatagccgctctacctccctgagcatgacatgtattgctgtcggcatggtgaccctttacctcggggttatggtgcaggccgattctggatgcgtcatcaactggaagggccgggagctgaaatgtgggtccggaatttttgtgacaaacgaagttcacacctggacggagcaatataagttccaggctgacagccctaagagactgtccgccgcgatcggcaaagcctgggaggaaggggtgtgcggcattcgctctgctacacggctcgagaatatcatgtggaagcagattagcaacgaactgaatcatatccttctggagaacgatatgaaatttaccgtcgtggtgggagacgccaatggcatcctcgtccaggggaagaaaatgattagaccgcaacccatggaacacaagtactcctggaaatcttggggaaaggctaagatcattggcgccgacacccagaacacaaccttcatcattgatgggcctgacacgcccgagtgtcctgatggacagcgcgcctggaatatctgggaggttgaagactatggctttggcgtgttcacaaccaacatctggctgaaactgcgggatagctacacacagatgtgcgaccacagacttatgtccgctgcgattaaggatagcaaagccgtgcatgctgacatggggtattggatcgagtctgaaaagaatgagacctggaaactcgcccgcgcctccttcattgaagtcaagacatgtacctggcccaagagccacacgctgtggtctaacggagtgctggagtccgagatgatcattccgaaaatctacggcgggcctatcagccaacataattatcggcccggatactttacccagacagctggcccttggcacctcgggaagctggaacttgatttcgacctgtgcgagggaaccacagttgtggtcgatgaacactgcggcaacagaggcccctctctccggaccacgacagtgaccgggaaaattatccatgagtggtgttgccgcagctgtacactgcctcccctgagatttcggggagaggacggctgctggtacgggatggaaattagaccggttaaggagaaagaagagaatcttgtgcgctccatggtcagcgccggatctggcgaagtggattccttcagcctcgggatcctgtgtgtttccattatgatcgaggaggtgatgcggtctagatggagccgcaagatgctgatgaccggaaccctcgcggtctttctgcttctgatcatgggccagctcacatggaacgacctgattagactgtgcatcatggtgggcgctaatgcctccgaccggatggggatgggaacgacctatcttgccctgatggctacattcaagatgcgccctatgtttgccgtgggcctcctgttcagacggctcacctctcgcgaagtcctgcttctgacaattgggctcagcctggttgcgtccgtggagctgcccaactctcttgaagagctgggagatggcctcgctatggggatcatgatgctgaaactcctgaccgaatttcaaccccaccagctttggacgacactgctcagcctgaccttcgtgaagaccgccctgtcccttgactacgcctggaaaacaaccgctatggtcctgagcattgtgtctctctttcctctgtgtctctccacaacgagccagaagaccacatggctgccggttcttctgggatctttcggctgcaaacccctgaccatgtttctcatcacagagaacaagatttggggcagaaagtcctggcctctgaatgaggggatcatggccatcggaattgtgagcatccttctgtcttccctcctgaaaaacgatgtccccctcgctggccctctgattgccgggggaatgcttatcgcgtgttatgtgattagcggctccagcgccgacctgtctctggaaaaggctgccgaggttagctgggaacaggaggctgaacattccggggcctctcacaatatcctcgtggaggtccaagatgacggaaccatgaaaatcaaggatgaggaacgggacgatacgctgaccattcttctgaaagccacactcctggctgtgagcggcgtctaccccatgtccatccctgcgaccctcttcgtgtggtatttctggcagaagaaaaagcagcgctctggcgttctgtgggacacacccagcccgcctgaggtggaaagagccgtccttgataacgggatttaccggatcctgcagcgcggactgctcggcagatcccaagtgggggttggagtgtttcaggacggcgtcttccataccatgtggcacgtgacacggggggctgtgctgatgtatcagggaaagagacttgagccctcttgggccagcgttaaaaaggatctgatttcctacggcggcgggtggcgctttcagggaagctggaatacgggcgaggaagtccaagtgatcgccgtggagcctgggaaaaaccccaagaatgtccagaccacaccgggaaccttcaaaacccctgaaggcgaggtgggggctatcgccctcgactttaagcccggaacatctggctcccctattgttaaccgggaaggcaagatcgtggggctgtacggaaatggcgtcgtgacgaccagcgggacatatgtttctgcgattgctcaggccaaagcctcccaagagggacccctccccgagatcgaagacgaggtgttcaagaaaagaaacctgaccattatggatcttcaccctggcagcgggaagacacgccggtacctgccggctatcgtcagagaagccattaaacgcaagctgcggaccctcatcctggcgcccacgagagtggttgcttccgagatggccgaagcccttaagggcatgcctatccgctatcagacaaccgctgtgaaatctgagcataccggacgggagattgtcgacctgatgtgccacgccacatttaccatgagactcctgagccccgtgcgggtgcctaattacaacatgatcattatggatgaagctcatttcacagaccccgcctccatcgcggcccgcggctatattagcaccagagtcgggatgggagaggctgccgctatctttatgacggccacacctccgggctctgttgaagccttcccccagtccaatgctgtgatccaggatgaggaacgggacattcctgagcgcagctggaactctgggtacgattggatcaccgactttcccggaaagacagtgtggttcgtccctagcattaaatccggcaatgatatcgcgaactgtctgagaaagaacgggaaacgggtgattcaactctctagaaagaccttcgacacggagtatcagaagaccaaaaataacgattgggactacgttgtgacaaccgacatcagcgaaatgggcgccaattttcgcgctgatcgggtcatcgaccccagacgctgccttaagccggtgattctgaaagatggacctgagcgggttatcctggccggccccatgcccgtgacagtcgcctccgctgcccagagacgcgggcggattggaagaaaccagaataaggaaggcgaccaatacgtgtatatggggcagcctctcaacaatgatgaggaccacgcgcattggaccgaggctaaaatgctgcttgataacatcaatacacccgaaggaattatccctgccctgttcgagccggaacgcgagaagtctgccgctattgacggcgaatacagactccggggggaggcccgcaagacctttgtcgagctgatgagacggggcgatctgcccgtgtggctcagctataaagttgcgtccgaaggattccagtacagcgaccgcagatggtgctttgatggcgagcggaacaatcaggtgcttgaagagaacatggacgtggaaatctggacgaaggagggggagagaaaaaagctgcgccctcggtggctggatgccagaacatattctgaccccctcgctctgcgcgaattcaaagagtttgccgctggacggagatccgtcagcggcgaccttatcctggaaattgggaagctccctcaacacctgaccctgcgggcccagaatgctctcgataaccttgttatgctgcacaattccgagcagggaggcaaagcctaccgccatgcgatggaagagctgcccgacaccatcgagacactcatgctgcttgccctgattgctgtgctcaccggcggggtgacactgttctttctgtctggaaagggcctcgggaagacgagcatcggacttctgtgtgtcaccgcctcctctgctctgctctggatggccagcgtggaaccgcactggattgccgcttccatcatcctggagttctttcttatggttctgctcattcctgaacccgatagacagcggacacctcaagacaaccagctggcgtatgtggtcatcggcctgctcttcatgattcttaccgtggccgctaacgagatggggctgctggagacaaccaaaaaggatctcggaatcggctacgtcgccgccgaaaatcatcagcacgctacgatgctggacgtggatcttcaccccgccagcgcgtggaccctgtacgccgttgctacaaccgtgattacacctatgatgcgccataccatcgagaacacgacagccaatatctctctcaccgctattgccaaccaagcggccatcctgatgggcctggacaaagggtggcccatttccaagatggatatcggagtcccgctccttgctctgggctgctatagccaggtgaatcctctgacactcacctctgccgttctgatgcttgtggctcactacgccattatcgggcccggactgcaggctaaagccaccagagaagcgcagaagcggacagccgctggcattatgaagaaccccacggtcgacgggatcgtggccatcgatctcgaccctgtggtttatgatgctaaatttgagaagcaactgggacagattatgctgctcatcctttgtacctcccagattctgctgatgcgcacaacctgggccctctgcgaaagcatcacactggccaccggcccgcttacgacactgtgggagggctctcccgggaaattctggaataccaccattgcggtcagcatggctaacatcttcagaggatcctacctcgccggcgctgggctggccttttctctgatgaagagcctcggaggcgggcggcgcggaacaggcgcccagggcgagacccttggggaaaaatggaagagacaactgaatcagctgtccaagagcgagttcaacacatataaacggtccggaatcatggaagtggacagatctgaggctaaggaaggcctcaaacgcggggagacgaccaagcatgccgtgagccggggaacagcgaaactgagatggtttgtcgagcgcaatcttgttaagcctgaaggcaaggtgattgacctggggtgtggacggggcggctggtcctactattgcgccgggctcaaaaaggtgaccgaggtcaaaggatacacaaagggcgggcccggacacgaagagcctatccccatggctacctacggctggaacctggtgaaactgcattctgggaaggatgttttctttatgcctccggaaaaatgtgacacgctcctttgcgatattggagagagctcccccaatcctaccatcgaggaaggcagaacactgcgcgtgctgaagatggtcgagccctggctccggggcaaccagttctgtattaagatcctgaatccttatatgccctctgtggttgaaacccttgagcagatgcaaagaaaacacgggggaatgctggtgcgcaacccgctcagccggaattccacacacgagatgtactgggtcagctgcggcaccgggaacatcgtgtctgccgtgaacatgacatccagaatgctgctgaatcgctttaccatggctcatcggaagcctacgtatgaaagagacgtcgatctcggagccggcacacgccacgttgcggtggagcccgaagtggccaacctggacattatcgggcagagaattgagaatatcaaaaacgaacataagagcacctggcactacgatgaggacaatccctataaaacctgggcttaccacggatcttatgaggtcaagccttccggcagcgcctcttccatggtgaacggcgttgtgcggcttctgacaaagccctgggatgtcattcctatggtgacgcagatcgctatgaccgacacaaccccgttcgggcaacagcgcgtttttagagaaaaagtggatacacggacccccagagccaagcggggaacaacccagattatggaggtcacggctaaatggctctggggcttcctgagccgcaataagaaacctagaatctgtacccgggaagagtttacacgcaaggtgagatccaacgccgcgatcggggccgttttcgtggacgaaaatcagtggaacagcgctaaggaggccgtcgaggacgaacggttttgggatcttgtgcatcgcgagagagaactgcacaaacaaggaaagtgcgctacctgcgtctacaatatgatgggcaaacgggagaagaaactcggggaattcggcaaggccaagggatctcgcgccatttggtacatgtggctgggcgcgagattcctggagtttgaggctctcgggttcatgaacgaagaccattggtttagccgggagaattccctgtctggagtggaaggcgaggggcttcacaaactgggatatatcctccgcgatattagcaagatccccggcgggaacgtttacgccgacgatacagccggctgggacaccagaattacggaggatgacctgcagaatgaagctaaaatcacagatatcatggagcctgaacatgcccttctggctacctccattttcaagctcacatatcagaacaaagtggtccgggtgcagcgccccgccaagaacggaaccgtgatggacgttatctctagacgggatcaaagaggcagcgggcaggtgggaacgtacggcctgaatacctttacaaacatggaggtccagctgattcgccagatggaatccgaggggatcttcctcccgtctgagctggaaacccctaatcttgcggagcgggccctggactggctcgaaaaacacggagtggagagactgaagcgcatggctattagcggcgatgactgtgttgtgaagcccatcgacgatcggtttgccacagctcttaccgccctgaacgacatggggaaagtcagaaaggatatccctcaatgggaaccctccaaaggctggaatgactggcagcaggtgcctttctgcagccaccattttcaccagctcattatgaaggatggacgcgagatcgtcgtgccctgtcggaaccaagacgagctggttggcagagcgcgcgtgtctcagggggccggatggtccctgcgggaaacagcttgcctcggcaaaagctatgcccagatgtggcaactgatgtacttccatagacgcgatcttcggctggctgccaatgctatttgttctgccgtcccggtggactgggttcctacctccagaacgacatggagcatccacgcgcaccatcagtggatgaccaccgaggatatgctctccgtgtggaaccgggtctggattgaagagaatccctggatggaagacaagacacacgtgtctagctgggaggaggtgccctatctggggaagagagaagatcagtggtgcggatcccttatcggcctgaccgcccgcgctacatgggccacgaacatccaggttgccattaatcaagtccggagactcatcgggaacgagaattacctggactacatgaccagcatgaaacgctttaagaacgaatctgactccgagggcgctctgtggtga

SEQ ID NO: 18814 - RNA, 9879 nt, synthetic construct
  misc_feature 1..9879: note = derived and/or modified CDS sequence (opt5) from DENV-1__GU131841__SS-prME
  source 1..9879: mol_type = other RNA
agcgtgacaatgctgctcatgctgcttcccacagccctggctttccacctcacgacccggggcggggagcctcatatgatcgtctccaagcaggaacggggaaaatctctgctttttaagacaagcgttggcgtgaatatgtgcaccctgattgccatggacctcggggagctgtgtgaagatacaatgacctacaaatgccccagaatcacagaggcggaacccgacgatgtggactgttggtgcaatgctaccgatacgtgggtcacctatggaacatgttcccagaccggcgagcaccggcgggagaagcgctctgtggccctggcccctcatgttgggctcggactggaaacaagaaccgagacgtggatgagctccgaaggcgcttggaaacagattcagcgggtggagacatgggcccttcgccaccccggcttcaccgtcatcgcctttttcctggcctacgcgattgggacatctatcacccagaagggaatcatttttatcctcctgatgcttgtgacccctagcatggccatgagatgcgttggcattgggaatcgggacttcgtggagggactgtccggcgctacatgggtcgatgtggtgctcgaacatgggagctgtgtcacgaccatggccaagaataaacccacactggacatcgagctgctcaagaccgaagttacaaaccctgctgtgctgcgcaaactttgcattgaggccaagatctctaataccacgacagattccagatgtccgacccaaggagaagcgaccctggtggaggagcaggacgccaactttgtctgccggcgcacattcgtggatagaggctggggcaatgggtgtggactctttggcaaagggagcctgcttacctgcgctaagttcaagtgcgttacaaaactggaaggaaagattgtgcagtatgagaacctcaaatactctgtcatcgtgacggttcacaccggcgaccagcaccaagtggggaatgaaacaaccgagcatggaacaatcgccaccattacgccccaggctcctacctccgaaatccagctgacagattatggcgccctgaccctcgactgtagcccccggacaggcctggactttaacgagatggtccttctgaccatgaaggagaaatcttggctcgtgcacaagcagtggttcctggatcttcctctgccctggacgtccggggccagcacatcccaagaaacctggaatcgccaggacctcctggtcacatttaaaaccgctcatgcgaagaagcaggaggtggttgtgctgggatctcaagaaggcgccatgcacaccgctctcacaggggccacggagattcagaccagcggaacaaccacaatcttcgccggccacctgaaatgcagacttaagatggataaactgaccctcaaggggatgtcctacgtcatgtgtacgggcagcttcaaactggaaaaggaggtggctgagacacagcatggaaccgttctggtgcaggtcaagtatgaaggcaccgacgccccgtgcaaaattcctttttctacacaagatgagaagggggtgacccagaacggacggcttatcacagcgaatcccatcgtgacggacaaagaaaagcctgttaacattgagaccgagccgcccttcggcgaatcctacatcgtcgtgggggctggagagaaagccctcaagctgagctggtttaagagaggctctagcattgggaaaatgttcgaagccacagctcgcggcgcccggagaatggctatcctgggagataccgcctgggactttggctccattgggggagtgttcacatctgtcggcaagctcgtgcaccaggtttttgggaccgcgtacggagtgctgttcagcggcgtctcctggacgatgaaaatcgggatcggcattcttctgacctggctcggactgaatagccgctctacatccctgagcatgacctgtatcgccgtgggcatggttacactttatctcggggtgatggtccaggctgattctggatgcgtgattaactggaagggccgggagctgaaatgtgggtccggaatctttgttaccaacgaagtgcatacatggaccgagcaatacaagttccaggccgacagccctaagagactgtccgctgccattggcaaagcgtgggaggaaggggtctgcggcatccgctctgccacgcggctcgagaatattatgtggaagcagatcagcaacgaactgaatcacatccttctggagaacgatatgaaatttacagtggtggtcggagacgctaatggcattctcgcccaggggaagaaaatgatcagaccgcaacccatggaacataagtattcctggaaatcttggggaaaggctaagattatcggcgccgacattcagaacaccaccttcatcatcgatgggcctgacacacccgagtgtcctgatggacagcgcgcctggaatatttgggaggttgaagactacggctttggcgtgttcaccacgaacatctggctgaaactgcgggatagctatacacagatgtgcgaccacagacttatgtccgctgcgattaaggatagcaaagccgtgcacgctgacatggggtactggatcgagtctgaaaagaatgagacctggaaactcgcccgcgcctccttcattgaagtcaagacatgtacctggcccaagagccatacactgtggtctaacggagtgctggagtccgagatgatcatcccgaaaatttatggcgggcctatcagccaacacaattaccggcccggatactttacccagacggctggcccttggcatctcgggaagctggaacttgatttcgacctgtgcgagggaaccacagttgtggtcgatgaacactgcggcaacagaggcccctctctccggaccacaaccgtgacggggaaaattatccacgagtggtgttgccgcagctgtacactgcctcccctgagatttcggggagaggacggctgctggtatgggatggaaattagaccggttaaggagaaagaagagaatcttgtgcgctccatggtcagcgccggatctggcgaagtggattccttcagcctcgggatcctgtgtgtttccatcatgattgaggaggtgatgcggtctagatggagccgcaagatgctgatgaccggaacactcgcggtctttctgcttctgatcatgggccagctcacctggaacgacctgattagactgtgcatcatggtgggcgctaatgcctccgaccggatggggatgggaaccacataccttgccctgatggctacgttcaagatgcgccctatgtttgccgtgggcctcctgttcagacggctcacctctcgcgaagtcctgcttctgacaattgggctcagcctggttgcgtccgtggagctgcccaactctcttgaagaactgggagatggcctcgctatggggatcatgatgctgaaactcctgaccgaatttcaaccccatcagctttggacaaccctgctcagcctgacgttcgtgaagacaaccctgtcccttgactatgcctggaaaaccacagccatggtcctgagcattgtgtctctctttcctctgtgtctctccaccacaagccagaagacgacctggctgccggttcttctgggatctttcggctgcaaacccctgacaatgtttctcatcaccgagaacaagatctggggcagaaagtcctggcctctgaatgaggggattatggctatcggaattgtgagcatccttctgtcttccctcctgaaaaacgatgtccccctcgccggccctctgattgctgggggaatgcttatcgcctgttacgtgatcagcggctccagcgcggacctgtctctggaaaaggccgctgaggttagctgggaacaggaggccgaacactccggggcttctcataatattctcgtggaggtccaagatgacggaacaatgaaaatcaaggatgaggaacgggacgataccctgacgattcttctgaaagccaccctcctggccgtgagcggcgtctatcccatgtccatccctgctacactcttcgtgtggtacttctggcagaagaaaaagcagcgctctggcgttctgtgggacacccccagcccgcctgaggtggaaagagcggtccttgatgacgggatttatcggatcctgcagcgcggactgctcggcagatcccaagtgggggttggagtgtttcaggatggcgtcttccacacaatgtggcatgtgaccagaggggctgtgctgatgtaccagggaaagagacttgagccctcttgggctagcgttaaaaaggacctgatctcctacggcggcgggtggcgctttcagggaagctggaacacaggcgaggaagtccaagtgattgccgtggagcctgggaaaaatcccaagaacgtccagacgaccccgggaacattcaaaacccctgaaggcgaggtgggggccatcgctctcgactttaagcccggaacctctggctcccctattgttaatcgggaaggcaagatcgtggggctgtatggaaacggcgtcgtgacaacgagcgggacctacgtttctgccattgcgcaggctaaagcctcccaagagggacccctccccgagatcgaagatgaggtgttcaagaaaagaaatctgacaattatggaccttcaccctggcagcgggaagacccgccggtatctgccggccatcgtcagagaagctatcaaacgcaagctgcggacactcattctggcccccaccagagtggttgcgtccgagatggctgaagcccttaagggcatgcctatccgctaccagacgacagccgtgaaatctgagcacaccggacgggagattgtcgatctgatgtgccatgctacctttacaatgagactcctgagccccgtgcgggtgcctaactataatatgatcattatggacgaagcccacttcaccgatcccgcttccatcgccgcgcgcggctacatcagcacaagagtcgggatgggagaggccgctgccatttttatgaccgctacgcctccgggctctgttgaagccttcccccagtccaacgccgtgatccaggacgaggaacgggatattcctgagcgcagctggaactctgggtatgactggatcacagattttcccggaaagaccgtgtggttcgtccctagcattaaatccggcaacgacatcgctaattgtctgagaaagaacgggaaacgggtgatccaactctctagaaagacattcgataccgagtaccagaagacgaaaaacaatgactgggactacgttgtgaccacagatattagcgaaatgggcgcgaactttcgcgccgaccgggtcatcgatcccagacgctgccttaagccggtgattctgaaagacggacctgagcgggttatcctggctggccccatgcccgtgaccgtcgcctccgccgctcagagacgcgggcggattggaagaaatcagaacaaggaaggcgatcaatatgtgtacatggggcagcctctcaataacgacgaggatcatgcccactggacagaggcgaaaatgctgcttgacaatatcaacacccccgaaggaattatccctgctctgttcgagccggaacgcgagaagtctgccgccatcgatggcgaatatagactcagaggggaagctcgcaagacatttgtcgagctgatgagacggggcgacctgcccgtgtggctcagctacaaagttgcctccgaaggattccagtatagcgatcgcagatggtgctttgacggcgagcggaataaccaggtgcttgaagagaatatggatgtggaaatttggaccaaggagggggagcgcaagaaactgcgccctcggtggctggacgcgagaacgtactctgaccccctcgccctgcgcgagttcaaagagtttgctgccggacggagatccgtcagcggcgatcttatcctggaaattgggaaactccctcaacatctgacactgcgggctcagaacgccctcgacaatcttgttatgctgcacaactccgagcagggaggcaaggcttatcgccacgccatggaggaactgcccgataccatcgagaccctcatgctgcttgcgctgattgccgtgctcacaggcggggtgaccctgttctttctgtctggaaagggcctcgggaagacaagcatcggacttctgtgtgtcacggcttcctctgccctgctctggatggctagcgtggaaccgcattggatcgccgcctccattatcctggagttctttcttatggttctgctcattcctgaacccgacagacagcggacccctcaagataatcagctggcttacgtggtcatcggcctcctgttcatgattcttacagtggcggccaacgagatggggctgctggagaccaccaaaaaggacctcggaatcggctacgtcgctgccgaaaaccaccagcatgccaccatgctggatgtggaccttcaccccgctagcgcctggacgctgtatgcggttgccaccacagtgatcacccctatgatgcgccacacaattgagaataccacggctaacatctctctcacagccattgctaatcaagccgcgatcctgatgggcctggataaagggtggcccatttccaagatggacatcggagtcccgctccttgccctgggctgctacagccaggtgaaccctctgaccctcacagctgccgttctgatgcttgtggctcattatgccattatcgggcccggactgcaggctaaagccaccagagaagcgcagaagcggaccgccgctggcatcatgaagaatcccacagtcgatgggattgtggccatcgacctcgatcctgtggtttacgacgctaaatttgagaagcaactgggacagattatgctgctcatcctttgtacgtctcagattctgctgatgcgcaccacatgggccctctgcgaatccatcaccctggccacaggcccgcttaccacgctgtgggagggcagccccgggaaattctggaacacaaccatcgcggtctctatggctaatattttcagaggaagctatctcgccggcgctgggctggccttttccctgatgaagtctctcggaggcgggcggcgcggaaccggcgcccagggcgagacacttggggaaaaatggaagagacaactgaaccagctgagcaagtccgagttcaatacctacaaacggagcggaatcatggaagtggacagatccgaggctaaggaaggcctcaaacgcggggagacaacgaagcacgccgtgtctcggggaaccgcgaaactgagatggtttgtcgagcgcaaccttgttaagcctgaaggcaaggtgattgatctggggtgtggacggggcggctggagctattactgcgccgggctcaaaaaggtgacagaggtcaaaggatacaccaagggcgggcccggacatgaggaacctatccccatggctacatatggctggaatctggtgaaactgcactccgggaaggacgttttctttatgcctccggaaaaatgtgataccctcctttgcgacattggagagtctagccccaaccctacgatcgaggaaggcagaaccctgcgcgtgctgaagatggtcgagccctggctccggggcaatcagttctgtatcaagattctgaacccttacatgccctccgtggttgaaacacttgagcagatgcaaagaaaacatgggggaatgctggtgcgcaatccgctctctcggaacagcacccacgagatgtattgggtctcctgcggcacagggaatatcgtgagcgccgtgaacatgacctctagaatgctgctgaaccgctttacaatggctcaccggaagcctacctacgaaagagatgtcgacctcggagccggcacgcgccatgttgcggtggagcccgaagtggccaatctggatattatcgggcagagaattgagaacatcaaaaatgaacacaagtccacatggcattatgacgaggataacccctacaaaacctgggcttatcacggaagctacgaggtcaagccttctggctccgccagctctatggtgaatggcgttgtgcggcttctgaccaagccctgggacgtcattcctatggtgacacagatcgctatgacggataccacaccgttcgggcaacagcgcgtttttaaagaaaaggtggacaccagaacaccccgggccaaaagaggaaccacacagatcatggaggtcaccgctaagtggctctggggcttcctgtcccggaacaaaaagcctcgcatttgtacgagagaagagtttacccggaaggtgcgcagcaatgccgcgatcggggccgttttcgtggacgaaaaccagtggaactccgctaaagaggccgtcgaggatgaaagattttgggaccttgtgcaccgggagcgcgaactgcataagcaaggaaaatgcgctacatgcgtctacaacatgatgggcaagagagagaaaaagctcggggagttcggcaaggccaaaggaagccgggccatttggtatatgtggctgggcgcgcgcttcctggagtttgaggctctcgggttcatgaatgaagatcactggttttctagagagaacagcctgtccggagtggaaggcgaggggcttcataagctgggatacatcctccgggacatttctaaaatccccggcgggaatatgtatgccgatgacaccgccggctgggatacacgcatcaccgaggacgatctgcagaacgaagctaagattacggacatcatggagcctgaacacgcccttctggctacaagcattttcaaactcacctaccagaataaggttgtgagagtccagcggcccgccaaaaacggaacagtgatggatgtgatctcccgcagagaccaacggggctctgggcaggttggaacctatggcctgaacacgtttaccaatatggaggtgcagctgattagacagatggaaagcgaggggatcttcctcccgtccgagctggaaacacctaaccttgcggagcgcgccctggattggctcgaaaagcatggagctgagcggctgaagagaatggccatctctggcgacgactgtgtcgtgaaacccattgatgaccgctttgctaccgcccttacagcgctgaatgatatggggaaggttcggaaagacatccctcaatgggaacccagcaagggctggaacgattggcaacaggtgcctttctgctcccaccactttcatcagctcattatgaaagacggaagagagatcgtcgtgccctgtcgcaatcaagatgagctggtcggccgggccagagtgagccagggggctggatggtctctgcgcgaaaccgcctgcctcggcaagtcctacgctcagatgtggcaactgatgtatttccaccggagagaccttcgcctggccgctaacgccatttgtagcgcggttccggtggattgggtccctacatctcggaccacgtggtccatccatgcccaccaccagtggatgacaaccgaggacatgctcagcgtgtggaatagagtttggatcgaagagaacccctggatggaagataagacccatgtgtcctcttgggaggaggtcccctacctggggaaacgggaagaccagtggtgcggaagccttattggcctgacagctagagccacctgggccacaaatatccaggtggctattaaccaagtgcgccggctcatcgggaatgagaactacctggactatatgacgtccatgaagagatttaaaaatgaaagcgatcctgagggcgccctgtggtga

SEQ ID NO: 18815 - RNA, 9879 nt, synthetic construct
  misc_feature 1..9879: note = derived and/or modified CDS sequence (opt5) from DENV-1__GQ868601__SS-prME
  source 1..9879: mol_type = other RNA
agcgtgaccatgctgctcatgctgcttcccacagccctggctttccacctcacgaccagaggcggggagcctcatatgatcgtctccaagcaggaacggggaaaatctctgctttttaagacaagcgttggcgtgaacatgtgcaccctgattgccatggacctcggggagctgtgtgaagatacaatgacctacaaatgcccgcgcatcacagaggcggaacccgacgatgtggactgttggtgcaatgctaccgatacgtgggtcacctatggaacatgttcccaaaccggcgagcacagacgggacaagcgctctgtggccctggcccctcatgttgggctcggactggagacaagaaccgaaacgtggatgagctccgagggcgcttggaaacagattcagaaggtggaaacatgggcccttcggcaccccggcttcaccgtcatcgctctgtttctcgcccatgcgattgggacatctatcacccagaagggaatcattttcatcctgcttatgctggtgacccctagcatggccatgcgctgcgttggcattgggaacagagattttgtggagggactctccggcgctacatgggtcgacgtggtgctggagcacgggagctgtgtcacgaccatggccaaaaataagcccacactggatatcgaactcctgaaaaccgaggttacaaaccctgctgtgcttcggaagctgtgcattgaagccaaaatctctaataccacgacagactcccgctgtccgacccaaggagaggcgaccctcgtggaagagcaggatgccaacttcgtctgcagacggacatttgtggaccgcggctggggcaatgggtgtggactgttcggcaaggggagccttctgacctgcgctaagtttaaatgcgttacaagactcgagggaaagattgtgcagtacgaaaacctgaaatattctgtcatcgtgacggttcacaccggcgatcagcatcaagtggggaatgagacaaccgaacacggaacaatcgccaccattacgccccaggctcctacctccgagatccagctgacagactacggcgccctcaccctggactgtagcccccggacaggccttgatttcaacgaaatggtcctgctcaccatgaaggagaaatcttggctggtgcataagcagtggtttcttgacctgcctctcccctggacgtccggggccagcacatcccaagagacctggaatcgccaggatctgctggtcacattcaaaaccgctcacgcgaagaagcaggaagtggttgtgctcggatctcaagagggcgccatgcacaccgctctgacaggggccacggaaattcagaccagcggaacaaccacaatctttgccggccatcttaaatgcagactgaagatggacaaactcaccctgaaggggatgtcctatgtcatgtgtacgggcagcttcaaactggagaaggaagtggctgagacacagcacggaaccgttcttgtgcaggtcaagtacgagggcaccgatgccccgtgcaaaattcctttcctcacacaagacgaaaagggggtgacccagaacggacggctgatcacagcgaatcccatcgtgacggataaagagaagcctgttaacattgaaaccgagcccccctttggcgagtcttatatcgtcgtgggggctggagaaaaagccctgaagctctcctggttcaagaaaggcagctctattgggaagatgtttgaggccacagctagaggcgcccgccggatggctatcctgggagacaccgcctgggatttcggcagcattgggggactttttacatccgtgggcaaactgatccatcaggtcttcgggaccgcgtacggagtgctcttttctggcgttagctggacgatgaagatcgggattggcatcctgctgacctggcttggactcaattccagaagcacatctctgtccatgacctgtattgccgtgggcatggtcacactgtacctcggggtgatggttcaggctgacagcggatgcgtgatcaactggaaaggccgcgaactgaagtgtgggtctggaattttcgtcaccaacgaggtgcacacatggaccgaacaatataagtttcaggccgattcccctaaacggcttagcgctgccatcggcaaggcgtgggaggagggggtttgcggcattagatccgccacgcgcctggaaaatatcatgtggaaacagatctctaacgagctcaattacattctgctggaaaacgacatgaagttcacagtggtcgtgggagacgctaatggcatccttgcccaggggaaaaagatgattcggccgcaacccatggagcataaatatagctggaagtcctggggaaaggctaaaatcattggcgccgatatccagaacaccacctttatcattgacgggcctgatacacccgaatgtcctgacgatcagagagcctggaatatctgggaggtggaggactacggattcggcatttttaccacgaacatctggctcaagctgcgcgattcttatacacagatgtgcgaccaccggctgatgagcgctgcgattaaagattccaaggccgtccacgctgacatgggctactggatcgaaagcgagaaaaatgaaacctggaagctcgccagagcctctttcatcgaggttaagacatgtatttggcccaaatcccataccctgtggagcaacggggtgcttgaatctgagatgatcattccgaagatctatggaggccctatttcccaacacaattaccgccccgggtacttcacacagaccgctggaccttggcatctgggcaaactcgagctggattttgacctgtgcgaagggacgaccgtggtcgtggatgagcactgcggatatcggggccccagccttagaacaaccacagttaccggcaagatcatccacgaatggtgttgccggtcttgtacgctccctcccctgcgcttcagaggggaggacggatgctggtacggcatggagattcggccggtgaaagaaaaggaggaaaacctggtcagaagcatggtgtccgccgggagcggagaggttgactctttttccctcggcatcctgtgtgtgagcattcttatcgaagaggtcatgcgctcccggtggtctagacgcatgctgatgacagggaccctcgcggtgttcctgctgcttattatgggacagctgacatggaatgatctcatcagactgtgcattatggttggcgctaacgccagcgaccggatgggcatggggaccacctatctcgccctgatggctacatttaagatgcgccctatgttcgccgtgggacttctgtttagacggctcacgtcccgcgaggtcctgctgcttaccatcggcctgtctctcgtggcgagcgtggaactgcccaattccctcgaggaactgggggatggacttgctatgggcatcatgatgctgaaactcctgacagacttccaaccccatcagctgtggaccacacttctgtctctcacctttattagaacgacactgagcctcgattacgcctggaagaccatggccatggctctgtccatcgtcagccttttccctctgtgtctgtctaccacatcccagaaaaccacatggctcccggttctgcttgggagctttggatgcaagcccctgacgatgttcctcattaccgagaacaaaatctggggccggaagtcttggcctattaacgaaggcatcatggccgtggggatcgtgtccattctgctcagctctctgcttaagaatgacgtccccctggctggacctctgatcgccggcgggatgctcattgcgtgttatgtgatctccggaagctccgccgatctgagccttgagaaagctgccgaggtttcttgggaagaggaagctgagcacagcggcacatcccataacattctggtggaagtccaggacgatgggaccatgaagatcaaagacgaggagcgcgatgacacactcaccatcctgctcaaggccacgctgcttgccgtgtctggagtttaccccatgagcattcctgctaccctgtttgtgtggtatttctggcaaaaaaagaaacagagatccggcgtcctgtgggatacaccctctccgcctgaagtggagcgggcggtcctcgacgacggcatctaccgcattctgcagagagggcttctgggacggagccaggtgggcgttggggtgttccaagatggagtctttcacaccatgtggcatgtgacaagaggcgccgttctcatgtaccaggggaagcgcctggaaccctcctgggcttctgtgaagaaagacctcatcagctatggaggcggctggcggttccaggggtcctggaataccggagaggaggtccaggtgattgccgtggaacctggcaagaaccccaaaaatgttcaaacaacgccggggacctttaagacacctgagggagaagtcggcgccatcgctctggatttcaaacccgggaccagcggatctcctattgtgaacagagagggcaagatcgtgggcctttacgggaatggagtcgtgaccacatccggcacgtatgttagcgccatcgcgcaggctaaggcctctcaggaagggcccctgcccgagattgaggacgaagtgtttaaaaagcgcaacctgaccatcatggatctccaccctggatccggcaaaacacggagatacctgccggccattgtccgcgaggctatcaagcggaaacttagaaccctgattctcgcccccacacgcgtggttgcgagcgaaatggctgaggccctgaaggggatgcctatccggtatcaaaccacggccgtgaagtccgaacacacaggcagagagatcgtcgacctgatgtgccatgctaccttcaccatgcggctcctttctcccgtgcgcgttcctaattacaacatgattatcatggatgaggcccactttacagaccccgctagcattgccgcgagaggatatatctccacccgggtgggcatgggggaagccgctgccattttcatgacagctacccctccgggaagcgtcgaggcctttccccagtctaatgccgtgatccaggatgaagagcgcgacatccctgaaagatcctggaacagcggctacgattggattacggacttccccgggaaaacagtgtggtttgtcccttctatcaagagcggaaatgacattgctaactgtctgcggaaaaatggcaagagagttatccagctgtcccgcaaaaccttcgatacagagtaccaaaagaccaagaacaacgactgggattatgtggtgacgaccgacatttctgagatgggggcgaatttccgggccgatagagtcatcgacccccgccggtgcctcaaaccggtgattctgaaggatggccctgaaagagttatccttgctggacccatgcccgtgacagtcgccagcgccgctcagcgccggggcagaatcgggcgcaaccagaataaagagggagaccagtacatttatatgggccaacctctgaacaatgatgaagaccatgcccactggaccgaggcgaagatgctcctggataacatcaatacacccgaggggattatccctgctctgtttgaaccggagagagaaaaatccgccgccattgacggagagtaccggctccgcggcgaagctagaaagaccttcgtggagcttatgcggcgcggggatctgcccgtttggctgtcttataaggtggccagcgagggctttcagtactccgacagacggtggtgcttcgacggagaaagaaacaatcaggtcctcgaggaaaacatggatgtggagatctggacaaaagaaggcgagcgcaagaaactgcggcctagatggcttgacgcgcgcacctatagcgatcccctggccctccgggagtttaaggaattcgctgccgggagacggtctgtctccggagacctgatcctggagattggcaaactccctcagcatcttacgctgcgcgctcaaaatgccctggataacctcgtgatgctgcacaatagcgaacaggggggaaaggcttacagacacgccatggaggaacttcccgacacaatcgagaccctgatgctcctggcgctgattgccgttctcaccggcggcgtgacactttttttcctgtccgggaaaggactgggcaagacctctatcgggctcctgtgtgtgatggctagctccgcccttctgtggatggcttctgtcgagccgcattggattgccgccagcatcatcctcgaatttttcctgatggttctgctcattcctgagcccgatcggcagcgcacacctcaggacaaccaacttgcttacgtggtgatcggactgctgtttatgattctcacggtcgcggccaatgaaatgggcctgcttgagaccacaaagaaagatctggggatcggacacgtggctgccgagaaccatcaccacgccaccatgctcgacgttgatctgagacccgcttccgcctggacactgtatgcggtggccaccacggtcattacccctatgatgcggcatacaatcgaaaacaccacagctaatattagcctcaccgccatcgctaaccaggccgcgatccttatgggcctggacaagggctggcccatttctaaaatggatatcggggtgccgctgctcgccctgggatgctactcccaggtcaatcctcttacgctgacagctgccgtgctcatgctggttgctcactatgccattatcggccccgggctgcaagctaaggccacccgcgaggcgcagaaaagaacagccgctggaattatgaagaaccccaccgtggacggcatcgtcaccatcgacctcgatcctgtggtttacgacgccaagttcgaaaaacagcttgggcagattatgctgctgatcctctgtacaagccaaattctgcttatgcggacgacctgggctctgtgcgagtctatcacactcgccaccggaccgctgacaaccctgtgggaaggctcccccggcaagttttggaatacgacaattgccgtgagcatggcgaacatcttccgcgggtcttatctcgctggagccggccttgctttcagcctgatgaaatccctggggggaggcagacgggggaccggagcccagggcgagaccctcggcgagaagtggaaaagacagctgaatcagctttctaagagcgaatttaacacatacaagcgctccgggatcatggaggtcgatcggagcgaagccaaagagggactgaagagaggcgaaaccacaaaacatgctgtgtcccgcgggacggccaagctccggtggttcgtggagagaaatctggttaaacctgagggaaaggtcattgacctgggctgtgggcgcggaggctggtcttattactgcgcgggcctcaagaaagtgaccgaagtgaaggggtacacaaaaggaggccccgggcacgaggaacctatccccatggccacctatggatggaaccttgtcaagctgcatagcggcaaagatgtttttttcacacctccggagaagtgtgacaccctgctctgcgatattggggaatcctctcccaatcctacgatcgaggagggacggaccctgagagtgcttaaaatggtggaaccctggctgcgcggcaaccaattttgtattaagatcctcaatccttacatgcccagcgtcgtggagacactggaacagatgcagcggaagcacggcgggatgctggttagaaacccgctctcccgcaattctacccacgagatgtattgggtgagctgcggaacaggcaacattgtctccgctgtgaatatgaccagccggatgctgcttaacagattcacaatggcccatcgcaaacctacctacgagagagacgttgatctgggggctggaacgcggcacgtggccgtcgaacccgaggtggcgaacctcgacatcatcggccagcgcattgaaaatatcaagaacgagcataaatctacatggcactatgatgaagacaatccctacaagacctgggcctatcacgggtcctacgaggtgaaacctagcggatctgcttccagcatggtcaacggcgttgtgagactgcttaccaagccctgggacgtgattcctatggtcacacaaatcgccatgacggataccacaccgtttggccagcagcgggtgttcaaggagaaagttgacaccagaacaccccgggctaagcgcgggaccgcccaaattatggaagtgacagctaaatggctgtggggatttctctctagaaataagaaacctcggatctgtacccgcgaggaattcacgagaaaggtccggtccaacgccgcgatcggcgccgtgtttgttgatgagaatcagtggaacagcgctaaggaagccgtggaggacgagcgcttctgggatctggtccatagagaacgggagctgcacaaacaggggaagtgcgctacctgcgtgtacaatatgatgggaaaacgcgaaaagaaactcggcgagtttgggaaggccaagggctccagagccatttggtatatgtggctgggagcgcggttccttgaattcgaggctctgggctttatgaacgaggaccattggttcagccgcgaaaattctctcagcggggttgagggagaaggcctgcacaaacttgggtacatcctgagagatatttccaagatccccggaggcaacatgtatgccgacgatacagccgggtgggacacccggattacagaggatgacctccagaatgaggctaaaatcaccgatatcatggaacctgagcatgccctgctggctacgtctatttttaagctcacataccaaaacaaagtggtccgcgtgcagagacccgccaagagcggcaccgtcatggacgtgatctcccggagagaccagcgcggatctggccaggttgggacatatggactgaataccttcacgaacatggaagtgcaacttattcggcagatggagagcgaaggcatcttttccccgtctgagctggagacccctaacctcgcgaaaagagtcctggattggcttgaaaagcagggggccgagcgcctgaagcggatggctattagcggagacgattgtgtggtgaaacccatcgacgatagattcgccacagctctcaccgccctgaatgacatgggcaaggttcgcaaagatatccctcagtgggaaccctccaaggggtggaacgactggcaacaggtgcctttttgcagccaccacttccatcagctgattatgaaagatggccgggagatcgtcgtgccctgtagaaatcaggacgaactcgttggacgcgcgcgggtgtctcaaggcgccgggtggtccctgagagagacagcttgccttggaaagagctacgcccagatgtggcagctgatgtattttcaccgccgggatctcagactggctgccaacgctatttgttctgccgtcccggtggactgggtccctacctcccggacaacctggagcatccatgcgcaccaccaatggatgacgacagaggacatgctttccgtgtggaatagagtttggattgaagagaacccctggatggaagataagacccatgtgtctagctgggaggaagtcccctacctgggcaaacgcgaggaccagtggtgcgggtccctcatcggactgaccgcccgggctacatgggccaccaatattcaggtggccatcaaccaggttagacgcctgatcggcaatgagaactacctcgattatatgacaagcatgaagagattcaaaaatgaatctgaccctgagggggctctgtggtga

SEQ ID NO: 18816 - RNA, 9879 nt, synthetic construct
  misc_feature 1..9879: note = derived and/or modified CDS sequence (opt5) from DENV-1__EU660390__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagcccccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttattgtgggagatgtcgctggcatcctggggcagggacggaaaatgattagaccgcaacccatggagtacaagtattcttggaaaagctggggcaaggccaagatcatcggggccgacgctcagaataccaccttcattatcgatggacctaacacacccgaatgtcctgacgatcagcgcgcgtggaatatttgggaggtggaggactacggctttggcatcttcaccacgaacatttggctgaaacttcgggattcctatacacaggtgtgcgaccacagactcatgagcgccgctatcaaggattctaaagccgtccacgccgacatggggtactggatcgaatccgagaagaatgaaacctggaaactggctcgcgccagctttattgaggttaagacatgtatctggcccaagtctcataccctgtggtccaacggagtgctcgaaagcgagatgattatcccgaaaatttatggcgggcctatctctcaacacaattaccggcccggatacttcacacagaccgcgggcccttggcatctggggaagcttgagctggatttcgacctctgcgaaggaacgaccgtggtcgtggatgagcactgcggcaacagaggccccagcctgcggacaaccacagttaccgggaaaatcattcacgaatggtgttgccgctcctgtacgctgcctccccttagatttcggggagaggacggctgctggtatgggatggagatcagaccggtgaaggaaaaagaggaaaatctcgtcaagagcatggtgtctgctggatccggcgaggttgacagcttctccctggggctgctctgtatttctatcatgattgaagaggtgatgcgcagccggtggtccagaaagatgctgatgacaggaacccttgccgtctttttcctgctcatcatgggccagctgacatggaacgatctgattcgcctttgcatcatggtgggcgccaatgcttctgacagaatggggatgggaaccacctacctggccctcatggcgacatttaaaatgcggcctatgttcgctgttggcctgctctttcgcagactgacgagccgggaggtgcttctgctcaccatcgggctgtccctggtcgcctctgtggaacttcccaacagcctggaggaactcggagatggcctggccatggggattatgatcctcaagctgcttacagacttccaatcccatcagctgtgggctaccctcctgagcctgacatttattaaaaccacgttctctcttcactatgcctggaagacaatggctatggtgctgtccatcgtcagcctctttcccctgtgtctctctaccacctcccagaaaacaacctggctgcctgttcttctgggaagcctgggctgcaagccgctcacaatgttcctgattgccgagaataagatctggggccgcaaatcttggccccttaacgaagggatcatggcggtgggaattgtgtccatcctgctcagctccctgctcaagaacgatgtccctctggccggcccccttgtggctgggggaatgctgattgcctgttacgttatcagcggctctagcgctgacctgtccctcgagaaagccgccgaggtgtcttgggaagaggaagctgagcatagcggggcgtcccacaatattctggtcgaagtgcaggatgacggaacgatgaagatcaaagatgaggagagagacgatacccttacaatcctgctcaaggccaccctgctcgctgtttctggcgtgtatcctctgagcattcccgccacactttttgtctggtacttctggcaaaaaaagaagcagcggtccggcgtgctgtgggacaccccttctcccccggaagtcgagcgcgccgtgctggatgacgggatctatagaattatgcagcggggactcctgggccgcagccaggttggggtgggagtcttccaagaaaacgtgtttcatacgatgtggcacgttaccagaggcgctgtgcttatgtaccaggggaaacggctggagccttcctgggccagcgtcaagaaagacctcatctcttacggaggcggctggagactgcgcgggtcctggaatacaggagaggaagtgcaggtgattgcggttgagcccggcaagaaccctaaaaatgtccagaccgctcccgggacattcaagaccccggaaggagaggtgggcgccatcgccctcgattttaagcctgggacaagcggatctcccattgtgaaccgggaaggcaaaatcgtcggcctgtatgggaatggagtggttacgacctccggcacatacgtgagcgctatcgcccaagcgaaggcttcccaggaggggcctcttcccgagattgaagacgaggtcttcagaaaacgcaacctgaccatcatggatctgcaccccggatctggcaagacccggagatatctccctgccattgtgcgcgaagccatcaaacggaagctgagaacacttattctggctccgacgcgcgttgtggccagcgagatggctgaagccctcaaggggatgcccatccggtaccagaccacagcggtcaaatccgagcataccggcaaggagatcgtggacctgatgtgccacgccacatttaccatgagactgctcagccctgttcgggtgcccaattataacatgattatcatggatgaagctcatttcacggacccttcttccattgccgctcgcggatacatcagcacaagagtcggcatgggggaggccgccgctatttttatgaccgcgaccccccctggatctgtggaagccttcccgcaaagcaatgctgtgatccaggatgaggaacgggacatccccgagcgctcctggaactctggctatgagtggattacagattttcctgggaaaaccgtctggttcgttcccagcatcaagtccggaaatgacattgccaactgtcttagaaaaaatggcaagcgggtgatccagctgtctagaaagacatttgataccgaataccagaaaacgaagaacaacgactgggactacgtggtcacaaccgatattagcgagatgggggccaatttccgcgctgaccgggtgatcgatcctagacgctgcctgaaacccgttattctcaaggacggcccggaacgggtgatcctggccggacctatgcccgtcacagtggcgtccgctgcccaaagacgcggccggatcgggagaaaccacaataaagagggagatcagtatatttacatgggccagccccttaacaatgacgaggatcatgcccactggaccgaagctaagatgctgctcgacaacatcaatacgcctgaggggattatccccgccctgttcgaacctgagcgcgaaaagagcgcggccgttgatggagagtatagactgcggggcgaggctcgcaaaacctttgtggaactcatgagacggggggaccttccggtctggctgtcttacaaggtggcctccgagggcttccagtatagcgatcgcagatggtgctttgacggagaacggaacaatcaagtcctggaggaaaacatggatgtggagatttggacaaaagagggcgaaagaaagaaactccgcccccggtggctggacgctagaacctactccgaccctcttgccctgcgcgagttcaaggaatttgctgccgggcggagatctgttagcggagatctcatcctggagatcggcaaactgccccagcacctcacacagcgggcgcagaatgcccttgacaacctggtgatgctgcataattccgaacaagggggacgcgcttatagacacgccatggaggagctccctgataccattgaaacactgatgcttctggctctcatcgccgtgctgaccggcggcgtcacgctgttctttctctctgggcggggacttggcaagacaagcattgggctgctgtgtgttatggcctccagcgtgctcctgtggatggcttctgtggagccccattggatcgcggcctccattatccttgaattctttctgatggtcctcctgatcccggagcctgaccgccagagaaccccccaggataaccagctggcttacgtggttattggactccttttcatgatcctgaccgtggccgccaatgagatgggcctgctcgaaacaaccaagaaagacctggggattggacacgtcgctgtggagaaccaccatcacgccgcgatgcttgatgtcgacctgcatcctgccagcgcttggacactctacgccgtggctacgaccatcattacacccatgatgcggcacaccatcgaaaacacaaccgccaatatttctctgacggcgatcgccaaccaagctgccatcctgatgggcctcgataagggctggcctatttccaaaatggacatcggggttccccttctggctctgggatgctatagccaggtgaatccgctcaccctgacagccgctgtccttatgctggtggcccattacgcgattatcggccctgggctccaggccaaggctacccgcgaggcccaaaaaagaacagctgccggaattatgaagaaccccaccgttgatggcatcgtggccatcgacctggatcccgtcgtgtatgacgcgaagtttgaaaaacagctggggcagattatgctccttatcctgtgtacgtctcagattctgctcatgcggacaacctgggctctgtgcgagagcatcacacttgccaccggacctctgaccacactctgggagggctccccgggcaagttctggaatacgaccattgctgtgtctatggccaacatctttcgcgggagctacctggccggagctggcctggccttctccctcatgaaaagccttgggggaggcagacgggggacaggagcgcaaggcgaaaccctgggcgagaagtggaaaagacagctgaatcagctctccaagtctgaattcaacacatataagcgcagcgggatcatggaggttgaccggtccgaagccaaagagggactgaagagaggcgagaccacgaaacacgctgtctctcgcgggacagccaagcttcggtggtttgtggaaagaaatctggtgaaacccgagggaaaggtcattgatctcggctgtgggcgcggaggctggagctactattgcgctggcctgaagaaagttaccgaagtgaaggggtacaccaaaggaggccctgggcacgaggaacccatccctatggccacatacggatggaacctggtgaagctccattccggcaaagacgtcttctttattccccctgagaagtgtgatacccttctgtgcgacatcggggagtctagcccgaatcccacaattgaagagggacggacgctgagagtgctcaaaatggttgaaccttggctgcgcggcaaccagttctgtatcaagattcttaatccctatatgccttccgtggtcgagaccctggagcaaatgcagcggaagcacggcgggatgctcgtgagaaaccccctgagccgcaattctacacatgaaatgtactgggtttcctgcggaaccggcaacatcgtgagcgcggtcaatatgacatctcggatgctgctcaacagatttaccatggcccaccgcaaaccgacgtatgagagagatgtggacctggggaccggaacacggcacgtggctgtcgaacctgaggttgccaaccttgatatcattggccagcgcatcgaaaatattaagcatgagcacaaatccacctggcattacgacgaggataacccctataagacatgggcttaccacgggagctatgaagtgaaaccctctggatccgccagctccatggtgaatggcgtcgtgaagctgctcaccaagccttgggacgttatccccatggtgacacagattgctatgaccgatacgacacctttcggccaacagagagtctttaaagagaaggtggacacccggaccccgaaagccaagagagggacagcgcagatcatggaagttacggcccggtggctgtggggattccttagccgcaacaaaaagcccagaatctgtacccgggaggaatttacacgcaaggtgagatctaatgctgccattggcgctgtcttcgtggacgagaaccaatggaatagcgccaaagaggccgttgaagatgagcggttttgggacctggtgcatcgcgaaagagagctccacaagcaggggaaatgcgcgacctgcgtctacaacatgatgggaaagcgggaaaaaaagctgggcgagttcgggaaggctaaaggctcccgcgccatctggtacatgtggctgggagccagatttctcgagttcgaagctctgggcttcatgaatgaggatcactggttttctcgggaaaacagcctttccggggtggagggagagggcctgcataagctcgggtatattctgcgcgacatctctaaaattcctggaggcaatatgtacgccgatgacacagctgggtgggataccagaatcacagaagacgatcttcagaacgaggccaagatcaccgacattatggaacccgagcacgcgctgctcgccaaagctatcttcaagctgacgtatcagaataaagtcgtgcgggttcaacgccctgccaagaacggcaccgtgatggatgtcattagcagacgggaccagagaggatccggccaggtggggacatacggactgaatacctttacaaacatggaagctcagctcatccgccaaatggagtctgagggcattttcagcccctccgaactggagaccccgaaccttgccgaacgggcgctggattggctcgagaagtatggggtggaaagactgaaacgcatggccatcagcggagacgactgtgttgtgaagcctatcgatgaccggtttgctacggcccttacagctctgaatgatatgggcaaagtcagaaaggacattccccagtgggagccttctaaagggtggaacgattggcagcaggtgcccttctgctcccatcactttcaccaactcatcatgaaggacggccgcgagattgttgtgccttgtcggaatcaggatgaactggtcggaagagcccgcgtgagccagggcgctgggtggtctctgcgggagaccgcctgcctcggaaagtcctacgcgcagatgtggcaactgatgtatttccatagacgcgaccttcggctggccgctaacgccatctgtagcgccgtccccgtggattgggttccgacatccagaaccacgtggtctattcacgctcatcaccagtggatgaccacagaagacatgctcagcgtgtggaatcgggtctggatcgaggaaaacccttggatggaggataaaacccatatttccagctgggaggacgtgccctacctgggcaagagagaagaccagtggtgcgggtctcttatcggactgacagcccgcgcgacctgggctacaaatatccaagttgccattaaccaggtgcggagactcatcggcaatgagaactacctggattatatgacctccatgaaacgctttaagaatgaaagcgaccccgagggggccctgtggtga

SEQ ID NO: 18817 - RNA, 9879 nt, synthetic construct
  misc_feature 1..9879: note = derived and/or modified CDS sequence (opt5) from DENV-1__EU660391__SS-prME
  source 1..9879: mol_type = other RNA
agcgtgacaatgctgctgatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggacaatgaaaatcaaggatgaggagcgggacgatacgctcaccatcctgcttaaggccacactgctcgctgtgagcggagtctatcctctgtccattcccgccaccctcttcgtgtggtacttttggcagaaaaagaaacaacgctctggcgtcctgtgggacacaccttcccctcccgaagtggagagagccgttcttgatgacggcatctatcggattatgcagcgcgggctgctgggaagatcccaggtgggcgtcggggtgttccaggaaaacgtttttcataccatgtggcacgtgacgcggggagctgtcctcatgtaccaaggcaagcgcctggagcccagctgggcctctgtgaaaaaggaccttatctcctacgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacctccgggagccctattgtcaaccgggaaggaaagatcgtgggcctgtatggcaatggggttgtgacaacgtccggaacctacgtctctgctatcgcccaagcgaaagctagccaggacggccccctccctgagattgaggatgaagtgttcagaaagcgcaacctgacaatcatggaccttcaccccgggtccggaaagacccggagatatctgcccgccattgttcgcgaggccatcaaacggaagctgagaaccctcattctggctcctacacgcgtggtcgccagcgaaatggctgaggcccttaaaggcatgccgatccggtaccagacgaccgcggtgaagtctgaacatacagggaaagagatcgttgatctgatgtgccacgccacctttacaatgagactcctgtcccccgtgcgcgtccctaattataacatgattatcatggacgaggctcatttcaccgatcccagctctattgccgctcggggctacatcagcacgagagtgggaatgggcgaagccgccgctatttttatgacagcgacccctcccgggtccgtggaggccttccctcaatctaatgctgtcatccaggacgaagaacgggatatcccggaacgcagctggaactccggatatgagtggattaccgactttcccggcaagacagtttggttcgtgccttctatcaagagcgggaatgatattgccaactgtctgcgcaagaatggaaagcgggtgatccagctctcccgcaaaaccttcgacacagagtaccagaagaccaaaaacaacgactgggattacgtcgtgacgacagacattagcgaaatgggcgccaattttagagctgatcgggttatcgaccccagacgctgccttaagcctgtgattctgaaggatgggcccgagcgggtcatcctggccggcccgatgcctgtgaccgttgcgtctgctgcccaaagacgcggacggatcggcagaaaccacaataaagaaggggaccagtatatttacatgggacagcccctcaacaatgatgaggaccatgcccactggacagaggctaagatgctgcttgataacatcaatacccccgaaggcattatccctgccctgttcgagcccgaacgcgagaaatccgcggccattgacggggaatatcggctcagaggagaggctcgcaagacgtttgtggagctgatgagacggggcgatctgcctgtctggctcagctacaaagtggcctccgaagggttccagtattctgaccgcagatggtgctttgatggcgagcggaacaatcaagtccttgaagagaacatggacgtggaaatctggaccaaggagggagagcgcaaaaagctgagaccgcggtggctggacgctagaacatacagcgatcccctcgccctgcgcgagttcaaggagtttgctgccggccggagatccgtttctggggaccttatcctggaaattggaaaactccctcagcacctgacccagcgcgcgcagaatgccctggataacctcgtgatgcttcataatagcgagcaaggcgggcgggcttatagacacgccatggaggaactgcccgacacaatcgagaccctgatgctcctggctcttattgccgtgctgacaggaggcgtcaccctcttctttctgtccggccgggggctgggaaagacgagcatcggcctcctttgtgttatggcctcttccgtgctgctgtggatggctagcgtggaacctcattggattgcggcctctatcatcctcgagttctttctgatggtccttctgattcccgaaccggatcgccagagaacacctcaggacaaccagctcgcttacgtggttatcgggctgctgttcatgattctcaccgtggccgccaatgagatgggacttctggagaccaccaagaaggatctgggcatcgggcacgtcgctgtggaaaaccaccatcacgccgcgatgctcgacgtcgatctgcatcccgcctccgcttggaccctttacgccgtggctacaacgattatcacccctatgatgcggcacacaattgagaacaccacagccaatatcagcctgaccgcgatcgccaaccaagctgccattctcatgggactggacaaaggctggcccatctctaagatggatattggcgttcctctgctcgctcttgggtgctatagccaggtgaatcccctgacgctgaccgccgctgtcctcatgctggtggcccattacgcgatcattggaccgggccttcaggccaaggctacacgcgaagcccagaagagaaccgctgccgggatcatgaagaaccctacagttgacggaatcgtggccattgatctggaccccgtcgtgtatgacgcgaaatttgagaagcagctcggccagatcatgctgctgattctctgtacctcccagatccttctgatgcggacgacatgggctctgtgcgaatctattaccctcgccacagggcccctgaccaccctttgggagggaagccctggcaaattctggaatacaacgatcgctgtgtccatggccaacatcttccgcggcagctacctggccggggctggactcgccttttccctgatgaagtctctgggcgggggaagacggggcaccggggcgcaaggagagacactcggcgaaaagtggaaacgccagcttaatcagctgagcaagtccgagttcaacacctataaaagatctggcattatggaagttgatcggagcgaggccaaggaagggctgaaaagaggagagacaaccaagcacgctgtctcccgcggcacggccaagctccggtggtttgtggagagaaatctggtgaaaccggaagggaaggtcatcgaccttggatgtggccgcgggggatggtcttactattgcgctggcctgaaaaaggttacagaggtgaaaggctacaccaaagggggacccggccacgaggaacctattcccatggccacctacgggtggaacctcgtgaaactgcatagcggaaaggatgtcttctttatccctcccgaaaagtgtgacacactgctctgcgatattggcgagtccagccctaatccgaccatcgaggaagggcggacacttagagtgctgaaaatggttgagccctggctgcgcggaaaccagttctgtattaagatcctcaatccttatatgccctctgtggtcgaaacgctggagcaaatgcagcggaaacacggcggcatgcttgtgagaaaccctctgtcccgcaatagcacccatgagatgtactgggtttcttgcgggacaggaaacatcgtgtccgcggtcaatatgaccagccggatgctcctgaacagatttacaatggcccaccgcaagcccacctatgaacgggacgtggatctgggcgctgggacgagacacgtggccgtcgagccggaagttgctaacctcgacattatcggacagcgcattgagaatatcaaatacgaacataagtctacctggcactatgatgaggacaacccttacaagacatgggcctatcatggctcctacgaggtgaaacccagcgggtccgctagctctatggtgaatggagtcgtgaagctgcttaccaaaccctgggatgttattcctatggtgacacagatcgccatgaccgacacaacccccttcggccaacagagagtctttaaggaaaaagtggacacgcggacacctaaggcgaagcgcggcaccgcccagatcatggaggttaccgctaaatggctgtgggggttcctcagcagaaacaagaaaccgcggatttgtacaagagaagagtttacgcggaaggtgcgctccaatgccgctatcggagccgtcttcgtggatgaaaaccaatggaactctgccaaagaggcggttgaggacgaaagattttgggatctggtgcaccgggagcgcgaacttcataagcagggcaagtgcgctacctgcgtctacaacatgatggggaaaagagagaagaaactgggagagttcggcaaggccaaagggagccgggccatttggtatatgtggctcggcgctcgcttcctggagtttgaggccctgggattcatgaatgaagaccactggttttccagagagaactctctcagcggcgtggaaggggagggactgcacaaacttggctacatcctgcgggatatttccaaaatccccgggggaaatatgtatgctgacgatacagccggctgggacacccgcatcacagaggatgacctccagaacgaagcgaagattaccgatatcatggagcctgaacatgccctgcttgctaagtctattttcaaactgacataccagaataaggtcgtgagagttcaacggcccgccaaaaacgggaccgtgatggacgtcatcagccgcagagatcagcggggctccggacaggtgggcacgtatgggctcaatacctttacaaacatggaggctcagctgattcgccaaatggaaagcgagggaatcttctctccttccgagctggaaacccccaacctcgccggcagagtgctggactggcttgagaagcacggggttgaacggctgaaaagaatggcgatcagcggagacgattgtgtggtcaagccgattgacgatcgctttgccacagctctcaccgccctgaatgacatgggcaaggtgcggaaagatatccctcagtgggagccctctaaggggtggaacgactggcagcaggttcctttctgctcccatcactttcaccaacttattatgaaagatggcagagaaatcgtggtcccctgtcgcaatcaggacgagctggtgggacgggctagagtcagccagggcgccgggtggtccctccgcgagacggcttgcctgggaaagtcttacgcccagatgtggcaactgatgtatttccatcggagagatctccgcctggcggccaacgctatttgtagcgccgtgcctgttgactgggtgcccacatcccggaccacatggagcatccacgcccatcaccagtggatgaccacggaagatatgctttctgtctggaatagagtgtggattgaggaaaacccgtggatggaggacaaaacccatatctccagctgggaagacgttccttacctgggcaagcgcgaggatcagtggtgcgggtctctcatcggactgacagctcgggccacctgggcgacaaatattcaagtggctatcaaccaggtcagacggcttattggcaatgagaactacctggactatatgaccagcatgaagagatttaaaaatgaatccgatcccgagggggccctctggtga

SEQ ID NO: 18818 - RNA, 9879 nt, synthetic construct
  misc_feature 1..9879: note = derived and/or modified CDS sequence (opt5) from DENV-1__EU660393__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttatcgcgatggacctgggggaactctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaaggggatcacgcagagcggacggctgattaccgcgaaccccatcgtgacagacaaagagaagcctgtcaatattgaagctgagccgccctttggcgagtcttatatcattatcggggccggagaaaaagcccttaagctcagctggttcaagaaaggctcctctatcgggaagatgtttgaggctaccgccagaggcgctcgccggatggccattctgggagatacagcgtgggacttcggcagcatcgggggagtgtttacctccgtgggcaaactggttcatcagattttcgggacggcctacggagtcctctttagcggcgtgtcttggaccatgaagatcgggattggcgtgctgcttacatggctgggactcaactccagaagcacctctctgtccatgacatgtatcgctgtcggcctggtgaccctttacctcggggttatggtgcaggccgatagcggatgcgtcattaattggaaaggccgcgaactgaagtgtgggtccggaatcttcgtgacaaacgaggttcacacctggacggaacaatataagtttcaggctgactctcctaaacggctgagcgccgcgatcggcaaggcctgggaggagggggtgtgcggcattagatccgctacacgcctcgaaaatatcatgtggaaacagatttctaacgagctgaaccatatccttctggaaaatgacatgaagttcaccgtcgtggttggagatgtggccggcattctcgctcaggggaaaaagatgatccggccgcaacccatggagtacaaatatagctggaagtcctggggaaaggccaaaatcattggcgccgacgtccagaacaccacatttatcattgatgggcctaatacccccgaatgtcctgacgatcagagagcttggaacatctgggaggtggaggactacggattcggcatttttacgacaaatatctggctgaagctgcgcgatagctatacccaggtgtgcgaccaccggcttatgtctgcggccatcaaagattccaaggctgtccacgccgacatgggctactggattgaaagcgagaaaaacgaaacatggaagctcgccagagcttctttcatcgaggttaagacctgtatttggcccaaatcccatacactgtggagcaatggggtgctggaatctgagatgatcattccgaagatctatggaggccctatcagccaacacaactaccgccccgggtacttcacccagacggccggaccttggcatctcggcaaactggagcttgattttgacctgtgcgaagggaccacagtggtcgtggatgagcactgcggaaatcggggcccctccctcagaaccacaaccgttacgggcaagattatccacgaatggtgttgccggagctgtacactgcctcccctgcgcttcagaggggaggacggatgctggtatggcatggagattcggccggtgaaagaaaaggaggaaaaccttgtcaagtctatggtgtccgcggggagcggagaggttgactccttttctctcggcctgctgtgtatcagcattatgatcgaagaggtgatgagatcccgctggtctcggaaaatgctcatgaccgggacactggctgtcttctttcttctgattatgggacagctcacctggaatgatctgatcagactgtgcatcatggtgggcgccaacgccagcgaccgcatgggcatggggaccacataccttgctctgatggccacgttcaagatgagacctatgtttgcggttggactcctgttccggcgcctcacctccagagaggtgctgcttctgacaattggcctctctctggtcgctagcgtggaactgcccaattcccttgaggaactgggggatggactcgccatgggcatcatgattctgaaactcctgaccgactttcaaagccatcagctttgggccacactgctctctctgaccttcatcaagacgacattttccctgcactatgcttggaaaaccatggccatggtgcttagcattgtctctctgttccccctctgtctgtccaccacaagccagaagaccacatggctccctgttctgcttgggtctctgggatgcaagccgctgacgatgtttctcatcgctgagaacaaaatctggggccggcgctcctggcccctgaatgaaggcattatggccgtggggatcgtgagcattcttctgtccagcctcctgaagaacgatgtccctctcgcgggacccctgatcgccggcgggatgcttattgcttgttacgtgatctctggaagctccgccgacctgtctctggagaaagctgccgaggttagctgggaagaggaagccgagcattccggcgcttctcacaacatcctcgtggaagtccaggatgacgggaccatgaagattaaagatgaggagagagacgatacactgaccatccttctgaaggcgacactcctggccgtgagcggagtttatcctctctccattcccgctaccctgttcgtgtggtacttctggcagaagaagaagcagcggtctggcgtcctttgggacacgcctagccctcccgaagtggagcgcgccgtcctggatgacggcatctatagaattatgcagcgggggctgctcggacgctcccaggtgggcgttggggtgtttcaagaaaatgtcttccataccatgtggcacgtgacaagaggagccgttctgatgtaccagggcaaacggcttgagcccagctgggcttctgtgaagaaagacctgatctcctacgggggaggctggagactccagggcagctggaacaccggggaggaagtccaggtgattgccgtggagcccggaaagaatcctaaaaacgttcaaacagcgcccggcacctttaagacaccggaaggggaggtcggagctatcgccctggatttcaagcctggcacgtctgggtcccccatcgtgaatcgcgaaggaaaaattgtgggcctctatggcaacggggtcgtgaccacaagcggaacctacgtttccgccatcgctcaggccaaggcgtctcaggagggccctctgcccgagattgaagacgaggtgtttcggaaaagaaatcttaccatcatggatctgcaccccgggagcggaaagacacgccggtatctgcctgctattgtcagagaagccatcaaacgcaagctccggacgctgatccttgccccgaccagagtggttgcttccgagatggccgaagctctgaagggcatgcccattcgctaccaaacaaccgccgtgaaaagcgagcatacagggaaggagatcgtcgacctcatgtgccacgcgaccttcacgatgcggctgctgtctcctgtgagagttcccaactataatatgattatcatggatgaagcccattttacagacccttccagcattgctgcccggggctacatctctacccgcgtgggaatgggcgaggctgccgccatcttcatgaccgctacaccccctgggagcgtcgaagcgtttccgcagtccaacgccgtgattcaggatgaggaaagagacatccccgagcggtcttggaatagcggatatgagtggattaccgatttccctggcaaaacagtgtggtttgtcccctccatcaagtctgggaacgacattgctaattgtctccgcaaaaacggaaagagagttatccagcttagccggaagaccttcgatacggaataccagaaaaccaagaataacgactgggactacgtggtgaccacagatatttccgagatgggcgccaacttcagagccgaccgcgtcatcgatcctcggagatgcctgaaacccgtgatcctgaaggacgggccggaacgcgttattctcgctggccctatgcccgtgaccgtcgccagcgcggctcagcggagaggacgcatcggccggaatcacaacaaagagggggatcagtatatttacatgggacagcccctgaataacgacgaggatcatgcccactggacggaagccaagatgcttctggacaatatcaacacccctgagggcattatccccgctctctttgaacctgagagagaaaagtctgccgcgatcgatggggagtatcgcctgagaggagaggcccggaaaacattcgtggaactgatgcgcagaggcgacctcccggtttggctttcctacaaggtggctagcgaggggtttcaatattccgatcggcgctggtgcttcgacggcgaaagaaataaccaggtcctggaggaaaatatggatgtggagatttggaccaaagagggagaacggaagaaactgagaccccgctggctcgacgcccggacatactctgaccctctggctcttagagagtttaaggagttcgccgctggccgccggagcgtctccggggatctgatcctcgagattggaaaactgccccagcacctgacccagagagcccaaaacgcgctcgacaatcttgtgatgctgcataactctgaacagggcgggcgggcctatcgccacgctatggaggagctgcctgatacaatcgaaaccctcatgctgcttgccctgattgctgttctcacgggaggcgtgacactgtttttcctgagcggcagagggctcggaaagacctccatcggccttctgtgtgtgatggccagctctgtcctgctctggatggcctccgttgagccccattggatcgctgcgagcattatcctggaatttttccttatggtgctgctcattccggagcctgaccggcagcgcacaccccaggataatcaactggcctacgtggtcatcgggctgctctttatgattcttacagtggctgccaacgagatgggactgctggaaaccacaaagaaagacctcggcatcgggcacgttgccgtggagaatcaccatcacgctgccatgctggatgtcgaccttcatcctgcgtctgcctggacgctgtacgctgtggccaccacaattatcacccccatgatgagacacacaatcgaaaacaccacggctaacatttccctcaccgccatcgcgaatcaggccgctattctgatgggactggataagggctggcctatcagcaaaatggacattggcgtccccctccttgccctggggtgctattctcaggtgaacccgctgacactcaccgctgccgttctgatgcttgtggctcattacgccatcatcggacctggcctgcaagcgaaggccacacgggaggctcagaaacgcaccgccgctgggattatgaagaatcccacggtcgatggaatcgtggccattgacctcgatcccgttgtgtatgacgccaagttcgaaaaacagctgggccagatcatgctgctcattctttgtacaagccaaatcctgctgatgagaaccacatgggcgctctgcgagtccatcaccctggctaccgggcctcttacaacgctgtgggagggatctccgggcaagttttggaacaccacaattgccgtcagcatggctaatatcttccggggctcctacctcgccggggccggactggctttcagcctgatgaaatccctcggcgggggacgcagaggcaccggggcccagggagaaacacttggcgagaagtggaaacggcagctgaaccagctgtctaagagcgaatttaatacctatagacgctccggcattatggaggtggaccggtctgaagcgaaggaggggctcaaaagaggagagacgacaaagcacgccgtgagccgcggcaccgctaaactgcggtggttcgttgaaagaaaccttgtcaagcccgaggggaaagtgatcgatctgggatgtggccgcgggggatggtcctactattgcgccggcctcaagaaggtgaccgaagtcaaaggctacacaaaagggggacctggccacgaggaacccattcctatggctacctacgggtggaatctggttaaactgcattctggaaaggacgtgtttttcattccccctgagaaatgtgatacactcctttgcgacattggcgagagctccccgaaccccacgatcgaagaggggcggaccctgagagtgctgaagatggtcgaaccttggctccgcggaaatcaattttgtatcaaaattctgaacccctatatgcctagcgtggttgagacacttgagcagatgcagcggaagcacggcggcatgctggtgagaaatcccctctctcgcaactccacccatgaaatgtactgggtcagctgcgggacaggaaatatcgtgtctgccgttaacatgacctcccggatgctgctgaatagattcacgatggcgcaccgcaagccgacctatgagagagatgtggacctcggcgccgggacacggcacgtcgctgtggaacctgaggtggccaacctggatattatcggacagcgcattgaaaacatcaaacatgagcacaagagcacctggcattacgacgaggataatccctataaaacatgggcttaccacggctcttatgaagtcaagccctccgggagcgcctccagcatggttaacggagtggtgaaacttctgaccaagccttgggacgtcatccccatggtgacacaaattgctatgaccgatacgacaccttttggccagcagagagttttcaaggagaaagtggacacccggaccccgaaggccaaaagaggcacagcgcaaatcatggaagtcacggccaagtggctctgggggtttctgtctcggaataaaaagccccgcatttgtaccagagaggagttcacacggaaggtgcgcagcaacgctgccatcggagctgtttttgtggacgagaatcagtggaactccgccaaagaggccgtcgaagatgagagattctgggaccttgtgcatcgggaacgcgagctgcacaagcagggcaaatgcgcgacctgcgtttacaatatgatggggaagagagagaaaaagctcggagagtttggcaaggctaaagggtctcgggccatttggtacatgtggctgggcgcccgcttcctggagttcgaagctctcggatttatgaacgaggatcactggttcagcagagaaaattccctgtctggcgtggagggggagggacttcataagctgggctatatcctccgggacatcagcaaaattcctgggggaaacatgtacgccgatgacacagctggctgggatacccgcatcacagaagacgatctgcagaatgaggccagaattaccgacatcatggaacccgagcacgcgcttctggccaagtccatttttaaactcacgtatcaaaacaaggtcgtgcgggtccagcgccctgctaaaaatgggaccgtgatggatgttatctctagacgggaccagagaggcagcggacaggtgggcacatacgggctgaacaccttcacaaatatggaagcccaactgatccgccagatggagtccgagggaatttttagcccctctgaactcgagaccccgaacctggctgaacgggtccttgattggctggagaagtatggcgtggaaagactcaagcgcatggccatctccggggacgactgtgtggttaaacctattgatgaccggttcgcgacggccctgacagctcttaacgatatgggaaaggtgagaaaagacatcccccagtgggagcctagcaagggctggaatgattggcagcaagtccccttttgctctcatcacttccaccagctgattatgaaagacgggcgcgagatcgtggttccttgtcggaaccaggatgaactcgtgggcagagcccgcgtctcccagggagctggctggagcctgcgggagaccgcctgcctggggaagtcctacgctcaaatgtggcagctcatgtattttcatagacgcgacctgcggcttgccgcgaatgccatttgttctgctgtgcccgtcgattggatcccgacaagcagaaccacgtggtccatccacgcccatcaccagtggatgaccacagaagacatgctgagcgtgtggaaccgggtttggattgaggaaaatccttggatggaggataagacccatatctcttcctggggagacgtgccctacctcggcaaaagagaggaccaatggtgcgggagcctgattggacttacagcccgcgctacctgggccacaaacatccaggtcgcgattaatcaggtgcggagactgatcggcaacgaaaattacctcgattatatgacctctatgaagcgcttcaaaaacgagagcgaccccgaaggggctctgtggtga

SEQ ID NO: 18819 - RNA, 9879 nt, synthetic construct
  misc_feature 1..9879: note = derived and/or modified CDS sequence (opt5) from DENV-1__EU660401__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgaggtcgccaacctggatatcattggacagcggatcgaaaatattaagcacgagcataaatccacctggcactatgacgaggataacccctacaagacatgggcttatcatggcagctacgaagttaaaccctctgggtccgccagctccatggtgaatggagtggtcaaacttctgaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctctgggggtttctgagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggaccttgttcacagagaacgggagctgcacaaacagggcaagtgcgcgacctgcgtgtataacatgatggggaaacgcgaaaagaagctcggagagtttggcaaagctaaggggtccagagccatctggtacatgtggctgggcgcccggttcctggagttcgaagctctcggatttatgaatgaggatcattggttctctcgcgaaaacagcctgtccggcgtcgagggggagggacttcacaaactgggctacattctcagagacatctctaagatccctgggggaaatatgtatgccgatgacacagctggctgggatacccggattacagaagacgatctgcagaacgaggcccgcatcaccgacattatggaacccgagcatgcgcttctggccaaaagcatctttaagctcacgtaccaaaataaagtggtcagagtgcagcggcctgctaagaacgggaccgttatggatgtgatttcccgcagagaccagcggggctctggacaggtcggcacatatgggctgaataccttcacaaacatggaagcccaactgatcagacagatggagagcgagggaatcttttcccccagcgaactcgagaccccgaacctggctgaacgcgtgcttgattggctggagaagtacggcgtggaacggctcaaaagaatggccatttctggggacgactgtgttgtgaagcctatcgatgaccgcttcgcgacggccctgacagctcttaatgatatgggaaaagtccggaaggacattccccagtgggagccttccaaaggctggaacgattggcagcaagtgcccttttgcagccaccacttccatcagctgatcatgaaggacgggagagagattgttgtgccttgtcgcaatcaggatgaactcgtcggccgggccagagtgtctcagggagctggctggtccctgcgcgagaccgcctgcctgggaaagagctatgctcaaatgtggcagctcatgtactttcaccggagagacctgcgccttgccgcgaacgccatctgttccgctgtccccgtggattggattccgacatctcggaccacgtggagcatccatgcccaccatcagtggatgaccacagaagacatgctgtccgtttggaatagagtgtggatcgaggaaaacccttggatggaggataaaacccacattagctcttggggagacgtcccctatctcggcaagcgggaggaccaatggtgcgggtccctgatcggacttacagccagagctacctgggccacaaatattcaggtggcgatcaaccaggttcgccggctgattggcaatgaaaactacctcgattacatgaccagcatgaaaagattcaagaatgagggggaccccgaaggcgctctgtggtga

SEQ ID NO: 18820 - RNA, 9879 nt, synthetic construct
  misc_feature 1..9879: note = derived and/or modified CDS sequence (opt5) from DENV-1__FJ373305__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagctatacccaggtctgcgaccaccggctcatgtccgcggccatcaaagatagcaaggctgttcacgccgacatgggctactggatcgaatctgagaaaaatgaaacatggaagctggccagagcttccttcattgaggtgaagacctgtatctggcccaaaagccatacactgtggtctaacggggtgctcgaatccgagatgattatcccgaagatttatggaggccctatcagccaacacaattaccgccccgggtacttcacccagacggccggaccttggcatctgggcaaacttgagctggattttgacctctgcgaagggaccacagtcgtggttgatgagcactgcggaaaccggggcccctctctgagaaccacaaccgtgacgggcaagatcattcacgaatggtgttgccggagctgtacactgcctccccttcgcttcagaggggaggacggatgctggtatggcatggagatccggccggtcaaagaaaaggaggaaaatctcgtgaagtccatggttagcgcggggtctggagaggtggactcctttagcctgggcctgctctgtatttccatcattatcgaagaggtcatgagatctcgctggagccggaaaatgctgatgaccgggacacttgctgtgttctttctgctcattatgggacagctgacctggaacgatctgatcagactttgcatcatggttggcgccaatgcctccgaccgcatgggcatggggaccacatacctggctctcatggccacgttcaagatgagacctatgtttgcggtgggactcctgttccggcgcctgacctctagagaggtccttctgctcacaattggcctgagcctggtggcttccgtggaacttcccaactctctggaggaactcggggatggactggccatgggcatcatgattctcaaactgcttaccgactttcaaagccatcagctgtgggccacactcctgtccctgaccttcatcaagacgacagtcagccttcactatgcttggaaaaccatggccatggttctgtctattgtgtccctctttcccctgtgtctcagcaccacatctcagaagaccacatggctgcctgtgcttctggggtccctgggatgcaagccgctcacgatgttcctgatcgctgagaataaaatctggggccggcgcagctggccccttaacgaaggcattatggccgtcgggatcgtgtctattctgctctccagcctgctcaagaacgatgttcctctggcgggaccccttatcgccggcgggatgctgattgcttgttacgtgatctccggaagctctgccgacctgagcctcgagaaagctgccgaggtctcctgggaagaggaagccgagcattctggcgctagccacaatatcctggtggaagttcaggatgacgggaccatgaagattaaagatgaggagagagacgatacacttaccatcctgctcaaggcgacactgctcgccgtgtccggagtctatcctctgtctattcccgctaccctttttgtgtggtacttctggcagaagaagaagcagcggagcggcgtcctgtgggacacgcctagccctcccgaagtggagcgcgccgttctggatgacggcatctatagaattatgcagcgggggctcctgggacgctctcaggtgggcgtcggggtgttccaagaaaacgtttttcataccatgtggcacgtgacaagaggagccgtccttatgtaccagggcaaacggctggagcccagctgggcttccgtgaagaaagacctcatcagctacgggggaggctggagactgcagggctcttggaataccggggaggaagtgcaggttattgccgtcgagcccggaaagaaccctaaaaatgtgcaaacagcgcccggcaccttcaagacaccggaaggggaggtgggagctatcgccctcgattttaagcctggcacgtccgggagccccatcgtcaaccgcgaaggaaaaattgtgggcctgtatggcaatggggttgtgaccacatctggaacctacgtctccgccatcgctcaggccaaggcgagccaggagggccctcttcccgagattgaagacgaggtgttccggaaaagaaacctgaccatcatggatctgcaccccgggtccggaaagacacgccggtatctccctgctattgttagagaagccatcaaacgcaagctgcggacgcttatcctggccccgaccagagtggtcgcttctgagatggccgaagctctcaagggcatgcccattcgctaccaaacaaccgccgtgaaaagcgagcatacagggaaggagatcgttgacctgatgtgccacgcgacctttacgatgcggctgctctcccctgtgagagtccccaattataacatgattatcatggatgaagcccatttcacagaccctagctctattgctgcccggggctacatctccacccgcgtgggaatgggcgaggctgccgccatctttatgaccgctacaccccctgggagcgtggaagcgttcccgcagtctaatgccgtcattcaggatgaggaaagagacatccccgagcggagctggaactccggatatgagtggattaccgattttcctggcaaaacagtttggttcgtgccctctatcaagagcgggaatgacattgctaactgtcttcgcaaaaatggaaagagagtgatccagctgtcccggaagacctttgatacggaataccagaagaccaagaacaacgactgggactacgtcgtgaccacagatatttctgagatgggcgccaatttcagagccgaccgcgttatcgatcctcggagatgcctgaaacccgtgatcctcaaggacgggccggaacgcgtcattctggctggccctatgcccgtgaccgttgccagcgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgttcgaacctgagagagaaaagtccgccgcgatcgatggggagtatcgcctgagaggagaggcccggaaaacatttgtggaactcatgcgcagaggcgaccttccggtctggctgagctacaaggtggcttctgaggggttccaatattccgatcggcgctggtgctttgacggcgaaagaaacaatcaggtcctggaggaaaacatggatgtggagatttggaccaaagagggagaacggaagaaactcagaccccgctggctggacgcccggacatacagcgaccctcttgctctgagagagttcaaggaatttgccgctggccgccggtccgtttctggggatctcatcctggagattggaaaactgccccagcacctcacccagagagcccaaaatgcgcttgacaacctggtgatgctgcataatagcgaacagggcgggcgggcctatcgccacgctatggaggagctccctgatacaatcgaaaccctgatgcttctggccctcattgctgtgctgacgggaggcgtcacactgttctttctctccggcagagggcttggaaagacctctatcggcctgctgtgtgttatggccagctccgtgctcctgtggatggccagcgtggagccccattggatcgctgcgtctattatccttgagttctttctgatggtcctcctgattccggagcctgaccggcagcgcacaccccaggataaccaactggcctacgtggttatcgggctccttttcatgattctgacagtggctgccaatgagatgggactgctcgaaaccacaaagaaagacctgggcatcgggcacgtcgccgtggagaaccaccatcacgctgccatgcttgatgtcgacctgcatcctgcgtccgcctggacgctctacgctgtggccaccacaattatcacccccatgatgagacacacaatcgaaaacaccacggctaatattagcctgaccgccatcgcgaaccaggccgctattctgatgggactcgataagggctggcctatctctaaaatggacattggcgttccccttctggccctggggtgctattcccaggtgaatccgctcacactgaccgctgccgtccttatgctggtggctcattacgccatcatcggacctggcctccaagcgaaggccacacgggaggctcagaaacgcaccgccgctgggattatgaagaaccccacggttgatggaatcgtggccattgacctggatcccgtcgtgtatgacgccaagtttgaaaaacagctgggccagatcatgctccttattctgtgtacaagccaaatcctgctcatgagaaccacatgggcgctgtgcgagtctatcacccttgctaccgggcctctgacaacgctctgggagggaagcccgggcaagttctggaataccacaattgccgtgtccatggctaacatctttcggggctcttacctggccggggccggactggctttcagcctcatgaaatcccttggcgggggacgcagaggcaccggggcccagggagaaacactgggcgagaagtggaaacggcagctgaatcagctcagcaagtccgagttcaacacctataagagatctggcattatggaggttgaccgcagcgaagcgaaagaggggctgaagcggggagagacgacaaaacacgccgtctccagaggcaccgctaaacttcgctggtttgtggaacggaatctggtgaaacccgaggggaaggtcatcgatctcggatgtggcagagggggatggtcttactattgcgccggcctgaagaaagttaccgaagtgaagggctacacaaaagggggacctggccacgaggaacccattcctatggctacctacgggtggaacctggtgaagctccatagcggaaaagacgtcttctttattccccctgagaagtgtgatacacttctgtgcgacatcggcgagtcctctccgaatcccacgatcgaagaggggcgcaccctgcgggtgctcaaaatggttgaaccttggctgagaggaaaccaattctgtatcaagattcttaatccctatatgcctagcgtggtcgagacactggagcagatgcagcgcaagcacggcggcatgctcgtgcggaaccccctgtccagaaatagcacccatgaaatgtactgggtttcttgcgggacaggaaacatcgtgtccgccgtcaatatgaccagccgcatgctgctcaaccggtttacgatggcgcacagaaaaccgacctatgagcgcgatgtggacctgggcgccgggacaagacacgtggctgtcgaacctgaggttgccaaccttgatattatcggacagcggattgaaaatatcaagcatgagcacaaatctacctggcattacgacgaggataacccctataagacatgggcttaccacggctcctatgaagtgaaacccagcgggtctgcctccagcatggtgaatggagtcgtgaagctgctcaccaagccttgggacgttatccccatggtgacacaaattgctatgaccgatacgacacctttcggccagcagcgcgtctttaaagagaaggtggacaccagaaccccgaaagccaagcggggcacagcgcaaatcatggaagttacggccaaatggctgtgggggttcctttccagaaacaagaagccccggatttgtacccgcgaggaatttacaagaaaagtgcggagcaatgctgccatcggagctgtcttcgtggacgagaaccagtggaactctgccaaggaggccgttgaagatgagcgcttttgggacctggtgcatagagaacgggagctccacaaacagggcaagtgcgcgacctgcgtctacaacatgatggggaaacgcgaaaagaagctgggagagttcggcaaagctaaggggagcagagccatttggtacatgtggctgggcgcccggtttctcgagttcgaagctctgggattcatgaatgaggatcactggttttcccgcgaaaactctcttagcggcgtggagggggagggactgcataaactcggctatatcctgagagacatctccaagattcctgggggaaatatgtacgccgatgacacagctggctgggatacccggatcacagaagacgatcttcagaacgaggcccgcattaccgacatcatggaacccgagcacgcgctgctcgccaaatctattttcaagctgacgtatcaaaataaagtcgtgagagttcagcggcctgctaagaacgggaccgtgatggatgtcatcagccgcagagaccagcggggctccggacaggtgggcacatacgggctgaatacctttacaaacatggaagcccaactcatcagacagatggagtctgagggaattttcagcccctccgaactggagaccccgaaccttgctgaacgcgtgctggattggctcgagaagtatggcgttgaacggctgaaaagaatggccatcagcggggacgactgtgtggtcaagcctattgatgaccgctttgcgacggcccttacagctctgaatgatatgggaaaagtgcggaaggacatcccccagtgggagccttctaaaggctggaacgattggcagcaagttcccttctgctcccatcactttcaccagctcattatgaaggacgggagagagatcgtggtcccttgtcgcaatcaggatgaactggtgggccgggccagagtcagccagggagctggctggtctctgcgcgagaccgcctgcctcgggaagtcctacgctcaaatgtggcagctgatgtatttccatcggagagaccttcgcctggccgcgaacgccatttgtagcgctgtgcccgttgattggatcccgacatcccggaccacgtggtctatccacgcccatcaccagtggatgaccacagaagacatgctcagcgtgtggaatagagtctggattgaggaaaacccttggatggaggataaaacccatatctccagctggggagacgtgccctacctgggcaagcgggaggaccaatggtgcgggtctcttattggactgacagccagagctacctgggccacaaatatccaggttgcgattaaccaggtgcgccggctcatcggcaatgaaaactacctggattatatgacctccatgaaaagatttaagaatgagggggaccccgaaggcgctctgtggtga

SEQ ID NO: 18821 - RNA, 9879 nt, synthetic construct
  misc_feature 1..9879: note = derived and/or modified CDS sequence (opt5) from DENV-1__EU660402__SS-prME
  source 1..9879: mol_type = other RNA
tccgtgaccatgctgctgatgctgatgcccacagcccttgctttccacctgacgaccagaggaggggaacctcatatgattgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcatcgacgcgccgtgcaaaatcccttttagcacccaagatgaaaagggggtgacacagaacggacggctgattaccgctaatcccatcgtcacagacaaagagaagcctgtgaacattgaagccgagccgcccttcggcgagtcttatatcgtgattggggccggagaaaaagctctgaaacttagctggtttaagaaaggctcctctatcgggaagatgttcgaggccacggctagaggcgcccgccggatggcgatcctcggagataccgcctgggactttggcagcattgggggagttttcacatccgtcggcaaactggtgcatcagatctttgggaccgcttacggagtgctgttcagcggcgtctcttggacaatgaagattgggatcggcgtgctcctgacctggcttggactcaattccagaagcacgtctctctccatgacctgtattgccgttggcctggtgacactgtaccttggggtcatggtgcaggctgatagcggatgcgttatcaactggaaaggccgcgaactcaagtgtgggtccggaatttttgtgaccaatgaggtccacacatggaccgaacaatataagttccaggccgactctcctaaacggctgagcgcggccatcggcaaggcttgggaggagggggtgtgcggcatcagatccgccacacgcctggaaaacattatgtggaaacagatctctaacgagctcaatcatattctgcttgaaaacgacatgaagctgaccgttgtggtcggagatgtggctggcatcctcgcccaggggaaaaagatgattcggccgcaacccatggagtacaaatatagctggaagatctggggaaaggccaaaatcattggcgctgacgtgcagaatacgacatttatcattgatgggcctaacacccccgaatgtcctgacgatcagagagcgtggaatatctgggaggtcgaggactacggattcggcatttttaccacaaacatctggctgaagctgcgcgattcctatacccaggtttgcgaccaccggcttatgagcgccgctatcaaagattctaaggccgtgcacgccgacatgggctactggattgaatccgagaaaaatgaaacgtggaagctcgctagagccagcttcatcgaggtgaagacatgtatttggcccaaatctcataccctgtggtccaacggggtcctggaaagcgagatgatcattccgaagatctatggaggccctatctctcaacacaattaccgccccgggtacttcacacagaccgcgggaccttggcatctcggcaaactggagcttgattttgacctgtgcgaagggacaaccgtggttgtggatgagcactgcggaaaccggggccccagcctcagaacgaccacagtcaccggcaagattatccacgaatggtgttgccggtcctgtacactgcctcccctgcgcttcaaaggggaggacggatgctggtatggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgcaagatgctcatgaccgggacgctggccgttttctttcttctgattatgggacagctcacatggaacgatctgatccggctgtgcatcatggtgggcgccaatgcttacgacagaatgggcatggggaccacatatcttgccctgatggcgaccttcaaaatgcgccctatgtttgctgtcggactcctgttcagacggctcacctctcgcgaggtgctgcttctgacaattggcctcagcctggtggcctccgtcgaactgcccaactctcttgaggaactgggggatggactcgccatgggcatcatgattctgaagctcctgacggactttcaaagccatcagctttgggctaccctgctctccctgacattcatcagaaccacatttagcctgcactacgcctggaaaaccatggctatggttctttctattgtgtccctgttccccctctgtctgagcacgacatctcagaagaccacctggctccctgtgctgcttgggtccctgggatgcaagccgctgacaatgtttctcatcgccgagaataaaatctggggccggaaatcctggcccctgaacgaaggcattatggcggtcgggatcgtgtctattcttctgtccagcctcctgaaaaacgatgttcctctcgccggacccctgatcgctggcgggatgcttattgcctgttatgtgatctccggaagctctgctgacctgagcctggagaaggccgccgaggtctcctgggaagaggaagctgagcattctggcgcgagccacaatatcctcgtggaagttcaggatgacgggaccatgaaaattaaggatgaggagcgcgacgatacactgacgatccttctgaaagccaccctcctggctgtgtccggagtctaccctctctctattcccgccacactgttcgtgtggtatttctggcaaaagaagaaacagagaagcggcgtcctttgggacacccctagccctcccgaagtggagcgggccgttctggatgacggcatctaccgcattatgcagagagggctgctcggacggtctcaggtgggcgtcggggtgtttcaagaaaacgttttccatacaatgtggcacgtgacccgcggagctgtcctgatgtaccagggcaagagacttgagcccagctgggcctccgtgaaaaaggacctgatcagctatgggggaggctggcggctccagggctcttggaatacgggggaggaagtgcaggttattgcggtcgagcccggcaagaaccctaagaatgtgcaaaccgctcccggcacatttaagacctccgaaggggaggtgggagccatcgccctggatttcaaaccgggcacaagcgggtctcctatcgtcaacagagaaggaaagattgtgggcctctacggcaatggggttgtgaccacatccggaacgtatgtcagcgctatcgcccaggcgaaggcttcccaggagggccccctgcctgagattgaagacgaggtgtttcgcaagcggaaccttaccatcatggatctgcaccccgggtctggaaaaacaagacgctacctgcccgccattgttcgggaagccatcaagagacgcctccggaccctgatccttgctcctaccagagtggtcgccagcgagatggctgaagccctgaagggcatgccgattcgctatcaaacaacggcggtgaaatccgagcataccgggaaggagatcgttgacctcatgtgccacgccacattcaccatgcggctgctgagccccgtgagagtccctaattacaacatgattatcatggatgaagctcattttacagacccctcttccattgccgctcggggctatatcagcacccgcgtgggaatgggcgaggccgccgctatcttcatgacggcgacacctcccgggtctgtggaagcctttcctcagagcaatgctgtcattcaggatgaggaaagagacatcccggagcggtcctggaactctggatacgagtggattaccgatttccccggcaaaaccgtttggtttgtgcctagcatcaagtccgggaatgacattgccaactgtctccgcaaaaatggaaagagagtgatccagctttctcggaagacattcgataccgaataccagaagacaaagaacaacgactgggactatgtcgtgaccacggatattagcgagatgggcgccaatttcagagctgaccgcgttatcgatccccggagatgcctgaaacctgtgatcctgaaggacgggcccgaacgcgtcattctcgccggcccgatgcctgtgacagttgcgtccgctgcccagcggagaggacgcatcggccggaaccacaataaagagggggatcagtacatttatatgggacagcccctgaacaatgacgaggatcatgcccactggaccgaagctaagatgcttctggacaacatcaatacacccgagggcattatccctgccctctttgaacccgagagagaaaagagcgcggccatcgatggggagtaccgcctgagaggagaggctcggaaaaccttcgtggaactgatgcgcagaggcgacctccctgtctggctttctcacaaggtggcctccgaggggtttcaatatagcgatcggcgctggtgcttcgacggcgaaagaaacaatcaggtcctggaggaaaacatggatgtggagatttggacgaaagagggagaacggaagaaactgagaccgcgctggctcgacgctcggacctactccgaccccctggcccttagagagtttaaggagttcgctgccggccgccggtctgttagcggggatctgatcctcgagattggaaaactgcctcagcatctgacacagagagcgcaaaatgccctcgacaaccttgtgatgctgcacaattccgaacagggcgggcgggcttatcgccatgccatggaggagctgcccgataccatcgaaacactcatgctgcttgctctgattgccgtgctcaccggaggcgtcatgctgtttttcctgtctggcagagggctcggaaagacaagcatcggccttctgtgtgttatggcctccagcgtgctgctctggatggcttctgtggagcctcactggatcgcggcctccattatcctggaatttttccttatggtcctgctcattcccgagccggaccggcagcgcacccctcaggataaccaactggcttacgtggttatcgggctgctctttatgattcttacggtggccgccaatgagatgggactgctggaaacaaccaagaaagacctcggcatcgggcacgtcgctgtggagaaccatcaccatgccgcgatgctggatgtcgaccttcaccccgccagcgcttggaccctgtacgccgtggctacaaccattatcacacctatgatgagacatacgatcgaaaacaccacagccaatatttctctcaccgcgatcgccaaccaggctgccattctgatgggactggataagggctggcccatctccaaaatggacattggcgttcctctccttgctctggggtgctatagccaggtgaatcccctgacactcaccgccgctgtcctgatgcttgtggcccactacgcgatcatcggaccgggcctgcaagccaaggctacgcgggaggcccagaaacgcaccgctgccgggattatgaagaaccctacagttgatggaatcgtggccattgacctcgatcccgtcgtgtatgacgcgaagttcgaaaaacagctgggccagatcatgctgctcattctttgtacctctcaaatcctgctgatgagaacaacctgggctctctgcgagagcatcacgctggccacagggccccttaccacactgtgggagggatcccctggcaagttttggaataccaccattgctgtgtctatggccaacatcttccggggcagctacctcgccggggctggactggccttctccctgatgaaaagcctcggcgggggacgcagaggcacaggggcgcagggagaaacgcttggcgagaagtggaaacggcagctgaatcagctgtccaagtctgaatttaacacctataagagaagcggcattatggaggttgaccgctccgaagccaaagaggggctcaagcggggagagacaaccaaacacgctgtctctagaggcacagccaagctgcgctggttcgtggaacggaatcttgtgaaaccggaggggaaggtcatcgatctgggatgtggcagagggggatggagctactattgcgctggcctcaagaaagttaccgaagtgaagggctacacgaaagggggacccggccatgaggaacctattcccatggccacatacgggtggaacctggtgaagctgcactccggaaaagacgtctttttcatccctcccgagaagtgtgataccctcctttgcgacattggcgagtctagccctaatccgaccatcgaagaggggcgcacactgcgggtgctgaaaatggttgaaccctggctcagaggaaaccaattttgtatcaagattctgaatccttatatgccctccgtggtcgagacccttgagcagatgcagcgcaagcatggcggcatgctggtgcggaaccctctcagcagaaattctacacacgaaatgtactgggtttcctgcgggacgggaaacatcgtgagcgcggtcaatatgacctctcgcatgctgctgaaccggttcacaatggcccacagaaaacccacctatgagcgcgatgtggacctcggcgctgggacaagacatgtggccgtcgaaccggaggttgctaacctggatattatcggacagcggattgaaaatatcaagcacgagcataaatccacctggcactacgacgaggataacccttataagacgtgggcctaccatggcagctatgaagtgaaaccctctgggtccgctagctccatggtgaatggagtcgtgaaacttctgaccaagccctgggacgttatccctatggtgacacaaattgccatgaccgatacaaccccctttggccagcagcgcgtcttcaaagagaaggtggacacaagaacccctaaagcgaagcggggcacggcccaaatcatggaagttacagctaaatggctctgggggtttctgagcagaaacaagaagccgcggatttgtacccgcgaggagttcaccagaaaagtgcggtctaatgccgctatcggagccgtctttgtggacgagaaccagtggaatagcgccaaggaggcggttgaagatgagcgcttctgggaccttgtgcacagagaacgggagctgcacaaacagggcaagtgcgctacatgcgtctacaacatgatggggaaacgcgaaaagaagctcggagagtttggcaaagccaaggggtccagagccatttggtacatgtggctgggcgctcggttcctggagttcgaagccctcggatttatgaatgaggatcattggttctctcgcgaaaacagcctgtccggcgtggagggggagggacttcacaaactgggctatatcctcagagacatctctaagattcccgggggaaatatgtacgctgatgacacggccggctgggatacccggatcacagaagacgatctgcagaacgaggcgaaaattaccgacatcatggaacctgagcatgcccttctggctaagagcatttttaaactcacatatcaaaataaggtcgtgcgcgttcagagacccgccaagaacgggaccgtgatggatgtcatctcccggcgcgaccagagaggctctggacaggtgggcacatacgggctgaataccttcacgaacatggaagctcaactgatccggcagatggagagcgagggaatcttttcccctagcgaactcgagacccccaacctggccggcagagtgcttgattggctggaaaaacacggggttgagcgcctcaagcggatggcgatctctggagacgactgtgtggtcaaaccgattgatgacagattcgccacagctctgaccgcccttaatgatatgggcaaggtgcgcaaagacatccctcagtgggaaccctccaaggggtggaacgattggcagcaagttcctttttgcagccaccatttccaccagctgattatgaaggacggccgggagatcgtggtcccctgtagaaatcaggatgagctcgtgggacgcgctcgggtctctcagggcgccgggtggtccctgagagaaacagcttgcctgggaaaaagctatgcccaaatgtggcagctcatgtactttcatcgccgggacctgagacttgcggccaacgctatttgttccgccgtgcctgttgattgggtgcccacctctcgcacgacatggagcatccacgcccatcaccagtggatgaccacagaggacatgctgtccgtctggaatcgggtgtggatcgaagagaacccgtggatggaagataagacccacgttagctcttggggcgacgtgccttatctcgggaaaagagaggaccaatggtgcggatccctgattggccttacggctcgggccacctgggcgacaaatatccaggtcgctattaaccaggtgagacgcctgctcgggaatgagaactacctggattacatgaccagcatgaagcggttcaaaaatgaatctgaccccgagggcgccctgtggtga

SEQ ID NO: 18822 - RNA, 9879 nt, synthetic construct
  misc_feature 1..9879: note = derived and/or modified CDS sequence (opt5) from DENV-1__EU660403__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagctatacccaggtctgcgaccaccggctcatgtccgcggccatcaaagatagcaaggctgttcacgccgacatgggctactggatcgaatctgagaaaaatgaaacatggaagctggccagagcttccttcattgaggtgaagacctgtatctggcccaaaagccatacactgtggtctaacggggtgctcgaatccgagatgattatcccgaagatttatggaggccctatcagccaacacaattaccgccccgggtacttcacccagacggccggaccttggcatctgggcaaacttgagctggattttgacctctgcgaagggaccacagtcgtggttgatgagcactgcggaaaccggggcccctctctgagaaccacaaccgtgacgggcaagatcattcacgaatggtgttgccggagctgtacactgcctccccttcgcttcagaggggaggacggatgctggtatggcatggagatccggccggtcaaagaaaaggaggaaaatctcgtgaagtccatggttagcgcggggtctggagaggtggactcctttagcctgggcctgctctgtatttccatcattatcgaagaggtcatgagatctcgctggagccggaaaatgctgatgaccgggacacttgctgtgttctttctgctcattatgggacagctgacctggaacgatctgatcagactttgcatcatggttggcgccaatgcctccgaccgcatgggcatggggaccacatacctggctctcatggccacgttcaagatgagacctatgtttgcggtgggactcctgttccggcgcctgacctctagagaggtccttctgctcacaattggcctgagcctggtggcttccgtggaacttcccaactctctggaggaactcggggatggactggccatgggcatcatgattctcaaactgcttaccgactttcaaagccatcagctgtgggccacactcctgtccctgaccttcatcaagacgacatttagccttcactatgcttggaaaaccatggccatggtcctgtctattgtttccctcttccccctgtgtctcagcaccacatctcagaagaccacatggctgcctgtgcttctggggtccctgggatgcaagccgctcacgatgtttctgatcgctgagaataaaatctggggccggcgcagctggccccttaacgaaggcattatggccgtggggatcgtctctattctgctctccagcctgctcaagaacgatgtgcctctggcgggaccccttatcgccggcgggatgctgattgcttgttacgttatctccggaagctctgccgacctgagcctcgagaaagctgccgaggtgtcctgggaagaggaagccgagcattctggcgctagccacaatatcctggtcgaagtgcaggatgacgggaccatgaagattaaagatgaggagagagacgatacacttaccatcctgctcaaggcgacactgctcgccgtttccggagtgtatcctctgtctattcccgctacccttttcgtctggtacttctggcagaagaagaagcagcggagcggcgtgctgtgggacacgcctagccctcccgaagtcgagcgcgccgtgctggatgacggcatctatagaattatgcagcgggggctcctgggacgctctcaggttggcgtgggggtctttcaagaaaacgtgttccataccatgtggcacgttacaagaggagccgtgcttatgtaccagggcaaacggctggagcccagctgggcttccgtcaagaaagacctcatcagctacgggggaggctggagactgcagggctcttggaataccggggaggaagtccaggtgattgccgttgagcccggaaagaaccctaaaaatgtccaaacagcgcccggcacctttaagacaccggaaggggaggtgggagctatcgccctcgatttcaagcctggcacgtccgggagccccatcgtgaaccgcgaaggaaaaattgtcggcctgtatggcaatggggtggttaccacatctggaacctacgtgtccgccatcgctcaggccaaggcgagccaggagggccctcttcccgagattgaagacgaggtctttcggaaaagaaacctgaccatcatggatctgcaccccgggtccggaaagacacgccggtatctccctgctattgtgagagaagccatcaaacgcaagctgcggacgcttatcctggccccgaccagagttgtggcttctgagatggccgaagctctcaagggcatgcccattcgctaccaaacaaccgccgtcaaaagcgagcatacagggaaggagatcgtggacctgatgtgccacgcgaccttcacgatgcggctgctctcccctgttagagtgcccaattataacatgattatcatggatgaagcccattttacagaccctagctctattgctgcccggggctacatctccacccgcgtcggaatgggcgaggctgccgccatcttcatgaccgctacaccccctgggagcgtggaagcgtttccgcagtctaatgccgtgattcaggatgaggaaagagacatccccgagcggagctggaactccggatatgagtggattaccgatttccctggcaaaacagtctggtttgttccctctatcaagagcgggaatgacattgctaactgtcttcgcaaaaatggaaagagagtgatccagctgtcccggaagaccttcgatacggaataccagaagaccaagaacaacgactgggactacgtggtcaccacagatatttctgagatgggcgccaatttcagagccgaccgcgtgatcgatcctcggagatgcctgaaacccgttatcctcaaggacgggccggaacgcgtgattctggctggccctatgcccgtcaccgtggccagcgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagtccgccgcgatcgatggggagtatcgcctgagaggagaggcccggaaaacattcgttgaactcatgcgcagaggcgaccttccggtgtggctgagctacaaggtcgcttctgaggggtttcaatattccgatcggcgctggtgcttcgacggcgaaagaaacaatcaggtgctggaggaaaacatggatgtcgagatttggaccaaagagggagaacggaagaaactcagaccccgctggctggacgcccggacatacagcgaccctcttgctctgagagagtttaaggagttcgccgctggccgccggtccgtgtctggggatctcatcctggagattggaaaactgccccagcacctcacccagagagcccaaaatgcgcttgacaacctggttatgctgcataatagcgaacagggcgggcgggcctatcgccacgctatggaggagctccctgatacaatcgaaaccctgatgcttctggccctcattgctgtgctgacgggaggcgtgacactgtttttcctctccggcagagggcttggaaagacctctatcggcctgctgtgtgtcatggccagctccgttctcctgtggatggccagcgtggagccccattggatcgctgcgtctattatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgtccgcctggacgctctacgctgtcgccaccacaattatcacccccatgatgagacacacaatcgaaaacaccacggctaatattagcctgaccgccatcgcgaaccaggccgctattctgatgggactcgataagggctggcctatctctaaaatggacattggcgtgccccttctggccctggggtgctattcccaggttaatccgctcacactgaccgctgccgtgcttatgctggtcgctcattacgccatcatcggacctggcctccaagcgaaggccacacgggaggctcagaaacgcaccgccgctgggattatgaagaaccccacggtggatggaatcgttgccattgacctggatcccgtggtctatgacgccaagttcgaaaaacagctgggccagatcatgctccttattctgtgtacaagccaaatcctgctcatgagaaccacatgggcgctgtgcgagtctatcacccttgctaccgggcctctgacaacgctctgggagggaagcccgggcaagttttggaataccacaattgccgtgtccatggctaacatcttccggggctcttacctggccggggccggactggctttcagcctcatgaaatcccttggcgggggacgcagaggcaccggggcccagggagaaacactgggcgagaagtggaaacggcagctgaatcagctcagcaagtccgaatttaacacctataagagatctggcattatggaggtggaccgcagcgaagcgaaagaggggctgaagcggggagagacgacaaaacacgccgtttccagaggcaccgctaaacttcgctggttcgtcgaacggaatctggtgaaacccgaggggaaggtgatcgatctcggatgtggcagagggggatggtcttactattgcgccggcctgaagaaagtcaccgaagttaagggctacacaaaagggggacctggccacgaggaacccattcctatggctacctacgggtggaacctggtgaagctccatagcggaaaagacgtgtttttcattccccctgagaagtgtgatacacttctgtgcgacatcggcgagtcctctccgaatcccacgatcgaagaggggcgcaccctgcgggtcctcaaaatggtggaaccttggctgagaggaaaccaattttgtatcaagattcttaatccctatatgcctagcgttgtggagacactggagcagatgcagcgcaagcacggcggcatgctcgtccggaaccccctgtccagaaatagcacccatgaaatgtactgggtgtcttgcgggacaggaaacatcgtttccgccgtgaatatgaccagccgcatgctgctcaaccggttcacgatggcgcacagaaaaccgacctatgagcgcgatgtcgacctgggcgccgggacaagacacgtggctgtggaacctgaggtcgccaaccttgatattatcggacagcggattgaaaatatcaagcatgagcacaaatctacctggcattacgacgaggataacccctataagacatgggcttaccacggctcctatgaagttaaacccagcgggtctgcctccagcatggtgaatggagtggtcaagctgctcaccaagccttgggacgtgatccccatggttacacaaattgctatgaccgatacgacaccttttggccagcagcgcgtgttcaaagagaaggtcgacaccagaaccccgaaagccaagcggggcacagcgcaaatcatggaagtgacggccaaatggctgtgggggtttctttccagaaacaagaagccccggatttgtacccgcgaggagttcacaagaaaagttcggagcaatgctgccatcggagctgtgtttgtcgacgagaaccagtggaactctgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggagcagagccatttggtacatgtggctgggcgcccggttcctcgagttcgaagctctgggatttatgaatgaggatcactggttctcccgcgaaaactctcttagcggcgtcgagggggagggactgcataaactcggctatatcctgagagacatctccaagattcctgggggaaatatgtacgccgatgacacagctggctgggatacccggatcacagaagacgatcttcagaacgaggcccgcattaccgacatcatggaacccgagcacgcgctgctcgccaaatctatttttaagctgacgtatcaaaataaagtggtcagagtgcagcggcctgctaagaacgggaccgttatggatgtgatcagccgcagagaccagcggggctccggacaggtcggcacatacgggctgaataccttcacaaacatggaagcccaactcatcagacagatggagtctgagggaatttttagcccctccgaactggagaccccgaaccttgctgaacgcgtgctggattggctcgagaagtatggcgtggaacggctgaaaagaatggccatcagcggggacgactgtgttgtgaagcctattgatgaccgcttcgcgacggcccttacagctctgaatgatatgggaaaagtccggaaggacatcccccagtgggagccttctaaaggctggaacgattggcagcaagtgcccttttgctcccatcacttccaccagctcattatgaaggacgggagagagatcgttgtgccttgtcgcaatcaggatgaactggtcggccgggccagagtgagccagggagctggctggtctctgcgcgagaccgcctgcctcgggaagtcctacgctcaaatgtggcagctgatgtattttcatcggagagaccttcgcctggccgcgaacgccatttgtagcgctgtccccgtggattggatcccgacatcccggaccacgtggtctatccacgcccatcaccagtggatgaccacagaagacatgctcagcgtttggaatagagtgtggattgaggaaaacccttggatggaggataaaacccatatctccagctggggagacgtcccctacctgggcaagcgggaggaccaatggtgcgggtctcttattggactgacagccagagctacctgggccacaaatatccaggtggcgattaaccaggttcgccggctcatcggcaatgaaaactacctggattatatgacctccatgaaaagattcaagaatgagggggaccccgaaggcgctctgtggtga

SEQ ID NO: 18823 - RNA, 9879 nt, synthetic construct
  misc_feature 1..9879: note = derived and/or modified CDS sequence (opt5) from DENV-1__EU660397__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagccgccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattcagaggggaagacggatgctggtatggcatggagattcggccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcatcatgattctgaagctcctgaccgactttcaatcccatcagctttgggccacactgctcagcctgaccttcatcaaaacgacattttctctgcactatgcttggaagaccatggccatggttctttccattgtgagcctgttccccctctgtctgtctaccacatcccagaaaaccacatggctccctgtgctgcttgggagcctgggatgcaagccgctgacgatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgttacgtgatcagcggatctagcgccgacctgtccctggagaaggctgccgaggtctcttgggaagaggaagccgagcatagcggcgcttcccacaatattctcgtggaagttcaggatgacgggaccatgaaaatcaaggatgaggagcgggacgatacactgaccatccttctgaaagcgacactcctggccgtgtctggagtctatcctctcagcattcccgctaccctgttcgtgtggtacttctggcaaaagaaaaagcagcgctccggcgtcctttgggacacgccttctcccccggaagtggagagagccgttctggatgacggcatctatcggattatgcagcgcgggctgctcggaagaagccaggtgggcgtcggggtgtttcaagaaaacgttttccataccatgtggcacgtgacacggggagccgtcctgatgtaccagggcaagagacttgagccttcctgggctagcgtgaaaaaggacctgatctcttacgggggaggctggcgcctccagggctcctggaataccggggaggaagtgcaggttattgccgtcgagcccggcaagaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctatggcaatggggttgtgaccacatccggaacctacgtcagcgccatcgctcaggccaaagcgtcccaggagggccctctgcccgagattgaagacgaggtgtttagaaagcgcaaccttaccatcatggatctgcaccccgggtctggaaaaacacggagatatctgcctgctattgttcgcgaagccatcaagcggaaactcagaacgctgattcttgccccgacccgcgtggtcgctagcgagatggccgaagctctgaagggcatgcccatccggtaccaaacaaccgccgtgaagtccgagcatacagggaaagagatcgttgacctcatgtgccacgcgaccttcacgatgagactgctgagccctgtgcgggtccccaattataacatgattatcatggatgaagcccattttacagacccttcttccattgctgcccgcggctacatcagcaccagagtgggaatgggcgaggctgccgccattttcatgaccgctacaccccctgggtctgtggaagcgtttccgcagagcaatgccgtcatccaggatgaggaacgggacatccccgagcgctcctggaactctggatatgagtggattaccgatttccctggcaagacagtttggtttgtgcccagcatcaaatccgggaatgacattgctaactgtctcagaaagaatggaaaacgggtgatccagctttctagaaagaccttcgatacggaataccaaaagaccaagaacaacgactgggactacgtcgtgaccacagatattagcgagatgggcgccaatttccgcgccgaccgggttatcgatcctagacgctgcctgaagcccgtgattctgaaagacgggccggaacgggtcatcctcgctggccctatgcccgtgaccgttgcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctctttgaacctgagcgcgaaaagagcgccgcgattgatggggagtatagactgcggggagaggcccgcaagacattcgtggaactgatgagacggggcgacctcccggtctggctttcttacaaagtggcttccgaggggtttcaatatagcgatcgcagatggtgcttcgacggcgaacggaacaatcaggtcctggaggaaaacatggatgtggagatctggaccaaggagggagaacgcaaaaagctgcgcccccggtggctcgacgccagaacatactccgaccctctggctcttagagagtttaaagagttcgccgctggccggagatctgttagcggggatctgatcctcgagattggaaagctgccccagcacctgacccagcgggcccaaaatgcgctcgacaaccttgtgatgctgcataattccgaacagggcgggcgcgcctatagacacgctatggaggagctgcctgatacaatcgaaaccctcatgctgcttgccctgattgctgtgctcacgggaggcgtcacactgtttttcctgtctggccgggggctcggaaaaaccagcatcggccttctgtgtgttatggcctccagcgtgctgctctggatggcctctgtggagccccattggattgctgcgtccatcatcctggaatttttccttatggtcctgctcattccggagcctgaccgccagagaacaccccaggataaccaactggcctacgtggttatcgggctgctctttatgattcttacagtggctgccaatgagatgggactgctggaaaccacaaagaaggacctcggcatcgggcacgtcgccgtggagaaccaccatcacgctgccatgctggatgtcgaccttcatcctgcgagcgcctggacgctgtacgctgtggccaccacaattatcacccccatgatgcggcacacaattgaaaacaccacggctaatatctctctcaccgccatcgcgaaccaggccgctattctgatgggactggataaaggctggcctatctccaagatggacattggcgttcccctccttgccctggggtgctatagccaggtgaatccgctgacactcaccgctgccgtcctgatgcttgtggctcattacgccatcattggacctggcctgcaagcgaaagccacacgcgaggctcagaagagaaccgccgctgggatcatgaaaaaccccacggttgatggaatcgtggccattgacctcgatcccgtcgtgtatgacgccaagttcgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattttggaataccacaatcgccgtgtctatggctaacatcttccgcggcagctacctcgccggggccggactggctttctccctgatgaaaagcctcggcgggggaagacggggcaccggggcccagggagaaacacttggcgagaaatggaagagacagctgaatcagctgtccaaatctgaatttaacacctataagcgcagcggcattatggaggttgaccggtccgaagcgaaggaggggctcaaaagaggagagacgacaaagcacgccgtctctcgcggcaccgctaaactgcggtggttcgtggaaagaaatcttgtgaagcccgaggggaaagtcatcgatctgggatgtggccgcgggggatggagctactattgcgccggcctcaagaaggttaccgaagtgaaaggctacacaaaaggcgggcctgggcacgaggaacccattcctatggctacctacgggtggaacctggtgaaactgcattccggaaaggacgtctttttcattccccctgagaaatgtgatacactcctttgcgacattggcgagtctagcccgaatcccacgatcgaagaggggcggaccctgagagtgctgaagatggttgaaccttggctccgcggaaaccaattttgtattaaaatcctgaatccctatatgccttccgtggtcgagacacttgagcagatgcagcggaagcacggcggcatgctggtgagaaaccccctcagccgcaattctacccatgaaatgtactgggtttcctgcgggacaggaaacatcgtgagcgccgtcaatatgacctctcggatgctgctgaacagattcacgatggcgcaccgcaagccgacctatgagagagatgtggacctcggcgccgggacacggcacgtggctgtcgaacctgaggttgccaacctggatattatcggacagcgcattgaaaatatcaaacatgagcacaagtccacctggcattacgacgaggataacccctataaaacatgggcttaccacggcagctatgaagtgaagccctctgggtccgccagctccatggtgaatggagtcgtgaaacttctgaccaagccttgggacgttattcccatggtgacacaaatcgctatgaccgatacgacaccttttggccagcagagagtcttcaaggagaaagtggacacccggaccccgaaggccaaaagaggcacagcgcaaatcatggaagttacggccaagtggctctgggggtttctgagccggaacaaaaagccccgcatttgtaccagagaggagttcacacggaaggtgcgctctaatgctgccatcggagctgtctttgtggacgagaaccagtggaatagcgccaaagaggccgttgaagatgagagattctgggaccttgtgcatcgggaacgcgagctgcacaagcagggcaaatgcgcgacctgcgtctacaacatgatggggaagagagagaaaaagctcggagagtttggcaaggctaaagggtcccgggccatttggtacatgtggctgggcgcccgcttcctggagttcgaagctctcggatttatgaatgaggatcactggttctctagagaaaacagcctgtccggcgtggagggggagggacttcataagctgggctatatcctccgggacatttctaaaatccctgggggaaatatgtacgccgatgacacagctggctgggatacccgcatcacagaagacgatctgcagaacgaggccagaattaccgacatcatggaacccgagcacgcgcttctggccaagagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgaacctggctgaacgggtgcttgattggctggagaagtatggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaacgccatttgttccgctgtgcccgttgattggatcccgacatctagaaccacgtggagcattcacgcccatcaccagtggatgaccacagaagacatgctgtccgtgtggaatcgggtctggatcgaggaaaacccttggatggaggataagacccatatcagctcttggggagacgtgccctacctcggcaaaagagaggaccaatggtgcgggtccctgattggacttacagcccgcgctacctgggccacaaatatccaggttgcgattaaccaggtgcggagactgatcggcaatgaaaactacctcgattatatgaccagcatgaagcgcttcaaaaatgagtctgaccccgaaggggctctgtggtga

SEQ ID NO: 18824 - RNA, 9879 nt, synthetic construct
  misc_feature 1..9879: note = derived and/or modified CDS sequence (opt5) from DENV-1__EU687247__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactgaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagatttggggaaaggccaaaatcatcggcgctgacgtgcagaatacaacctttattatcgatgggcctaacacccccgaatgtcctgacgatcagagagcgtggaatatttgggaggtcgaggactacggattcggcatctttacaaccaacatttggctgaagctgcgcgattcctatacgcaggtttgcgaccaccggcttatgagcgccgctatcaaagattctaaggccgtgcacgccgacatgggctactggatcgaatccgagaaaaatgaaacatggaagctcgctagagccagcttcattgaggtgaagacctgtatctggcccaaatctcatacactgtggtccaacggggtcctggaaagcgagatgattatcccgaagatttatggaggccctatctctcaacacaattaccgccccgggtacttcacccagacagcgggaccttggcatctcggcaaactggagcttgattttgacctgtgcgaagggaccacggtggttgtggatgagcactgcggaaaccggggccccagcctcagaaccacaaccgtcacaggcaagatcattcacgaatggtgttgccggtcctgtaccctgcctcccctgcgcttcaaaggggaggacggatgctggtatggcatggagatcagaccggtgaaggaaaaggaggaaaatcttgttaaaagcatggtgtctgctgggtccggagaggtcgacagcttttccctcggcctgctgtgtatttctatcatgattgaagaggtgatgcggagcagatggtcccgcaagatgctcatgacggggacactggccgttttctttcttctgatcatgggacagctcacctggaacgatctgattcggctgtgcatcatggtgggcgccaatgcttctgacagaatgggcatggggacaacctaccttgccctgatggcgaccttcaaaatgcgccctatgtttgctgtcggactcctgttcagacggctcacaagccgcgaggtgctgcttctgacgatcggcctctccctggtggcctctgtcgaactgcccaacagccttgaggaactgggggatggactcgccatgggcattatgatcctgaagctcctgaccgactttcaatcccatcagctttgggctacactgctcagcctgaccttcattagaacaaccttttctctgcactatgcctggaaaacgatggctatggttctttccatcgtgagcctgttccccctctgtctgtctacaacctcccagaagaccacatggctccctgtgctgcttgggagcctgggatgcaagccgctgaccatgtttctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacaatgaaaatcaaggatgaggagcgcgacgatacgctgaccattcttctgaaagccacactcctggctgtgtctggagtctatcctctcagcatccccgccaccctgttcgtgtggtacttctggcaaaagaagaaacagagatccggcgtcctttgggacacaccttctcccccggaagtggagcgggccgttctggatgacggcatttatcgcatcatgcagagagggctgctcggacggagccaggtgggcgtcggggtgtttcaagaaaacgttttccataccatgtggcacgtgacgcgcggagctgtcctgatgtaccagggcaagagacttgagccttcctgggccagcgtgaaaaaggacctgatttcttacgggggaggctggcggctccagggctcctggaataccggggaggaagtgcaggttatcgcggtcgagcccggaaaaaaccctaagaatgtgcaaacagctcccggcacctttaagacaagcgaaggggaggtgggagccattgccctggatttcaaaccgggcacctctgggtcccctatcgtcaacagagaaggaaagatcgtgggcctctatggcaatggggttgtgacaacgagcggaacctacgtctccgctattgcccaggcgaaagcttctcaggagggccccctgcctgagatcgaagacgaggtgtttcgcaagcggaaccttacaattatggatctgcaccccgggagcggaaaaaccagacgctatctgcccgccatcgttcgggaagccattaagagacgcctccggaccctgatccttgctcctacaagagtggtcgcctccgagatggctgaagccctgaagggcatgccgatccgctaccaaacgaccgcggtgaaaagcgagcatacagggaaggagattgttgacctcatgtgccacgccaccttcacaatgcggctgctgtctcccgtgagagtccctaattataacatgatcattatggatgaagctcattttaccgacccctccagcatcgccgctcggggctacatttctacgcgcgtgggaatgggcgaggccgccgctatcttcatgacagcgacccctcccgggagcgtggaagcctttcctcagtccaatgctgtcatccaggatgaggaaagagacattccggagcggtcttggaacagcggatatgagtggatcaccgatttccccggcaaaacagtttggtttgtgccttccattaagtctgggaatgacatcgccaactgtctccgcaaaaatggaaagagagtgattcagcttagccggaagaccttcgatacagaataccaaaaaaccaagaacaacgactgggactacgtcgtgacgacagatatctccgagatgggcgccaatttcagagctgaccgcgttattgatccccggagatgcctgaaacctgtgatcctgaaggacgggcccgaacgcgtcatcctcgccggcccgatgcctgtgaccgttgcgagcgctgcccagcggagaggacgcattggccggaaccacaataaagagggggatcagtatatctacatgggacagcccctgaacaatgacgaggatcatgcccactggacagaagctaagatgcttctggacaacattaatacccccgagggcatcattcctgccctctttgaacccgagagagaaaagtctgcggccatcgatggggagtatcgcctgagaggagaggctcggaaaacgttcgtggaactgatgcgcagaggcgacctccctgtctggctttcctacaaggtggccagcgaggggtttcaatattccgatcggcgctggtgcttcgacggcgaaagaaacaatcaggtcctggaggaaaacatggatgtggagatctggaccaaagagggagaacggaagaaactgagaccgcgctggctcgacgctcggacatactctgaccccctggcccttagagagtttaaggaattcgctgccggccgccggagcgtttccggggatctgattctcgagatcggaaaactgcctcagcacctgacccagagagcgcaaaatgccctcgacaaccttgtgatgctgcataattctgaacagggcgggcgggcttatcgccacgccatggaggagctgcccgatacaattgaaaccctcatgctgcttgctctgatcgccgtgctcacaggaggcgtcaccctgtttttcctgagcggcagagggctcggaaagacgtccattggccttctgtgtgttatggccagctctgtgctgctctggatggcttccgtggagcctcattggatcgcggccagcatcattctggaatttttccttatggtcctgctcatccccgagccggaccggcagcgcacacctcaggataaccaactggcttacgtggttattgggctgctctttatgatccttaccgtggccgccaatgagatgggactgctggaaaccacaaagaaagacctcggcattgggcacgtcgctgtggagaaccaccatcacgccgcgatgctggatgtcgaccttcatcccgcctctgcttggaccctgtacgccgtggctacaacgatcattacccctatgatgagacacacaatcgaaaacaccacagccaatatctccctcaccgcgattgccaaccaggctgccatcctgatgggactggataagggctggcccattagcaaaatggacatcggcgttcctctccttgctctggggtgctattctcaggtgaatcccctgacgctcaccgccgctgtcctgatgcttgtggcccattacgcgattatcggaccgggcctgcaagccaaggctacacgggaggcccagaaacgcaccgctgccgggatcatgaagaaccctacagttgatggaattgtggccatcgacctcgatcccgtcgtgtatgacgcgaagttcgaaaaacagctgggccagattatgctgctcatcctttgtaccagccaaattctgctgatgagaacgacatgggctctctgcgagtccatcaccctggccacagggccccttaccaccctgtgggagggatctcctggcaagttttggaatacaacgatcgctgtgagcatggccaacattttccggggctcctacctcgccggggctggactggccttcagcctgatgaaatccctcggcgggggacgcagaggcaccggggcgcagggagaaacacttggcgagaagtggaaacggcagctgaatcagctgtctaagagcgaatttaacacctataagagatccggcatcatggaggttgaccgctctgaagccaaagaggggctcaagcggggagagacaaccaaacacgctgtcagcagaggcacggccaagctgcgctggttcgtggaacggaatcttgtgaaaccggaggggaaggtcattgatctgggatgtggcagagggggatggtcctactattgcgctggcctcaagaaagttacagaagtgaagggctacaccaaagggggacccggccacgaggaacctatccccatggccacctacgggtggaacctggtgaagctgcattctggaaaagacgtctttttcattcctcccgagaagtgtgatacactcctttgcgacatcggcgagagctcccctaatccgaccattgaagaggggcgcacactgcgggtgctgaaaatggttgaaccctggctcagaggaaaccaattttgtatcaagatcctgaatccttatatgcccagcgtggtcgagacgcttgagcagatgcagcgcaagcacggcggcatgctggtgcggaaccctctctctagaaattccacccatgaaatgtactgggttagctgcgggacaggaaacattgtgtctgcggtcaatatgacctcccgcatgctgctgaaccggttcacaatggcccacagaaaacccacctatgagcgcgatgtggacctcggcgctgggacgagacacgtggccgtcgaaccggaggttgctaacctggatatcattggacagcggatcgaaaatattaagcatgagcacaaaagcacctggcattacgacgaggataacccttataagacatgggcctaccacggctcttatgaagtgaaaccctccgggagcgcttccagcatggtgaatggagtcgtgaagcttctgaccaagccctgggacgttatccctatggtgacacaaatcgccatgaccgatacaaccccctttggccagcagcgcgtcttcaaagagaaggtggacacgagaacacctaaagcgaagcggggcaccgcccaaattatggaagttaccgctaaatggctctgggggtttctgtctagaaacaagaagccgcggatctgtacacgcgaggaattcacgagaaaagtgcggagcaatgccgctattggagccgtctttgtggacgagaaccagtggaattccgccaaggaggcggttgaagatgagcgcttctgggaccttgtgcatagagaacgggagctgcacaaacagggcaagtgcgctacctgcgtctacaacatgatggggaaacgcgaaaagaagctcggagagtttggcaaagccaaggggtctagagccatctggtacatgtggctgggcgctcggttcctggagttcgaagccctcggatttatgaatgaggatcactggttcagccgcgaaaactccctgtctggcgtggagggggagggacttcataaactgggctatattctcagagacatcagcaagatccccgggggaaatatgtacgctgatgacacagccggctgggatacccggattacagaagacgatctgcagaacgaggcgaaaatcaccgacattatggaacctgagcacgcccttctggctaagtccatctttaaactcacatatcaaaataaggtcgtgcgcgttcagagacccgccaagaacgggaccgtgatggatgtcatttctcggcgcgaccagagaggcagcggacaggtgggcacgtacgggctgaataccttcacaaacatggaagctcaactgatccggcagatggagtccgagggaatctttagcccttctgaactcgagacccccaacctggccggcagagtgcttaattggctggaaaaacatggggttgagcgcctcaagcggatggcgatttccggagatgactgtgtggtcaaaccgatcgacgatagattcgccacagctctgaccgcccttaacgacatgggcaaggtgcgcaaagatattcctcagtgggaacccagcaaggggtggaatgactggcagcaagttcctttttgctctcaccacttccatcagctgatcatgaaggatggccgggagattgtggtcccctgtagaaaccaggacgagctcgtgggacgcgctcgggtctcccagggcgccgggtggagcctgagagaaacggcttgcctgggaaaatcctatgcccaaatgtggcagctcatgtactttcaccgccgggatctgagacttgcggccaatgctatctgttctgccgtgcctgttgactgggtgcccacaagccgcaccacatggtccattcatgcccaccatcagtggatgaccacggaggatatgctgagcgtctggaaccgggtgtggatcgaagagaatccgtggatggaagacaagacccacgtttcttcctggggcgatgtgccttatctcgggaaaagagaggaccaatggtgcggaagcctgatcggccttacagctcgggccacctgggcgacaaacattcaggtcgctatcaatcaggtgagacgcctgctcgggaacgagaattacctggactacatgacctctatgaagcggttcaaaaacgaaagcgatcccgagggcgccctgtggtga

SEQ ID NO: 18825 - RNA, 9879 nt, synthetic construct
  misc_feature 1..9879: note = derived and/or modified CDS sequence (opt5) from DENV-1__EU660412__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgccggtctgttagcggagatctcatcctggagatcggcaagctgccccagcacctcacacagagagcgcagaatgcccttgacaacctggtgatgctgcataattccgaacaagggggacgggcttatcgccacgccatggaggagctccctgataccattgaaacactgatgcttctggctctcatcgccgtgctgaccggcggcgtcacgctgttctttctctctgggagaggacttggcaagacaagcattgggctgctgtgtgttatggcctccagcgtgctcctgtggatggcttctgtggagccccattggatcgcggcctccattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctacgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctatagccaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgtacgtctcagattctgctcatgagaacaacctgggctctgtgcgagagcatcacacttgccaccggacctctgaccacactctgggagggctccccgggcaaattctggaatacgaccattgctgtgtctatggccaacatctttcgggggagctacctggccggagctggcctggccttctccctcatgaaaagccttgggggaggccgcagagggacaggagcgcaaggcgaaaccctgggcgagaaatggaagcggcagctgaatcagctctccaagtctgagttcaacacatataaaagaagcgggatcatggaggttgaccgctccgaagccaaggagggactgaaacggggcgagaccacgaagcacgctgtctctagagggacagccaaacttcgctggtttgtggaacggaatctggtgaagcccgagggaaaggtcattgatctcggctgtgggagaggaggctggagctactattgcgctggcctgaaaaaggttaccgaagtgaaagggtacaccaagggaggccctgggcacgaggaacccatccctatggccacatacggatggaacctggtgaaactccattccggcaaggacgtcttctttattccccctgagaaatgtgatacccttctgtgcgacatcggggagtctagcccgaatcccacaattgaagagggacgcacgctgcgggtgctcaagatggttgaaccttggctgagaggcaaccagttctgtatcaagattcttaatccctatatgccttccgtggtcgaggcgctggagcaaatgcagcgcaaacacggcgggatgctcgtgcggaaccccctgagcagaaattctacccatgaaatgtactgggtttcctgcggaacaggcaacatcgtgagcgccgtcaatatgacctctcgcatgctgctcaaccggtttacaatggctcacagaaagccgacctatgagcgcgatgtggacctggggacgggaaccagacacgtggccgtcgaacctgaggttgctaaccttgatatcattggccagcggatcgaaaatattaaacatgagcacaagtccacatggcattacgacgaggataacccctataaaacctgggcctaccacgggagctatgaagtgaagccctctggatccgctagctccatggtgaatggcgtcgtgaagctgctcacaaaaccttgggacgttatccccatggtgacccagattgccatgacagataccacgcctttcggccaacagcgcgtctttaaggagaaagtggacacaagaaccccgaaggcgaaacgggggaccgcccagatcatggaagttacagctagatggctgtggggattccttagccggaacaagaagccccgcatctgtacgagagaggaatttacccggaaagtgcgctctaatgccgctattggcgccgtcttcgtggacgagaaccaatggaatagcgccaaggaggcggttgaagatgagagattttgggacctggtgcatcgggaacgcgagctccacaaacaggggaagtgcgctacatgcgtctacaacatgatgggaaaaagagaaaagaagctgggcgagttcgggaaagccaagggctcccgggccatctggtacatgtggctgggagctcgctttctcgagttcgaagccctgggcttcatgaatgaggatcactggttttctagagaaaacagcctttccggggtggagggagagggcctgcataaactcgggtatattctgcgggacatctctaagattcctggaggcaatatgtacgctgatgacaccgccgggtgggatacacgcatcaccgaagacgatcttcagaacgaggcgaaaatcacagacattatggaacccgagcacgccctgctcgctaaggccatcttcaaactgacctatcagaataaggtcgtgagagttcaacggcctgctaagaacggcacggtgatggatgtcattagccgcagagaccagcggggatccggccaggtggggacctacggactgaatacatttaccaacatggaagcccagctcatcagacaaatggagtctgagggcattttcagcccctccgaactggagacaccgaaccttgcggaacgcgccctggattggctcgagaaatatggggtggaacggctgaagagaatggctatcagcggagacgactgtgttgtgaaacctatcgatgaccgctttgccaccgctcttacggccctgaatgatatgggcaaggtccggaaagacattccccagtgggagccttctaaggggtggaacgattggcaacaggtgcccttctgctcccatcactttcaccaactcatcatgaaggacggcagagagattgttgtgccttgtcgcaatcaggatgaactggtcggacgggctagagtgagccagggcgccgggtggtctctgcgcgagacagcgtgcctcggaaaatcctacgcccagatgtggcaactgatgtatttccatcggagagaccttcgcctggctgccaacgccatctgtagcgctgtccccgtggattgggttccgacctcccggacaacctggtctattcacgcccatcaccagtggatgacgaccgaagacatgctcagcgtgtggaatagagtctggatcgaggaaaacccttggatggaggataagacacatatttccagctgggaggacgtgccctacctgggcaaacgggaagaccagtggtgcgggtctcttatcggactgaccgcgagagctacatgggccaccaatatccaagttgccattaaccaggtgcgccggctcatcggcaatgagaactacctggattatatgatttccatgaagagatttaaaaatgaaagcgaccccgagggggctctgtggtga

SEQ ID NO: 18826 - RNA, 9879 nt, synthetic construct
  misc_feature 1..9879: note = derived and/or modified CDS sequence (opt5) from DENV-1__EU660418__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggcatttctggcagaagaagaagcagcggtccggcgtcctttgggacacgccttctcccccggaagtgggccgcgccgttctggatgacgggatctacagaattatgcagcggggactgctcggccgcagccaggtgggggtcggagtgtttcaagagaacgttttccacaccatgtggcacgtgacaagaggcgccgtcctgatgtatcaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctacgggaatggagttgtgaccacatccggcacctatgtcagcgccatcgctcaggccaaggcgtcccaggaagggcctctgcccgagattgaggacgaagtgtttcggaaaagaaaccttaccatcatggatctgcatcccggatctggcaagacacgccggtacctgcctgctattgttagagaggccatcaaacgcaagctccggacgctgattcttgccccgaccagagtggtcgctagcgaaatggccgaggctctgaaggggatgcccatccgctatcaaacaaccgccgtgaaatccgaacacacaggcaaggagatcgttgacctcatgtgccatgcgaccttcacgatgcggctgctgagccctgtgagagtccccaattacaacatgattatcatggatgaggcccactttacagacccttcttccattgctgcccggggatatatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctacgagtggattaccgatttccctgggaaaacagtttggtttgtgcccagcatcaagtccggaaatgacattgctaactgtctccgcaaaaatggcaagagagtgatccagctttctcggaagaccttcgatacggagtatcagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccataataaagaaggagatcagtacatttatatgggccagcccctgaacaatgacgaggatcacgcccactggacggaggccaagatgcttctggacaacatcaatacccctgaagggattatccccgctctctttgagcctgaaagagaaaagagcgccgcgattgatggagaataccgcctgagaggcgaggcccggaaaacattcgtggagctgatgcgcagaggggacctcccggtctggctttcttataaggtggcttccgaaggctttcaatacagcgatcggcgctggtgcttcgacggagagagaaacaatcaggtcctggaagagaacatggatgtggaaatctggaccaaagagggcgagcggaagaaactgagaccccgctggctcgacgcccggacatattccgaccctctggctcttagagaatttaaggagttcgccgctgggcgccggtctgttagcggagatctgatcctcgaaattggcaaactgccccagcatctgacccagagagcccaaaatgcgctcgacaaccttgtgatgctgcacaattccgagcaagggggacgggcctaccgccatgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccactggattgctgcgtccatcatcctggagtttttccttatggtcctgctcattccggaacctgaccggcagcgcacaccccaggataaccaactggcctatgtggttatcggactgctctttatgattcttacagtggctgccaatgagatgggcctgctggagaccacaaagaaagacctcgggatcggacacgtcgccgtggaaaaccatcaccatgctgccatgctggatgtcgaccttcaccctgcgagcgcctggacgctgtacgctgtggccaccacaattatcacccccatgatgagacatacaattgagaacaccacggctaatatctctctcaccgccatcgcgaaccaggccgctattctgatgggcctggataagggctggcctatctccaaaatggacattggggttcccctccttgccctgggatgctacagccaggtgaatccgctgacactcaccgctgccgtcctgatgcttgtggctcactatgccatcattggccctgggctgcaagcgaaggccacacgggaagctcagaaacgcaccgccgctggaatcatgaagaaccccacggttgatggcatcgtggccattgacctcgatcccgtcgtgtacgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctatctcgccggagccggcctggctttctccctgatgaaaagcctcgggggaggccgcagagggaccggagcccagggcgagacacttggcgaaaagtggaaacggcagctgaatcagctgtccaagtctgagtttaacacctacaagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcatcgatctgggctgtgggagaggaggctggagctattactgcgccggcctcaagaaagttaccgaggtgaaggggtatacaaaaggaggccctgggcatgaggagcccattcctatggctacctacggatggaacctggtgaagctgcactccggcaaagacgtctttttcattccccctgaaaagtgtgatacactcctttgcgacattggggagtctagcccgaatcccacgatcgaggaaggacgcaccctgcgggtgctgaaaatggttgagccttggctcagaggcaaccaattttgtattaagatcctgaatccctacatgccttccgtggtcgaaacacttgagcagatgcagcgcaagcatggcgggatgctggtgcggaaccccctcagcagaaattctacccacgagatgtattgggtttcctgcggaacaggcaacatcgtgagcgccgtcaatatgacctctcgcatgctgctgaaccggttcacgatggcgcacagaaaaccgacctacgaacgcgatgtggacctcggggccggaacaagacatgtggctgtcgagcctgaagttgccaacctggatattatcggccagcggattgagaatatcaagcacgaacataaatccacctggcactatgacgaggataacccctacaagacatgggcttatcatgggagctacgaggtgaaaccctctggatccgccagctccatggtgaatggcgtcgtgaaacttctgaccaagccttgggacgttattcccatggtgacacaaatcgctatgaccgatacgacaccttttggccagcagcgcgtcttcaaagaaaaggtggacaccagaaccccgaaagccaagcgggggacagcgcaaatcatggaggttacggccaaatggctctggggatttctgagcagaaacaagaagccccggatttgtacccgcgaagagttcacaagaaaagtgcggtctaatgctgccatcggcgctgtctttgtggacgaaaaccagtggaatagcgccaaggaggccgttgaggatgaacgcttctgggaccttgtgcacagagagcgggaactgcacaaacaggggaagtgcgcgacctgcgtctataacatgatgggaaaacgcgagaagaagctcggcgaatttgggaaagctaagggctccagagccatttggtacatgtggctgggagcccggttcctggagttcgaggctctcggctttatgaatgaagatcattggttctctcgcgagaacagcctgtccggggtggaaggagagggccttcacaaactggggtacatcctcagagacatttctaatatccctggaggcaacatgtatgccgatgacacagctgggtgggatacccggatcacagaggacgatctgcagaatgaagcccgcattaccgacatcatggagcccgaacatgcgcttctggccaagagcatttttaaactcacgtaccaaaacaaggtcgtgagagttcagcggcctgctaaaaatggcaccgtgatggatgtcatctcccgcagagaccagcggggatctggccaggtggggacatatggactgaacaccttcacaaacatggaggcccaactgattagacagatggaaagcgagggcatcttttcccccagcgagctcgaaaccccgaatctggctgagcgcgtgcttgattggctggaaaagtacggggttgagcggctcaagagaatggccatctctggagacgactgtgtggtcaaacctattgatgaccgcttcgcgacggccctgacagctcttaacgatatgggcaaggtgcggaaagacatcccccagtgggaaccttccaaggggtggaatgattggcagcaagttcccttttgcagccaccacttccatcagctgattatgaaagacggcagagagatcgtggtcccttgtcgcaaccaggatgagctcgtgggacgggccagagtctctcagggcgctgggtggtccctgcgcgaaaccgcctgcctgggaaagagctatgctcaaatgtggcagctcatgtactttcaccggagagacctgcgccttgccgcgaatgccatttgttccgctgtgcccgttgattggatcccgacatctcggaccacgtggagcattcatgcccaccatcagtggatgaccacagaggacatgctgtccgtgtggaacagagtctggatcgaagagaatccttggatggaagataagacccacatcagctcttggggcgacgtgccctatctcgggaaacgggaggaccaatggtgcggatccctgattggccttacagccagagctacctgggccacaaacatccaggttgcgattaatcaggtgcgccggctgatcgggaacgagaattacctcgattacatgaccagcatgaagagattcaaaaacgaatctgaccccgagggcgctctgtggtga

SEQ ID NO: 18827 - RNA, 9879 nt, synthetic construct
  misc_feature 1..9879: note = derived and/or modified CDS sequence (opt5) from DENV-1__EU677151__SS-prME
  source 1..9879: mol_type = other RNA
agcgtgaccatgctgctcatgctgatccccacagcccttgctttccacctgacgaccagaggcggggagcctcatatgattgtctccaagcaggaacggggaaaatctctcctgtttaagacaagcgccggcgttaacatgtgcacccttatcgcgatggacctgggggagctctgtgaagatacaatgacctacaaatgcccgcgcattacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagatccagaaggtggaaacatgggccctgcggcaccccggcttcaccgtcattgctctttttctggcccatgcgatcgggacatctatcacccagaagggaattatcttcattctcctgatgcttgtgacccctagcatggccatgcgctgcgttggcatcgggtccagagattttgtggagggactgagcggcgctacatgggtcgacgtggtgctcgagcacgggtcttgtgtcacgaccatggccaaagataagcccacactggacattgaactgctcaaaaccgaggttacaaaccctgctgtgctgcggaagctttgcatcgaagccaaaatttccaataccacgacagatagccgctgtccgacccaaggagaggcgaccctggtggaagagcaggacgccaacttcgtctgcagacggacatttgtggatcgcggctggggcaatgggtgtggactcttcggcaaggggtctctgatcacctgcgctaagtttaaatgcgttacaaagcttgagggaaaaatcgtgcagtacgaaaacctgaagtattccgtcattgtgacggttcacaccggcgaccagcatcaagtggggaatgagagcacagaacacggaaccacagccaccatcacgccccaggctcctacctctgagattcagctcacagactacggcgccctgaccctggattgttcccccagaacaggcctcgacttcaacgaaatggtcctgcttaccatgaaagagaagagctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaatccagaccagcggaacaaccacaatttttgccggccatctcaagtgccgcctgaaaatggataagcttaccctgaaagggatgtcttatgtcatgtgtacgggctccttcaagctcgagaaggaagtggctgagacacagcacggaaccgttctggtgcagatcaaatacgagggcaccgacgccccgtgcaagatccctttcagcacacaagatgaaaaaggggtcacccagaacggaagactgattacagcgaatcccatcgtgacggacaaggagaaacctgtgaacattgaagctgagcccccctttggcgagtcttatatcgttattggggccggagaaaaggcccttaagctcagctggttcaaaaagggctcctctatcgggaaaatgtttgaggctaccgcccggggcgctagacgcatggccatcctgggagatacagcgtgggacttcggcagcattgggggagtctttacctccgtgggcaagctggtgcatcagatcttcgggacagcctacggagtcctctttagcggcgtgtcttggaccatgaaaattgggatcggcgttctgcttacgtggctgggactcaattcccggagcacctctctgtccatgacatgtattgctgtgggcctggtcaccctttacctcggggtgatggttcaggccgatagcggatgcgtgatcaactggaagggcagagaactgaagtgtgggtccggaattttcgtcacaaatgaggtgcacacctggacagaacaatataaatttcaggctgactctcctaagcgcctgagcgccgcgatcggcaaagcctgggaggagggggtttgcggcatccggtccgctaccagactcgaaaacattatgtggcgccagatctctaacgagctgaatcatattcttctggaaaacgacatgaagttcacggtggtcgtgggagatgtggtcggcatcctcgcccaggggaaaaagatgattcggccgcaacccatggagcacaaatacagctggaagtcctggggaaaggctaaaatcatcggcgccgacgttcagaatacaacctttattatcgatgggcctaacacccccgaatgtcctgacgatcagagagcctggaatatttgggaggtggaggactatggattcggcatctttacaaccaacatttggctgaagctgcgcgatagctacacgcaggtgtgcgaccaccggcttatgtctgctgcgatcaaagattccaaggccgtccatgctgacatgggctattggatcgaaagcgagaaaaatgaaacatggaagctcgccagagcctctttcattgaggtgaagacctgtatctggcccaaatcccacacactgtggagcaacggggttctggaatctgagatgattatcccgaagatttacggaggccctatcagccaacataattatcgccccgggtacttcacccagacagctggaccttggcacctcggcaaactggagcttgattttgacctgtgcgaagggaccacggtggtcgtggatgagcactgcggaaaccggggcgcctccctcagaaccacaaccgttacaggcaagatcattcatgaatggtgttgccggagctgtaccctgccccctctgcgcttcaaaggggaggacggatgctggtacggcatggagatcagacccgtgaaggaaaaggaggaaaatcttgtcaaatctatggtgtccgcggggagcggagaggttgactccttttctctcggcctgctgtgtattagcatcatgattgaagaggtgatgcggtccagatggtctcgcaagatgctcatgacggggacactggctgtcttctttcttctgatcatgggacagctcacctggaacgatctgattcggagctgcatcatggtgggcgccaatgcctccgacagaatgggcatggggacaacctatctggctcttatggccaccttcaaaatgcgcccgatggtggcggtcggactgctctttagacggctgacatctcgcgaggttctcctgcttacgatcggcctgagcctcgtggcttccgtggaactgcctaacagcctggaggaacttggggatggactggccatgggcattatgatcctcaagctgctcaccgacttccaatcttaccagctgtgggccacacttctgtccctcacctttattaaaacaaccttcagcctgcactatgcttggaagacgatggccatggtcctgtctatcgtgtcccttctgcccctctgtctgagcacaacctctcagaagaccacatggctccccgttctgcttgggtccctgggatgcaaacctctgaccatgtttctcattgctgagaataagatctggggcagaaaaagctggccgctgaacgaaggcatcatggccgtggggattgtctccatccttctgagctctctcctgaagaacgatgtgcccctcgcgggacctctgattgccggcgggatgcttatcgcttgttacgttattagcggatcctctgccgacctgagcctggagaaagctgccgaggtgtcctgggaagaggaagccgagcattctggcgctagccacaatatcctcgtcgaagtgcaggatgacgggacaatgaagatcaaagatgaggagcgggacgatacgctgaccattcttctgaaggcgacactcctggccgtctccggagtgtatcccctctctatccctgctaccctgttcgtttggtacttttggcaaaagaaaaagcagcgcagcggcgtgctttgggacacaccctcccctcccgaagtcgagagagccgtgctggatgacggcatttatcggatcatgcagcgcgggctgctcggaagaagccaggttggcgtgggggtcttccaagaaaacgtgttccataccatgtggcacgtgacgcggggagccgttctgatgtaccagggcaaacgccttgagccgtcttgggcttccgtcaagaaagacctgattagctacgggggaggctggagactccagggctcttggaataccggggaggaagtgcaggtgatcgccgtcgagcctggaaagaaccccaagaatgtgcaaacagcgcctggcacctttaaaacacccgaaggggaggttggagctattgccctggatttcaagccgggcacctccgggagccctatcgtgaaccgggaaggaaaaatcgtcggcctctatggcaatggggtggttacaacgtccggaacctacgtgtctgccattgctcaggccaaggcgagccaggagggccccctgcctgagatcgaagacgaggtctttagaaaacgcaaccttacaattatggatctgcaccccgggtccggaaagacccggagatatctgcccgctatcgtgcgcgaagccattaagcggaaactcagaaccctgatccttgcccctacacgcgttgtggctagcgagatggccgaagctctgaagggcatgccgatccggtaccaaacgaccgccgtcaaatctgagcatacagggagagagattgtggacctcatgtgccacgcgaccttcacaatgcgcctgctgtcccccgtgcgggtccctaattataacatgatcattatggatgaagcccattttaccgaccccagctctatcgctgccagaggctacattagcacgcgggttggaatgggcgaggctgccgccatcttcatgacagctacccctcccgggtccgtggaagcgtttcctcagtctaatgccgtgatccaggatgaggaacgcgacattccggagagaagctggaactccggatatgagtggatcaccgatttccccggcaagacagtctggtttgtgccttctattaaaagcgggaatgacatcgctaactgtctccggaagaatggaaagcgcgttattcagctttccagaaaaaccttcgatacagaataccaaaagaccaaaaacaacgactgggactacgtggtcacgacagatatcagcgagatgggcgccaattttcgggccgacagagtgattgatccccgccggtgcctgaagcctgttatcctgaaagacgggcccgaaagagtgatcctcgctggcccgatgcctgtcaccgtggcctctgcggctcagcgccggggaagaattggccgcaaccacaataaggagggggatcagtatatctacatgggacagcccctgaacaatgacgaggatcatgcccactggacagaagccaagatgcttctggacaacattaatacccccgagggcatcattcctgctctcttcgaacccgagcgggaaaaatccgccgcgatcgatggggagtatagactgcgcggagaggccagaaagacgttcgtcgaactgatgcggcgcggcgacctccctgtgtggcttagctacaaagttgcttccgaggggtttcaatattctgatagacggtggtgcttcgacggcgaacgcaacaatcaggtgctggaggaaaacatggatgtggagatctggaccaaggagggagaaagaaaaaagctgcggccgagatggctcgacgcccgcacatacagcgaccccctggctcttcgggagtttaaagaattcgccgctggcagacgctccgtctctggggatctgattctcgagatcggaaagctgcctcagcacctgacccagcgggcccaaaatgcgctcgacaaccttgttatgctgcataatagcgaacagggcgggagagcctatcggcacgctatggaggagctgcccgatacaattgaaaccctcatgctgcttgccctgatcgctgtgctcacaggaggcgtgaccctgtttttcctgtccggccgcgggctcggaaagacgagcattggccttctgtgtgtcatggcctcttccgccctgctctggatggctagcgtggagcctcattggatcgcggcctctatcattctggaatttttccttatggttctgctcatccccgagccggacagacagcggacacctcaggataaccaactggcttacgtggtcattgggctgctctttatgatccttaccgtggccgccaatgagatgggactgctggaaaccacaaaaaaggacctcggcattgggcacgtcgctgtggagaaccaccatcacgccaccatgctggatgttgaccttcatcccgcgtccgcctggacactgtacgctgtggccacgaccatcattacacctatgatgcgccacaccatcgaaaacacaaccgctaatatcagcctcacggccattgcgaaccaggccgctatcctgatgggactggataaaggctggcccatttctaagatggacatcggcgtccctctccttgccctggggtgctatagccaggtgaatcccctgaccctcacagctgccgttctgatgcttgtggctcattacgccattatcggaccgggcctgcaagcgaaagccaccagagaggctcagaagcggacagccgctgggatcatgaagaaccctaccgtcgatggaattgtggccatcgacctcgatcccgtggtttatgacgccaaattcgaaaagcagctgggccagattatgctgctcatcctttgtacgtcccaaattctgctgatgcgcacaacctgggcgctctgcgagtctatcacactggctaccgggccccttaccacactgtgggagggaagccctggcaaattttggaatacgaccatcgccgtctccatggctaacattttcagaggcagctacctcgccggggccggactggctttttccctgatgaagtctctcggcgggggacggcgcggcacaggggcccagggagaaacccttggcgagaaatggaagagacagctgaatcagctgagcaagtccgaattcaacacatataaacggtctggcatcatggaggtggacagaagcgaagcgaaggaggggctccgccggggagagaccacgaaacacgccgtgtccagaggcacagctaagctgcgctggttcgtcgaacggaatcttgttaaaccggaggggaaggtgattgatctgggatgtggcagagggggatggtcttactattgcgccggcctcaagaaagtgaccgaagtcaagggctacaccaaagggggacccggccacgaggaacctatccccatggctacatacgggtggaacctggtgaagctgcatagcggaaaagacgtttttttcattcctcccgagaagtgtgataccctcctttgcgacatcggcgagtccagccctaatccgacaattgaagaggggcgcacgctgcgggtgctgaaaatggtcgaaccctggctcagaggaaaccaattttgtatcaagatcctgaatccttatatgccctctgtggttgagacccttgagcagatgcagcgcaagcacggcggcatgctggtgcggaaccctctctccagaaatagcacacatgaaatgtactgggtctcttgcgggaccggaaacattgtgtccgccgtgaatatgacaagccgcatgctgctgaaccggttcaccatggcgcacagaaaacccacgtatgagcgcgatgtcgacctcggcgccgggaccagacacgttgctgtggaaccggaggtggccaacctggatatcattggacagcggatcgaaaatattaagcatgagcacaaatctacatggcattacgacgaggataacccttataagacctgggcttaccacggctcctatgaagtcaaacccagcgggtccgccagctctatggtgaatggagttgtgaagcttctgacaaagccctgggacgtcatccctatggtgacccaaatcgctatgacagataccacgccctttggccagcagcgcgttttcaaagagaaggtggacacaagaacccctaaagccaagcggggcaccgcgcaaattatggaagtcacagccagatggctctgggggtttctgagccggaacaaaaagccgcgcatctgtacgagagaggaattcacccggaaggtgcgctccaatgctgccattggagctgtttttgtggacgagaaccagtggaattctgccaaagaggccgtcgaagatgagagattctgggaccttgtgcatcgggaacgcgagctgcacaagcagggcaaatgcgcgacatgcgtctacaacatgatggggaagagagaaaaaaagctcggagagtttggcaaggctaaagggagccgggccatctggtacatgtggctgggcgcccgcttcctggagtttgaagctctcggattcatgaatgaggatcactggttctccagagaaaactctctgagcggcgtggagggggagggacttcataagctgggctatattctccgggacatctccaaaatccccgggggaaatatgtacgccgatgacaccgctggctgggatacacgcattaccgaagacgatctgcagaacgaggccaagatcacagacattatggaacctgagcacgcgcttctggccacctctatctttaaactcacgtatcaaaataaggttgtgagagtccagcggcccgctcgcaacgggaccgtgatggatgtgattagcagacgggaccagagaggctccggacaggttggcacatacgggctgaataccttcacaaacatggaagcccaactgatccgccagatggagagcgagggaatcttttctccttccgaactcgagacccccaacctggctgaacgggtgcttgattggctggagaaacatggcgtcgaaagactcaagcgcatggccattagcggggacgactgtgtggttaagccgatcgatgaccggttcgcgacggccctgtctgctcttaatgatatgggaaaagtgagaaaggacattcctcagtgggagccctccaaaggctggaacgattggcagcaagtccctttttgcagccaccacttccatcagctgatcatgaaggacgggcgcgagattgtggtcccctgtcggaatcaggatgaactcgtgggcagagcccgcgtttcccagggagctggctggtctctgcgggagacagcctgcctggggaaaagctatgctcaaatgtggcagctcatgtactttcacagacgcgacctgcggcttgccgcgaacgccatctgttccgctgtgcctgtcgattgggtgcccaccagcagaacaacctggtctattcatgcccaccatcagtggatgacgaccgaagacatgctgtccgtttggaatcgggtgtggatcgaggaaaacccgtggatggaggataagacacacatcagctcttggggagacgtcccttatctcggcaagagagaggaccaatggtgcgggagcctgattggacttaccgcccgcgctacatgggccaccaatatccaggtggcgattaaccaggtgcggagactgatcggcaatgaaaactacctcgattacatgacatccatgaaacgcttcaagaatgagtctgaccccgaaggggctctgtggtga

SEQ ID NO: 18828 - RNA, 9879 nt, synthetic construct
  misc_feature 1..9879: note = derived and/or modified CDS sequence (opt5) from DENV-1__EU677152__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgctgccgtcgagaaccaccatcacgcggccatgctcgatgtggacctgcatcccgcttccgcctggacactttacgctgtcgccacgaccatcattacacctatgatgcggcacaccatcgaaaacacaaccgcgaatattagcctgacggccatcgctaaccaagccgctatcctcatgggactggataaaggctggcccatttctaagatggacatcggcgtgcctctgctcgcccttgggtgctatagccaggttaatcccctgaccctgacagctgccgtgctcatgctggtcgcgcattacgccattatcggaccgggccttcaggctaaggccacccgcgaggctcagaagagaacagccgccgggattatgaagaaccctaccgtggatggaatcgttgcgatcgacctggatcccgtggtctatgacgctaaatttgaaaagcagctcggccagattatgctgctgatcctctgtacgtcccagattcttctgatgcggacaacctgggccctgtgcgagtctatcacactcgctaccgggcccctgaccacactttgggagggaagccctggcaaattctggaatacgaccattgccgtgtccatggccaacatcttccgcggcagctacctggctggggccggactcgcgttttccctgatgaagtctctgggcgggggaagacggggcacaggggcccaaggagaaaccctcggcgagaagtggaaacgccagcttaatcagctgagcaagtccgagttcaacacatataaaagatctggcatcatggaggtggaccggagcgaagctaaggaggggctgaaaagaggagagaccacgaagcacgccgtttcccgcggcacagctaagctccggtggtttgtcgaaagaaatctggtgaaaccggaggggaaggtgattgatcttggatgtggccgcgggggatggtcttactattgcgccggcctgaaaaaggtcaccgaagttaaaggctacaccaaagggggacccggccacgaggaacctatccccatggcgacatacgggtggaacctcgtgaaactgcatagcggaaaggacgtgttctttattcctcccgagaagtgtgataccctgctctgcgacatcggcgagtccagccctaatccgacaattgaagaggggcggacgcttagagtcctgaaaatggtggaaccctggctgcgcggaaaccagttctgtatcaagattctcaatccttatatgccctctgttgtggagaccctggagcaaatgcagcggaaacacggcggcatgcttgtcagaaaccctctgtcccgcaatagcacacatgaaatgtactgggtgtcttgcgggaccggaaacatcgtttccgccgtgaatatgacaagccggatgctcctgaacagatttaccatggctcaccgcaagcccacgtatgagcgggatgtcgacctgggcgccgggaccagacacgtggctgtggaaccggaggtcgccaacctcgatatcattggacagcgcatcgaaaatattaaacatgagcacaagtctacatggcattacgacgaggataacccttataagacctgggcttaccacggctcctatgaagttaaacccagcgggtccgccagctctatggtgaatggagtggtcaagctgcttacaaaaccctgggacgtgatccctatggttacccagattgcgatgacagataccacgcccttcggccaacagagagtgtttaaggagaaagtcgacacacggacccctaaggccaagcgcggcaccgctcagatcatggaagtgacagccaaatggctgtgggggttcctcagcagaaacaagaaaccgcggatctgtacgagagaggaatttacccggaaggttcgctccaatgctgccattggagccgtgttcgtcgacgagaaccaatggaactctgcgaaagaggctgtggaagatgagagattttgggacctggttcatcgggaacgcgagcttcacaagcagggcaagtgcgccacatgcgtgtacaacatgatggggaaaagagaaaagaaactgggagagttcggcaaggccaaagggagccgggctatctggtacatgtggctcggcgcccgcttcctggagtttgaagctctgggattcatgaatgaggatcactggttttccagagaaaactctctcagcggcgtcgagggggagggactgcataaacttggctatattctgcgggacatctccaaaattcccgggggaaatatgtacgccgatgacaccgcgggctgggatacacgcatcaccgaagacgatctccagaacgaggccaagatcacagacattatggaacctgagcacgctctgcttgccaagtctatcttcaaactgacctatcagaataaggtggtcagagtgcaacggcccgctaaaaacgggacggttatggatgtgattagccgcagagaccagcggggctccggacaggtcggcacctacgggctcaatacatttaccaacatggaagcccagctgatccgccaaatggagagcgagggaattttctctccttccgaactggagacacccaacctcgcgggcagagtgctggattggcttgaaaagcatggggtggagcggctgaaaagaatggccatcagcggagacgactgtgttgtgaagccgatcgatgaccgctttgctaccgccctcacggctctgaatgatatgggcaaggtccggaaagacattcctcagtgggaaccctctaaggggtggaacgattggcaacaggtgcctttctgctcccaccactttcatcaacttatcatgaaagacggcagagagattgttgtgccctgtcgcaatcaggatgagctggtcggacgggccagagtgagccagggcgctgggtggtccctccgcgaaacagcctgcctgggaaagtcttatgcgcagatgtggcaactgatgtacttccaccggagagacctccgcctggccgctaacgccatctgtagcgccgtccctgtggattgggttcccacctcccggacaacctggagcattcatgctcaccatcagtggatgacgaccgaggacatgctttctgtgtggaatagagtctggatcgaagagaacccgtggatggaagataaaacacacatttccagctggggcgacgtgccttatctggggaagcgcgaggaccagtggtgcggatctctcatcggcctgaccgcccgggcgacatgggctaccaatatccaagttgccattaaccaggtgagacggcttatcgggaatgagaactacctggattacatgacaagcatgaagagatttaaaaatgaatccgaccccgagggcgccctctggtga

SEQ ID NO: 18829 - RNA, 9879 nt, synthetic construct
  misc_feature 1..9879: note = derived and/or modified CDS sequence (opt5) from DENV-1__EU677155__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagaccagcgccggcgttaacatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcacctcccacaatattctcgtggaagttcaggatgacgggacaatgaagatcaaagatgaggagagagacgataccctgacaatccttctgaaggctaccctcctggcggtgtctggagtctatcctctcagcattcccgccacgctgttcgtgtggtacttctggcagaagaagaagcagcggtccggcgtcctttgggacaccccttctcccccggaagtggagcgcgctgttctggatgacggcatctatagaattatgcagcgggggctgctcggacgcagccaggtgggcgtcggggtgtttcaagaaaacgttttccatacaatgtggcacgtgaccagaggagccgtcctgatgtaccagggcaaacggcttgagccttcctgggccagcgtgaagaaagacctgatctcttacgggggaggctggagactccagggctcctggaatacaggggaggaagtgcaggttattgctgtcgagcccggaaagaaccctaaaaatgtgcaaaccgcccccggcacatttaagacgccggaaggggaggtgggagcgatcgctctggatttcaagcctggcaccagcgggtctcccattgtcaaccgcgaaggaaaaatcgtgggcctctatggcaatggggttgtgacaacctccggaacctacgtcagcgccatcgcccaggctaaggcctcccaggagggccctctgcccgagattgaagacgaggtgtttcggaaaagaaaccttacaatcatggatctgcaccccgggtctggaaagacgcgccggtatctgcctgcgattgttagagaagctatcaaacgcaagctccggaccctgattcttgccccgacaagagtggtcgccagcgagatggctgaagccctgaagggcatgcccatccgctaccaaaccacagctgtgaaatccgagcataccgggaaggagatcgttgacctcatgtgccacgccacgttcacaatgcggctgctgagccctgtgagagtccccaattataacatgattatcatggatgaagcgcattttaccgacccttcttccattgccgctcggggctacatcagcacccgcgtgggaatgggcgaggccgctgccattttcatgacagccacaccccctgggtctgtggaggcttttccgcagagcaatgcggtcatccaggatgaggaaagagacatccccgagcggtcctggaactctggatatgagtggattacagatttccctggcaaaaccgtttggtttgtgcccagcatcaagtccgggaatgacattgccaactgtctccgcaaaaatggaaagagagtgatccagctttctcggaagacgttcgatacagaataccagaaaaccaagaacaacgactgggactacgtcgtgacaaccgatattagcgagatgggcgctaatttcagagccgaccgcgttatcgatcctcggagatgcctgaaacccgtgattctgaaggacgggccggaacgcgtcatcctcgccggccctatgcccgtgacggttgcttccgccgcgcagcggagaggacgcatcggccggaaccacaataaagagggggatcagtatatttacatgggacagcccctgaacaatgacgaggatcatgctcactggaccgaagccaagatgcttctggacaacatcaatacacctgagggcattatccccgccctctttgaacctgagagagaaaagagcgctgccattgatggggagtatcgcctgagaggagaggcgcggaaaaccttcgtggaactgatgcgcagaggcgacctcccggtctggctttcttacaaggtggcctccgaggggtttcaatatagcgatcggcgctggtgcttcgacggcgaaagaaacaatcaggtcctggaggaaaacatggatgtggagatctggacaaaagagggagaacggaagaaactgagaccccgctggctcgacgctcggacctactccgaccctctggcccttagagagtttaaggagttcgctgccggccgccggtctgttagcggggatctgatcctcgagattggaaaactgccccagcacctgacacagagagctcaaaatgccctcgacaaccttgtgatgctgcataattccgaacagggcgggcgggcgtatcgccacgccatggaggagctgcctgataccatcgaaacgctcatgctgcttgctctgattgccgtgctcacaggaggcgtcaccctgtttttcctgtctggcagagggctcggaaagaccagcatcggccttctgtgtgttatggcttccagcgtgctgctctggatggcctctgtggagccccattggattgccgcttccatcatcctggaatttttccttatggtcctgctcattccggagcctgaccggcagcgcacaccccaggataaccaactggcgtacgtggttatcgggctgctctttatgattcttaccgtggccgctaatgagatgggactgctggaaacaacgaagaaagacctcggcatcgggcacgtcgccgtggagaaccaccatcacgccgctatgctggatgtcgaccttcatcctgccagcgcgtggaccctgtacgccgtggctacaaccattatcacacccatgatgagacacaccattgaaaacacgaccgccaatatctctctcacagctatcgccaaccaggcggccattctgatgggactggataagggctggcctatctccaaaatggacattggcgttcccctccttgctctggggtgctatagccaggtgaatccgctgaccctcacagccgctgtcctgatgcttgtggcccattacgctatcattggacctggcctgcaagccaaggcgacccgggaggcccagaaacgcacggctgccgggatcatgaagaaccccacagttgatggaatcgtggctattgacctcgatcccgtcgtgtatgacgccaagttcgaaaaacagctgggccagatcatgctgctcattctttgtacctctcaaatcctgctgatgagaacaacctgggccctctgcgagagcattaccctggcgacagggcctcttacgaccctgtgggagggatccccgggcaagttttggaatacaaccatcgctgtgtctatggccaacatcttccggggcagctacctcgctggggccggactggccttctccctgatgaaaagcctcggcgggggacgcagaggcacaggggctcagggagaaacccttggcgagaagtggaaacggcagctgaatcagctgtccaagtctgaatttaacacgtataagagaagcggcattatggaggttgaccgctccgaagccaaagaggggctcaagcggggagagacaaccaaacacgcggtctctagaggcaccgccaagctgcgctggttcgtggaacggaatcttgtgaaacccgaggggaaggtcatcgatctgggatgtggcagagggggatggagctactattgcgctggcctcaagaaagttacagaagtgaagggctacaccaaagggggacctggccacgaggaacccattcctatggccacatacgggtggaacctggtgaagctgcattccggaaaagacgtctttttcattccccctgagaagtgtgatacgctcctttgcgacattggcgagtctagcccgaatcccaccatcgaagaggggcgcacactgcgggtgctgaaaatggttgaaccttggctcagaggaaaccaattttgtattaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacatcgtgagcgctgtcaatatgacgtctcgcatgctgctgaaccggttcaccatggcccacagaaaaccgacatatgagcgcgatgtggacctcggcgcggggaccagacacgtggccgtcgaacctgaggttgctaacctggatattatcggacagcggattgaaaatatcaagcatgagcacaaatccacatggcattacgacgaggataacccctataagacctgggcctaccacggcagctatgaagtgaaaccctctgggtccgctagctccatggtgaatggagtcgtgaaacttctgacaaagccttgggacgttattcccatggtgacccaaatcgccatgacggatacaaccccttttggccagcagcgcgtcttcaaagagaaggtggacaccagaacaccgaaagctaagcggggcacggcccaaatcatggaagttaccgcgaaatggctctgggggtttctgagcagaaacaagaagccccggatttgtacacgcgaggagttcaccagaaaagtgcggtctaatgccgctatcggagccgtctttgtggacgagaaccagtggaatagcgctaaggaggccgttgaagatgagcgcttctgggaccttgtgcatagagaacgggagctgcacaaacagggcaagtgcgccacatgcgtctacaacatgatggggaaacgcgaaaagaagctcggagagtttggcaaagcgaaggggtccagagctatttggtacatgtggctgggcgcccggttcctggagttcgaagccctcggatttatgaatgaggatcactggttctctcgcgaaaacagcctgtccggcgtggagggggagggacttcataaactgggctatatcctcagagacatttctaagatccctgggggaaatatgtacgctgatgacaccgccggctgggatacacggatcaccgaagacgatctgcagaacgaggctcgcattacggacatcatggaacccgagcacgcccttctggcggggagcatttttaaactcacctatcaaaataaggtcgtgagagttcagcggcctgccaaaaacggcacagtgatggatgtcatctcccgcagagaccagcggggatctggccaggtggggacctacggactgaatacattcaccaacatggaagctcaactgattagacagatggagagcgagggcatcttttcccccagcgaactcgagacgccgaacctggccgaacgcgtgcttgattggctggagaagtatggggttgaacggctcaagagaatggctatctctggagacgactgtgtggtcaaacctattgatgaccgcttcgccacagcgctgaccgcccttaatgatatgggcaaggtgcggaaagacatcccccagtgggagccttccaaggggtggaacgattggcagcaagttcccttttgcagccatcacttccaccagctgattatgaaagacggcagagagatcgtggtcccttgtcgcaatcaggatgaactcgtgggacgggctagagtctctcagggcgccgggtggtccctgcgcgagacagcttgcctgggaaagagctacgcccaaatgtggcagctcatgtattttcatcggagagacctgcgccttgctgccaacgcgatttgttccgccgtgcccgttgattggatcccgacctctcggacgacctggagcattcacgctcatcaccagtggatgacaaccgaagacatgctgtccgtgtggaatagagtctggatcgaggaaaacccttggatggaggataagacacatatcagctcttggggcgacgtgccctacctcgggaaacgggaggaccaatggtgcggatccctgattggccttaccgccagagccacatgggctaccaatatccaggttgccattaaccaggtgcgccggctgatcgggaatgaaaactacctcgattatatgacgagcatgaagagattcaaaaatgagtctgaccccgaaggcgcgctgtggtga

SEQ ID NO: 18830 - RNA, 9879 nt, synthetic construct
  misc_feature 1..9879: note = derived and/or modified CDS sequence (opt5) from DENV-1__EU677157__SS-prME
  source 1..9879: mol_type = other RNA
agcgtgaccatgctgctgatgctgatgcccacagcccttgctttccacctgacgaccagaggcggggaacctcatatgatcgtgtccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcaccctcgtcgatagaggctggggcaatgggtgtggactgtttggcaaagggtctcttattacatgcgctaagttcaagtgcgtgacgaaactggagggaaagatcgttcagtacgaaaacctcaaatattccgtgatcgtcaccgtgcacacaggcgaccagcatcaagttgggaatgagagcaccgaacacggaacaaccgccacgattacaccccaagctcctaccaccgagatccagctgacagactacggcgccctgaccctcgattgttctccccggacgggcctggactttaacgaaatggtgcttctgacaatgaaggagaaatcctggctcgtccataagcagtggttcctggatcttcctctgccctggaccagcggggcctccacatctcaagagacctggaatcgccaggacctcctggtgacctttaaaacagctcacgcgaagaagcaggaagtcgtggttctgggaagccaagagggcgccatgcacacggctctcaccggggccacagaaattcagacctccggaacaaccacgatcttcgccggccatctgaaatgcagacttaagatggataaactgacactcaaggggatgagctatgtgatgtgtaccggctcttttaaactggagaaggaactggctgagacccagcacggaacagtccttgtgcagattaagtacgagggcaccgacgccccgtgcaaaatccctttctccacacaagatgaaaagggggttacgcagaacggacggctcatcaccgcgaatcccattgtgacagacaaagagaagcctgtcaacatcgaagctgagccgcccttcggcgagagctatattgtgatcggggccggagaaaaagccctgaagctgtcttggtttaagaaaggcagctccattgggaagatgttcgaggctaccgccagaggcgctcgccggatggccatcctcggagatacagcgtgggactttggctctatcgggggagtgttcaccagcgttggcaaactggtccatcagatttttgggacggcctacggagtgcttttctccggcgtgagctggaccatgaagatcgggattggcgtcctgctcacatggctgggactcaattctagatccaccagcctttctatgacatgtatcgctgtgggcctcgttaccctgtacctgggggtgatggtccaggccgattccggatgcgtgattaactggaaaggccgcgaactcaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgccttgaaaacatcatgtggaaacagatttccaacgagctgaatcatatcctcctggaaaacgacatgaagtttaccgtggttgtgggagatgtcgccggcattctggctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggcttaagctccgcgattcctatacccaggtctgcgaccaccggctgatgagcgcggccattaaagattctaaggctgttcacgccgacatgggctactggatcgaatccgagaaaaatgaaacatggaagctggccagagctagctttatcgaggtgaagacctgtatttggcccaaatctcatacactctggtccaacggggtgctggaaagcgagatgatcattccgaagatctatggaggccctatttctcaacacaattaccgccccgggtacttcacccagacggccggaccttggcatcttggcaaactggagctcgatttcgacctgtgcgaagggaccacagtcgtggttgatgagcactgcggaaaccggggccccagcctgagaaccacaaccgtgacgggcaagatcatccacgaatggtgttgccggtcctgtacacttcctcccctccgctttagaggggaggacggatgctggtatggcatggagattcggccggtcaaagaaaaggaggaaaatctggtcaagagcatggtttctgcggggtccggagaggtggacagcttctccctgggcctcctgtgtatctctattatgatcgaagaggtcatgagaagccgctggtcccggaaaatgcttatgaccgggacactggctgtgtttttcctcctgattatgggacagctgacctggaacgatcttatcagactgtgcattatggttggcgccaatgcctctgaccgcatgggcatggggaccacatacctcgctctgatggccacgtttaagatgagacctatgttcgcggtgggactcctgtttcggcgccttaccagcagagaggtcctgctcctgacaatcggcctgtcccttgtggcttctgtggaactgcccaacagcctcgaggaactgggggatggactcgccatgggcatcatgattctgaaacttctgaccgacttccaatcccatcagctctgggccacactgctgagccttacctttatcaagacgacattctctctgcactatgcttggaaaaccatggccatggtcctctccattgttagcctgtttcccctctgtctgtctaccacatcccagaagaccacatggcttcctgtgctgctggggagcctcggatgcaagccgctgacgatgttccttatcgctgagaataaaatttggggccggcgctcttggcccctgaacgaaggcatcatggccgtggggatcgtctccattctcctgagctccctcctgaagaacgatgtgcctcttgcgggacccctgatcgccggcgggatgctgattgcttgttacgttatcagcggatctagcgccgacctctccctggagaaagctgccgaggtgtcttgggaagaggaagccgagcatagcggcgcttcccacaatattcttgtcgaagtgcaggatgacgggaccatgaagatcaaagatgaggagagagacgatacactgaccatcctcctgaaggcgacactcctggccgtttctggagtgtatcctcttagcattcccgctaccctgtttgtctggtacttctggcagaagaagaagcagcggtccggcgtgctgtgggacacgccttctcccccggaagtcgagcgcgccgtgctcgatgacggcatctatagaattatgcagcgggggctgcttggacgcagccaggttggcgtgggggtcttccaagaaaacgtgtttcataccatgtggcacgttacaagaggagccgtgctgatgtaccagggcaaacggctcgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctttatggcaatggggtggttaccacatccggaacctacgtgagcgccatcgctcaggccaaggcgtcccaggagggccctctgcccgagattgaagacgaggtcttccggaaaagaaacctgaccatcatggatctccaccccgggtctggaaagacacgccggtatctgcctgctattgtgagagaagccatcaaacgcaaacttcggacgctgattctcgccccgaccagagttgtggctagcgagatggccgaagctctgaagggcatgcccatccgctaccaaacaaccgccgtcaaatccgagcatacagggaaggagatcgtggacctgatgtgccacgcgacctttacgatgcggctccttagccctgttagagtgcccaattataacatgattatcatggatgaagcccatttcacagacccttcttccattgctgcccggggctacatcagcacccgcgtcggaatgggcgaggctgccgccatttttatgaccgctacaccccctgggtctgtggaagcgttcccgcagagcaatgccgtgatccaggatgaggaaagagacatccccgagcggtcctggaactctggatatgagtggattaccgattttcctggcaaaacagtctggttcgttcccagcatcaagtccgggaatgacattgctaactgtctgcgcaaaaatggaaagagagtgatccagctgtctcggaagacctttgatacggaataccagaagaccaagaacaacgactgggactacgtggtcaccacagatattagcgagatgggcgccaatttcagagccgaccgcgtgatcgatcctcggagatgcctcaaacccgttattctgaaggacgggccggaacgcgtgatccttgctggccctatgcccgtcaccgtggcctccgcggctcagcggagaggacgcatcggccggaaccacaataaagagggggatcagtatatttacatgggacagcccctgaacaatgacgaggatcatgcccactggacggaagccaagatgctcctggacaacatcaatacccctgagggcattatccccgctctgttcgaacctgagagagaaaagagcgccgcgattgatggggagtatcgcctcagaggagaggcccggaaaacatttgttgaacttatgcgcagaggcgacctgccggtgtggctgtcttacaaggtcgcttccgaggggttccaatatagcgatcggcgctggtgctttgacggcgaaagaaacaatcaggtgctcgaggaaaacatggatgtcgagatctggaccaaagagggagaacggaagaaactgagaccccgctggcttgacgcccggacatactccgaccctctggctctcagagagttcaaggaatttgccgctggccgccggtctgtgagcggggatctgatcctggagattggaaaactcccccagcaccttacccagagagcccaaaatgcgctggacaacctggttatgctccataattccgaacagggcgggcgggcctatcgccacgctatggaggagctgcctgatacaatcgaaacccttatgctgctcgccctgattgctgtgctgacgggaggcgtgacactcttctttctttctggcagagggctgggaaagaccagcatcggcctgctctgtgtcatggcctccagcgttctgctttggatggcctctgtggagccccattggattgctgcgtccatcatcctggagttctttctcatggtgctgctgattccggagcctgaccggcagcgcacaccccaggataaccaactcgcctacgtcgtgatcgggcttctgttcatgattctgacagttgctgccaatgagatgggactcctggaaaccacaaagaaagaccttggcatcgggcacgtggccgtcgagaaccaccatcacgctgccatgctggatgtggacctccatcctgcgagcgcctggacgctgtacgctgtcgccaccacaattatcacccccatgatgagacacacaattgaaaacaccacggctaatatctctctgaccgccatcgcgaaccaggccgctattctcatgggacttgataagggctggcctatctccaaaatggacattggcgtgcccctgctggccctcgggtgctatagccaggttaatccgctgacacttaccgctgccgtgctgatgctcgtcgctcattacgccatcattggacctggcctgcaagcgaaggccacacgggaggctcagaaacgcaccgccgctgggatcatgaagaaccccacggtggatggaatcgttgccattgacctggatcccgtggtctatgacgccaagtttgaaaaacagctcggccagatcatgcttctgattctgtgtacatctcaaatcctcctgatgagaaccacatgggcgctttgcgagagcattaccctggctaccgggcctctcacaacgctgtgggagggatccccgggcaagttctggaataccacaatcgccgtgtctatggctaacatctttcggggcagctacctggccggggccggactcgctttctcccttatgaaaagcctgggcgggggacgcagaggcaccggggcccagggagaaacactgggcgagaagtggaaacggcagctcaatcagctgtccaagtctgagttcaacacctataagagaagcggcattatggaggtggaccgctccgaagcgaaagaggggcttaagcggggagagacgacaaaacacgccgtttctagaggcaccgctaagctgcgctggtttgtcgaacggaatctcgtgaaacccgaggggaaggtgatcgatctgggatgtggcagagggggatggagctactattgcgccggcctgaagaaagtcaccgaagttaagggctacacaaaagggggacctggccacgaggaacccattcctatggctacctacgggtggaacctcgtgaaacttcattccggaaaagacgtgttctttattccccctgagaagtgtgatacactgctgtgcgacattggcgagtctagcccgaatcccacgatcgaagaggggcgcaccctccgggtcctgaaaatggtggaaccttggcttagaggaaaccaattctgtattaagatcctgaatccctatatgccttccgttgtggagacactcgagcagatgcagcgcaagcacggcggcatgctggtccggaaccccctgagcagaaattctacccatgaaatgtactgggtgtcctgcgggacaggaaacatcgttagcgccgtgaatatgacctctcgcatgctcctgaaccggtttacgatggcgcacagaaaaccgacctatgagcgcgatgtcgaccttggcgccgggacaagacacgtggctgtggaacctgaggtcgccaacctggatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctcctgaccaagccttgggacgtgattcccatggttacacaaatcgctatgaccgatacgacacctttcggccagcagcgcgtgtttaaagagaaggtcgacaccagaaccccgaaagccaagcggggcacagcgcaaatcatggaagtgacggccaaatggctttgggggttcctgagcagaaacaagaagccccggatttgtacccgcgaggaatttacaagaaaagttcggtctaatgctgccatcggagctgtgttcgtcgacgagaaccagtggaatagcgccaaggaggccgtggaagatgagcgcttttgggacctcgttcatagagaacgggagctgcacaaacagggcaagtgcgcgacctgcgtgtacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtcgagggggagggactccataaactgggctatatccttagagacatttctaagatccctgggggaaatatgtacgccgatgacacagctggctgggatacccggatcacagaagacgatctgcagaacgaggcccgcattaccgacatcatggaacccgagcacgcgctcctggccaaaagcattttcaagctgacgtatcaaaataaagtggtcagagtgcagcggcctgctaagaacgggaccgttatggatgtgatctcccgcagagaccagcggggctctggacaggtcggcacatacgggctcaatacctttacaaacatggaagcccaactgattagacagatggagagcgagggaatcttctcccccagcgaacttgagaccccgaacctggctaagcgcgtgctcgattggctggaaaaatatggcgtggagcggcttaagagaatggccatctctggggacgactgtgttgtgaaacctattgatgaccgctttgcgacggccctgacagctctcaatgatatgggaaaggtccggaaagacatcccccagtgggaaccttccaagggctggaacgattggcagcaagtgcccttctgcagccatcactttcaccagctgattatgaaggacgggagagagatcgttgtgccttgtcgcaatcaggatgagctggtcggccgggccagagtgtctcagggagctggctggtccctccgcgaaaccgcctgcctggggaaaagctacgctcaaatgtggcagcttatgtatttccatcggagagacctgcgcctcgccgcgaacgccatttgttccgctgtccccgtggattggatcccgacatctcggaccacgtggagcattcacgcccatcaccagtggatgaccacagaggacatgctgtccgtttggaatagagtgtggatcgaagagaacccttggatggaagataagacccatatcagctcttggggagacgtcccctaccttggcaaacgggaggaccaatggtgcgggtccctgattggactcacagccagagctacctgggccacaaatatccaggtggcgattaaccaggttcgccggctgatcggcaatgagaactacctggattatatgaccagcatgaagagatttaaaaatgaatctgaccccgagggggctctctggtga

SEQ ID NO: 18831 - RNA, 9879 nt, synthetic construct
  misc_feature 1..9879: note = derived and/or modified CDS sequence (opt5) from DENV-1__EU677158__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagctatacccaggtctgcgaccaccggctcatgtccgcggccatcaaagatagcaaggctgttcacgccgacatgggctactggatcgaatctgagaaaaatgaaacatggaagctggccagagcttccttcattgaggtgaagacctgtatctggcccaaaagccatacactgtggtctaacggggtgctcgaatccgagatgattatcccgaagatttatggaggccctatcagccaacacaattaccgccccgggtacttcacccagacggccggaccttggcatctgggcaaacttgagctggattttgacctctgcgaagggaccacagtcgtggttgatgagcactgcggaaaccggggcccctctctgagaaccacaaccgtgacgggcaagatcattcacgaatggtgttgccggagctgtacactgcctccccttcgcttcagaggggaggacggatgctggtatggcatggagatccggccggtcaaagaaaaggaggaaaatctcgtgaagtccatggttagcgcggggtctggagaggtggactcctttagcctgggcctgctctgtatttccatcattatcgaagaggtcatgagatctcgctggagccggaaaatgctgatgaccgggacacttgctgtgttcgttctgctcattatgggacagctgacctggaacgatctgatcagactttgcatcatggtgggcgccaatgcctccgaccgcatgggcatggggaccacatacctggctctcatggccacgtttaagatgagacctatgttcgcggtcggactgctctttcggcgcctgacctctagagaggtgcttctgctcacaattggcctgagcctggtggcttccgtcgaacttcccaactctctggaggaactcggggatggactggccatgggcatcatgattctcaaactgcttaccgacttccaaagccatcagctgtgggccacactcctgtccctgacctttatcaagacgacattcagccttcactatgcttggaaaaccatggccatggttctgtctattgtgtccctctttcccctgtgtctcagcaccacatctcagaagaccacatggctgcctgtgcttctggggtccctgggatgcaagccgctcacgatgttcctgatcgctgagaataaaatctggggccggcgcagctggccccttaacgaaggcattatggccgtcgggatcgtgtctattctgctctccagcctgctcaagaacgatgttcctctggcgggaccccttatcgccggcgggatgctgattgcttgttacgtgatctccggaagctctgccgacctgagcctcgagaaagctgccgaggtctcctgggaagaggaagccgagcattctggcgctagccacaatatcctggtggaagttcaggatgacgggaccatgaagattaaagatgaggagagagacgatacacttaccatcctgctcaaggcgacactgctcgccgtgtccggagtctatcctctgtctattcccgctaccctttttgtgtggtacttctggcagaagaagaagcagcggagcggcgtcctgtgggacacgcctagccctcccgaagtggagcgcgccgttctggatgacggcatctatagaattatgcagcgggggctcctgggacgctctcaggtgggcgtcggggtgttccaagaaaacgtttttcataccatgtggcacgtgacaagaggagccgtccttatgtaccagggcaaacggctggagcccagctgggcttccgtgaagaaagacctcatcagctacgggggaggctggagactgcagggctcttggaataccggggaggaagtgcaggttattgccgtcgagcccggaaagaaccctaaaaatgtgcaaacagcgcccggcaccttcaagacaccggaaggggaggtgggagctatcgccctcgattttaagcctggcacgtccgggagccccatcgtcaaccgcgaaggaaaaattgtgggcctgtatggcaatggggttgtgaccacatctggaacctacgtctccgccatcgctcaggccaaggcgagccaggagggccctcttcccgagattgaagacgaggtgttccggaaaagaaacctgaccatcatggatctgcaccccgggtccggaaagacacgccggtatctccctgctattgttagagaagccatcaaacgcaagctgcggacgcttatcctggccccgaccagagtggtcgcttctgagatggccgaagctctcaagggcatgcccattcgctaccaaacaaccgccgtgaaaagcgagcatacagggaaggagatcgttgacctgatgtgccacgcgacctttacgatgcggctgctctcccctgtgagagtccccaattataacatgattatcatggatgaagcccatttcacagaccctagctctattgctgcccggggctacatctccacccgcgtgggaatgggcgaggctgccgccatctttatgaccgctacaccccctgggagcgtggaagcgttcccgcagtctaatgccgtcattcaggatgaggaaagagacatccccgagcggagctggaactccggatatgagtggattaccgattttcctggcaaaacagtttggttcgtgccctctatcaagagcgggaatgacattgctaactgtcttcgcaaaaatggaaagagagtgatccagctgtcccggaagacctttgatacggaataccagaagaccaagaacaacgactgggactacgtcgtgaccacagatatttctgagatgggcgccaatttcagagccgaccgcgttatcgatcctcggagatgcctgaaacccgtgatcctcaaggacgggccggaacgcgtcattctggctggccctatgcccgtgaccgttgccagcgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgttcgaacctgagagagaaaagtccgccgcgatcgatggggagtatcgcctgagaggagaggcccggaaaacatttgtggaactcatgcgcagaggcgaccttccggtctggctgagctacaaggtggcttctgaggggttccaatattccgatcggcgctggtgctttgacggcgaaagaaacaatcaggtcctggaggaaaacatggatgtggagatttggaccaaagagggagaacggaagaaactcagaccccgctggctggacgcccggacatacagcgaccctcttgctctgagagagttcaaggaatttgccgctggccgccggtccgtttctggggatctcatcctggagattggaaaactgccccagcacctcacccagagagcccaaaatgcgcttgacaacctggtgatgctgcataatagcgaacagggcgggcgggcctatcgccacgctatggaggagctccctgatacaatcgaaaccctgatgcttctggccctcattgctgtgctgacgggaggcgtcacactgttctttctctccggcagagggcttggaaagacctctatcggcctgctgtgtgttatggccagctccgtgctcctgtggatggccagcgtggagccccattggatcgctgcgtctattatccttgagttctttctgatggtcctcctgattccggagcctgaccggcagcgcacaccccaggataaccaactggcctacgtggttatcgggctccttttcatgattctgacagtggctgccaatgagatgggactgctcgaaaccacaaagaaagacctgggcatcgggcacgtcgccgtggagaaccaccatcacgctgccatgcttgatgtcgacctgcatcctgcgtccgcctggacgctctacgctgtggccaccacaattatcacccccatgatgagacacacaatcgaaaacaccacggctaatattagcctgaccgccatcgcgaaccaggccgctattctgatgggactcgataagggctggcctatctctaaaatggacattggcgttccccttctggccctggggtgctattcccaggtgaatccgctcacactgaccgctgccgtccttatgctggtggctcattacgccatcatcggacctggcctccaagcgaaggccacacgggaggctcagaaacgcaccgccgctgggattatgaagaaccccacggttgatggaatcgtggccattgacctggatcccgtcgtgtatgacgccaagtttgaaaaacagctgggccagatcatgctccttattctgtgtacaagccaaatcctgctcatgagaaccacatgggcgctgtgcgagtctatcacccttgctaccgggcctctgacaacgctctgggagggaagcccgggcaagttctggaataccacaattgccgtgtccatggctaacatctttcggggctcttacctggccggggccggactggctttcagcctcatgaaatcccttggcgggggacgcagaggcaccggggcccagggagaaacactgggcgagaagtggaaacggcagctgaatcagctcagcaagtccgagttcaacacctataagagatctggcattatggaggttgaccgcagcgaagcgaaagaggggctgaagcggggagagacgacaaaacacgccgtctccagaggcaccgctaaacttcgctggtttgtggaacggaatctggtgaaacccgaggggaaggtcatcgatctcggatgtggcagagggggatggtcttactattgcgccggcctgaagaaagttaccgaagtgaagggctacacaaaagggggacctggccacgaggaacccattcctatggctacctacgggtggaacctggtgaagctccatagcggaaaagacgtcttctttattccccctgagaagtgtgatacacttctgtgcgacatcggcgagtcctctccgaatcccacgatcgaagaggggcgcaccctgcgggtgctcaaaatggttgaaccttggctgagaggaaaccaattctgtatcaagattcttaatccctatatgcctagcgtggtcgagacactggagcagatgcagcgcaagcacggcggcatgctcgtgcggaaccccctgtccagaaatagcacccatgaaatgtactgggtttcttgcgggacaggaaacatcgtgtccgccgtcaatatgaccagccgcatgctgctcaaccggtttacgatggcgcacagaaaaccgacctatgagcgcgatgtggacctgggcgccgggacaagacacgtggctgtcgaacctgaggttgccaaccttgatattatcggacagcggattgaaaatatcaagcatgagcacaaatctacctggcattacgacgaggataacccctataagacatgggcttaccacggctcctatgaagtgaaacccagcgggtctgcctccagcatggtgaatggagtcgtgaagctgctcaccaagccttgggacgttatccccatggtgacacaaattgctatgaccgatacgacacctttcggccagcagcgcgtctttaaagagaaggtggacaccagaaccccgaaagccaagcggggcacagcgcaaatcatggaagttacggccaaatggctgtgggggttcctttccagaaacaagaagccccggatttgtacccgcgaggaatttacaagaaaagtgcggagcaatgctgccatcggagctgtcttcgtggacgagaaccagtggaactctgccaaggaggccgttgaagatgagcgcttttgggacctggtgcatagagaacgggagctccacaaacagggcaagtgcgcgacctgcgtctacaacatgatggggaaacgcgaaaagaagctgggagagttcggcaaagctaaggggagcagagccatttggtacatgtggctgggcgcccggtttctcgagttcgaagctctgggattcatgaatgaggatcactggttttcccgcgaaaactctcttagcggcgtggagggggagggactgcataaactcggctatatcctgagagacatctccaagattcctgggggaaatatgtacgccgatgacacagctggctgggatacccggatcacagaagacgatcttcagaacgaggcccgcattaccgacatcatggaacccgagcacgcgctgctcgccaaatctattttcaagctgacgtatcaaaataaagtcgtgagagttcagcggcctgctaagaacgggaccgtgatggatgtcatcagccgcagagaccagcggggctccggacaggtgggcacatacgggctgaatacctttacaaacatggaagcccaactcatcagacagatggagtctgagggaattttcagcccctccgaactggagaccccgaaccttgctgaacgcgtgctggattggctcgagaagtatggcgttgaacggctgaaaagaatggccatcagcggggacgactgtgtggtcaagcctattgatgaccgctttgcgacggcccttacagctctgaatgatatgggaaaagtgcggaaggacatcccccagtgggagccttctaaaggctggaacgattggcagcaagttcccttctgctcccatcactttcaccagctcattatgaaggacgggagagagatcgtggtcccttgtcgcaatcaggatgaactggtgggccgggccagagtcagccagggagctggctggtctctgcgcgagaccgcctgcctcgggaagtcctacgctcaaatgtggcagctgatgtatttccatcggagagaccttcgcctggccgcgaacgccatttgtagcgctgtgcccgttgattggatcccgacatcccggaccacgtggtctatccacgcccatcaccagtggatgaccacagaagacatgctcagcgtgtggaatagagtctggattgaggaaaacccttggatggaggataaaacccatatctccagctggggagacgtgccctacctgggcaagcgggaggaccaatggtgcgggtctcttattggactgacagccagagctacctgggccacaaatatccaggttgcgattaaccaggtgcgccggctcatcggcaatgaaaactacctggattatatgacctccatgaaaagatttaagaatgagggggaccccgaaggcgctctgtggtga

SEQ ID NO: 18832 - RNA, 9879 nt, synthetic construct
  misc_feature 1..9879: note = derived and/or modified CDS sequence (opt5) from DENV-1__EU677159__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctattagcatccccgccacactgtttgtctggtacttctggcaaaagaagaaacagagatccggcgtgctttgggacaccccttctcccccggaagtcgagcgggccgtgctggatgacgggatttatcgcatcatgcagagaggactgctcggccggagccaggttggggtgggagtcttccaagaaaacgtgtttcatacgatgtggcacgttacccgcggcgctgtgctgatgtaccaggggaagagacttgagccttcctgggccagcgtcaaaaaggacctgatttcttacggaggcggctggcggctcagagggtcctggaatacaggagaggaagtccaggtgatcgcggttgagcccggcaaaaaccctaagaatgtccagaccgctcccgggacattcaagaccccggaaggagaggtgggcgccattgccctggattttaaacctgggacaagcggatctcccatcgtgaaccgcgaaggcaagatcgtcggcctctatgggaatggagtggttacgacctccggcacatacgtgagcgctattgcccaagcgaaggcttcccaggaggggcctctgcccgagatcgaagacgaggtcttccggaagagaaaccttaccattatggatctgcaccccggatctggcaaaacccgccggtatctgcctgccatcgtgagagaagccattaagcgcaagctccggacactgatccttgctccgacgagagttgtggccagcgagatggctgaagccctgaaagggatgcccatccgctaccagaccacagcggtcaagtccgagcataccggcaaagagattgtggacctcatgtgccacgccacatttaccatgcggctgctgagccctgttagagtgcccaattataacatgatcattatggatgaagctcatttcacggacccttcttccatcgccgctcggggatacattagcacacgcgtcggcatgggggaggccgccgctatctttatgaccgcgacaccccctggatctgtggaagccttcccgcaaagcaatgctgtgatccaggatgaggaaagagacattcccgagcggtcctggaactctggctatgagtggatcacagattttcctgggaagaccgtctggttcgttcccagcattaaatccggaaatgacatcgccaactgtctccgcaagaatggcaagagagtgattcagctttctcggaaaacatttgataccgaataccagaagacgaaaaacaacgactgggactacgtggtcacaaccgatatcagcgagatgggggccaatttcagagctgaccgcgtgattgatcctcggagatgcctgaagcccgttatcctgaaagacggcccggaacgcgtgatcctcgccggacctatgcccgtcacagtggcgtccgctgcccaacggagaggccgcattgggcggaaccacaataaggagggagatcagtatatctacatgggccagcccctgaacaatgacgaggatcatgcccactggaccgaagctaagatgcttctggacaacattaatacgcctgaggggatcattcccgccctcttcgaacctgagagagaaaagagcgcggccgttgatggagagtatcgcctgagaggcgaggctcggaagacctttgtggagctgatgcgcagaggggacctcccggtctggctttcttacaaagtggcctccgagggcttccagtatagcgatcggcgctggtgctttgacggagaaagaaacaatcaagtcctggaggaaaacatggatgtggagatctggacaaaggagggcgaacggaaaaagctgagaccccgctggctcgacgctcggacctactccgaccctctggcccttagagagttcaaagaatttgctgccgggcgccggtctgttagcggagatctgatcctcgagattggcaagctgccccagcacctgacacagagagcgcagaatgccctcgacaaccttgtgatgctgcataattccgaacaagggggacgggcttatcgccacgccatggaggagctgcctgataccatcgaaacactcatgctgcttgctctgattgccgtgctcaccggcggcgtcacgctgttctttctgtctgggagaggactcggcaagacaagcatcgggcttctgtgtgttatggcctccagcgtgctgctctggatggcttctgtggagccccattggattgcggcctccatcatcctggagttctttcttatggtcctgctcattccggagcctgaccggcagcgcacaccccaggataaccagctggcttacgtggttatcggactcctgttcatgattcttaccgtggccgccaatgagatgggcctgctggaaacaaccaaaaaggacctcgggatcggacacgtcgctgtggagaaccaccatcacgccgcgatgctggatgtcgaccttcatcctgccagcgcttggacactgtacgccgtggctacgaccattatcacacccatgatgagacacaccattgaaaacacaaccgccaatatctctctcacggcgatcgccaaccaagctgccattctgatgggcctggataaaggctggcctatctccaagatggacattggggttcccctccttgctctgggatgctatagccaggtgaatccgctgaccctcacagccgctgtcctgatgcttgtggcccattacgcgatcattggccctgggctgcaggccaaagctacccgggaggcccaaaagcgcacagctgccggaatcatgaagaaccccaccgttgatggcatcgtggccattgacctcgatcccgtcgtgtatgacgcgaaatttgaaaagcagctggggcagatcatgctgctcattctttgtacgtctcagatcctgctgatgagaacaacctgggctctctgcgagagcattacactggccaccggacctcttaccacactgtgggagggctccccgggcaaattctggaatacgaccatcgctgtgtctatggccaacatctttcgggggagctacctcgccggagctggcctggccttctccctgatgaaaagcctcgggggaggccgcagagggacaggagcgcaaggcgaaacccttggcgagaaatggaagcggcagctgaatcagctgtccaagtctgagttcaacacatataaaagaagcgggattatggaggttgaccgctccgaagccaaggagggactcaaacggggcgagaccacgaagcacgctgtctctagagggacagccaaactgcgctggtttgtggaacggaatcttgtgaagcccgagggaaaggtcatcgatctgggctgtgggagaggaggctggagctactattgcgctggcctcaaaaaggttaccgaagtgaaagggtacaccaagggaggccctgggcacgaggaacccattcctatggccacatacggatggaacctggtgaaactgcattccggcaaggacgtcttctttattccccctgagaaatgtgataccctcctttgcgacatcggggagtctagcccgaatcccacaatcgaagagggacgcacgctgcgggtgctgaagatggttgaaccttggctcagaggcaaccagttctgtattaagatcctgaatccctatatgccttccgtggtcgaggcgcttgagcaaatgcagcgcaaacacggcgggatgctggtgcggaaccccctcagcagaaattctacccatgaaatgtactgggtttcctgcggaacaggcaacatcgtgagcgccgtcaatatgacctctcgcatgctgctgaaccggtttacaatggctcacagaaagccgacctatgagcgcgatgtggacctcgggacgggaaccagacacgtggccgtcgaacctgaggttgctaacctggatattatcggccagcggattgaaaatatcaaacatgagcacaagtccacatggcattacgacgaggataacccctataaaacctgggcctaccacgggagctatgaagtgaagccctctggatccgctagctccatggtgaatggcgtcgtgaaacttctgacaaaaccttgggacgttattcccatggtgacccagatcgccatgacagataccacgcctttcggccaacagcgcgtctttaaggagaaagtggacacaagaaccccgaaggcgaaacgggggaccgcccagatcatggaagttacagctagatggctctggggattcctgagccggaacaagaagccccgcatttgtacgagagaggaatttacccggaaagtgcgctctaatgccgctatcggcgccgtcttcgtggacgagaaccaatggaatagcgccaaggaggcggttgaagatgagagattttgggaccttgtgcatcgggaacgcgagctgcacaaacaggggaagtgcgctacatgcgtctacaacatgatgggaaaaagagaaaagaagctcggcgagttcgggaaagccaagggctcccgggccatttggtacatgtggctgggagctcgctttctggagttcgaagccctcggcttcatgaatgaggatcactggttttctagagaaaacagcctgtccggggtggagggagagggccttcataaactggggtatatcctccgggacatttctaagatccctggaggcaatatgtacgctgatgacaccgccgggtgggatacacgcatcaccgaagacgatctgcagaacgaggcgaaaattacagacatcatggaacccgagcacgcccttctggctaaggccattttcaaactcacctatcagaataaggtcgtgagagttcaacggcctgctaagaacggcacggtgatggatgtcatcagccgcagagaccagcggggatccggccaggtggggacctacggactgaatacatttaccaacatggaagcccagctgattagacaaatggagtctgagggcatcttcagcccctccgaactcgagacaccgaacctggcggaacgcgcccttgattggctggggaaatatggagtggagcggctcaagagaatggctatcagcggcgacgactgtgttgtgaaacctattgatgaccgctttgccaccgctctgacggcccttaatgatatggggaaggtccggaaagacatcccccagtgggaaccttctaagggctggaacgattggcaacaggtgcccttctgctcccatcactttcaccaactgattatgaaggacggaagagagatcgttgtgccttgtcgcaatcaggatgagctcgtcggccgggctagagtgagccagggggccggatggtctctgcgcgaaacagcgtgcctgggcaaatcctacgcccagatgtggcaactcatgtatttccatcggagagacctgcgccttgctgccaacgccatttgtagcgctgtccccgtggattgggttccgacctcccggacaacctggtctatccacgcccatcaccagtggatgacgaccgaggacatgctgagcgtgtggaatagagtctggattgaagagaacccttggatggaagataagacacatatctccagctgggaggacgtgccctacctcgggaaacgggaggaccagtggtgcggatctctgatcggccttaccgcgagagctacatgggccaccaatattcaagttgccatcaaccaggtgcgccggctgattgggaatgaaaactacctcgattatatgatctccatgaagagatttaaaaatgagagcgaccccgaaggcgctctgtggtga

SEQ ID NO: 18833 - RNA, 9879 nt, synthetic construct
  misc_feature 1..9879: note = derived and/or modified CDS sequence (opt5) from DENV-1__EU677160__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcgtcctggtgacccctagcatggctatgagatgcgttggcattgggtcccgggatttcgtggagggacttagcggcgccacatgggtcgacgtggtgctggagcacgggtcttgtgtcacgaccatggctaaggataaacccacactcgacatcgaactgctgaagaccgaggttacaaaccctgccgtgctccgcaaactgtgcattgaagcgaagatctccaataccacgacagatagcagatgtccgacccaaggagaggccacccttgtggaagaacaagacgctaactttgtctgccggcgcacattcgtggatagaggctggggcaatgggtgtggactgtttggcaaagggtctctcattacctgcgccaagttcaagtgcgttacaaaactggagggaaagacggtgcagtacgaaaaccttaaatattccgtcatcgtgaccgttcacacaggcgaccagcatcaagtggggaatgagagcaccgaacacggaacaaccgctacgatcacaccccaggccccttctacagagattcagctgaccgactacggcgccctcacactggattgtagcccccggaccggcctggactttaacgaaatggtcctcctgacgatgaaggagaaaagctggcttgtgcataagcagtggttcctggatctccctctgccctggacatccggggcttctaccagccaagagacatggaatcgcaaagaccttctggtcacctttaagaccgcgcacgccaagaaacaggaagtggttgtgctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtcatgtgtacaggctccttcaagctggagaaggaagtggccgagacccagcacggaaccgttctcgtgcagatcaaatacgagggcacagacgcgccgtgcaagattccttttagcacccaggatgaaaaaggggtcacacaaaacggacggctgatcacggctaatcccatcgtgaccgacaaggagaaacctgtgaacattgaagccgagccgcccttcggcgagtcttatatcgttattggggccggagaaaaggctctgaaacttagctggtttaaaaagggctcctctatcgggaaaatgttcgaggccacagctagaggcgcccgccggatggcgattctcggagataccgcctgggactttggcagcatcgggggagtcttcacatccgtgggcaagctggtgcatcagatctttgggaccgcttacggagtcctgttcagcggcgtgtcttggacgatgaaaattgggatcggcgttctcctgacctggcttggactcaattccagaagcacatctctctccatgacctgtattgccgtgggcctggtcacactgtaccttggggtgatggttcaggctgatagcggatgcgtgatcaactggaagggccgcgaactcaagtgtgggtccggaatttttgtcaccaatgaggtgcacacatggaccgaacagtataaattccaagccgactctcctaagcggctgagcgcggccatcggcaaggcttgggaggagggggtttgcggcattagatccgccacgcgcctggaaaacatcatgtggaagcagatctctaacgagctcaatcatattctgcttgaaaacgacatgaaatttacagtggtcgtgggagatgtggctggcatcctggcccaggggaagaaaatgattcggccgcagcccatggagtacaagtatagctggaagtcctggggaaaagccaagatcattggcgctgacgtccaaaataccaccttcatcatcgatgggcctaacacacccgaatgtcctgacgatcagagagcgtggaatatttgggaggttgaggactacggatttggcatcttcaccacgaacatttggctcaaactgcgcgatagctatacacaggtgtgcgaccaccggctgatgtctgccgctatcaaggattccaaagccgtgcacgccgacatgggctactggattgaaagcgagaagaatgaaacctggaaacttgctagagcctctttcatcgaggtcaaaacatgtatctggcccaagtcccataccctctggagcaacggggtgctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgttgtggtcgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggttaaggaaaaagaggaaaatctggtgaagtctcttgtctccgctgggagcggagaggtggactccttctctctcggcctgctgtgtattagcatcatgattgaagaggttatgcggtccagatggtctcgcaaaatgctcatgacagggaccctggccgtgtttttccttctgatcatgggacagctcacatggaacgatctgattcggctgtgcatcatggtcggcgccaatgctagcgacagaatgggcatggggaccacctaccttgccctgatggcgacatttaagatgcgccctatgttcgctgtgggactcctgtttagacggctcacgtcccgcgaggtgctgcttctgaccattggcctctctctggtcgccagcgttgaactgcccaactcccttgaggaactgggggatggactcgccatgggcatcatgatcctgaaactcctgacagacttccagagccatcaactttgggctaccctgctctctctgacatttattaagaccacgttctccctgcactatgcctggaagacaatggctatggtgcttagcatcgtgtctctgtttcccctctgtctgtccaccaccagccagaaaacaacctggctccctgtcctgcttgggtctctgggatgcaagccgctgacaatgttcctcattgccgagaataaaatctggggcagaaagtcctggcccctgaacgaaggcattatggcggtggggatcgttagcatccttctgtccagcctcctgaaaaacgatgtgcctctcgccggacccctgattgctggcgggatgcttatcgcctgttacgtcatttctggaagctccgctgacctgtctctggagaaggccgccgaggtgagctgggaagaggaagctgagcattccggcgcgtctcacaatatcctcgttgaagtgcaggatgacgggacgatgaaaattaaggatgaggagcgggacgataccctgacaatccttctgaaggccaccctcctggctgtcagcggagtgtatcctctctccatccccgccacactgttcgtctggtacttttggcagaaaaagaaacaacgctctggcgtgctttgggacaccccttcccctcccgaagttgagagagccgtgctggatgacggcatttatcggatcatgcagcgcgggctgctcggaagatcccaggtcggcgtgggggttttccaggaaaacgtgtttcatacgatgtggcacgtcacccggggagctgtgctgatgtaccaaggcaagcgccttgagcccagctgggcctctgtgaaaaaggacctgatttcctacgggggaggctggagactccagggcagctggaatacaggggaggaagttcaggtcatcgcggtggagcccggaaagaaccctaaaaatgtgcagaccgctcccggcacattcaagacctctgaaggggaggtcggagccattgccctggattttaaaccgggcacatccgggagccctatcgtgaaccgggaaggaaagattgttggcctctatggcaatggggtggtcacgacctccggaacatacgtgtctgctatcgcccaagcgaaagctagccaggagggccccctgcctgagatcgaagacgaggttttcagaaagcgcaaccttaccattatggatctgcaccccgggtccggaaagacccggagatatctgcccgccatcgtgcgcgaagccattaaacggaagctcagaacactgatccttgctcctacgcgcgtcgtggccagcgagatggctgaagccctgaaaggcatgccgattcggtaccagaccacagcggttaagtctgagcataccgggaaagagatcgtggacctcatgtgccacgccacatttaccatgagactgctgtcccccgtccgcgtgcctaattataacatgatcattatggatgaagctcatttcacggaccccagctctatcgccgctcggggctacattagcacaagagtgggaatgggcgaggccgccgctatctttatgaccgcgacccctcccgggtccgtcgaagccttccctcaatctaatgctgttattcaggatgaggaacgggacatcccggagcgcagctggaactccggatatgagtggatcacagattttcccggcaagaccgtgtggttcgtgccttctattaagagcgggaatgacatcgccaactgtctccgcaagaatggaaagcgggtcattcagctttcccgcaaaacattcgataccgaataccagaagacgaaaaacaacgactgggactacgtggttacaaccgatatcagcgagatgggcgccaattttagagctgaccgggtgattgatcccagacgctgcctgaagcctgtcatcctgaaggacgggcccgaacgggtgattctcgccggcccgatgcctgttacagtggcgtctgctgcccaaagacgcggacggatcggcagaaaccacaataaagagggggatcagtatatctacatgggacagcccctgaacaatgacgaggatcatgcccactggaccgaagctaagatgcttctggacaacattaatacgcccgagggcatcattcctgccctcttcgaacccgagcgcgaaaaatccgcggccatcgatggggagtatcggctgagaggagaggctcgcaagacctttgtcgaactgatgagacggggcgacctccctgtgtggcttagctacaaagtcgcctccgaggggttccagtattctgatcgcagatggtgctttgacggcgaacggaacaatcaagtgctggaggaaaacatggatgttgagatttggacaaaggagggagaacgcaaaaagctgagaccgcggtggctcgacgctagaacctacagcgaccccctggcccttcgcgagttcaaggaatttgctgccggccggagatccgtgtctggggatctgatcctcgagatcggaaaactgcctcagcacctgacacagcgcgcgcagaatgccctcgacaaccttgtgatgctgcataatagcgaacaaggcgggcgggcttatagacacgccatggaggagctgcccgataccattgaaacactcatgctgcttgctctgatcgccgtcctcaccggaggcgttacgctgttctttctgtccggccgggggctcggaaagacaagcattggccttctgtgtgtgatggcctcttccgtgctgctctggatggctagcgtcgagcctcattggatcgcggcctctattatcctggagttctttcttatggtgctgctcatccccgagccggaccgccagagaacccctcaggataaccagctggcttacgttgtgattgggctgctgttcatgatccttaccgtcgccgccaatgagatgggactgctggaaacaaccaaaaaggacctcggcattgggcacgtggctgtcgagaaccaccatcacgccgcgatgctggatgtggaccttcatcccgcctccgcttggacactgtacgccgttgctacgaccatcattacacctatgatgcggcacaccatcgaaaacacaaccgccaatattagcctcacggcgatcgccaaccaagctgccatcctgatgggactggataaaggctggcccatttctaagatggacatcggcgtgcctctccttgctctggggtgctatagccaggtcaatcccctgaccctcacagccgctgtgctgatgcttgttgcccattacgcgattatcggaccgggcctgcaggccaaggctacccgcgaggcccagaagagaacagctgccgggattatgaagaaccctaccgtggatggaatcgtcgccatcgacctcgatcccgtggtgtatgacgcgaaatttgaaaagcagctgggccagattatgctgctcatcctttgtacgtcccagattctgctgatgcggacaacctgggctctctgcgagtctatcacactggccaccgggccccttaccacactgtgggagggaagccctggcaaattctggaatacgaccattgctgtttccatggccaacatcttccgcggcagctacctcgccggggctggactggccttttccctgatgaagtctctcggcgggggaagacggggcacaggggcgcaaggagaaacccttggcgagaagtggaaacgccagctgaatcagctgagcaagtccgagttcaacacatataaaagatctggcatcatggaggtcgaccggagcgaagccaaggaggggctcaaaagaggagagaccacgaagcacgctgtgtcccgcggcacagccaagctgcggtggtttgtggaaagaaatcttgtcaaaccggaggggaaggttattgatctgggatgtggccgcgggggatggtcttactattgcgctggcctcaaaaaggtgaccgaagtgaaaggctacaccaaagggggacccggccacgaggaacctatccccatggccacatacgggtggaacctggtcaaactgcatagcggaaaggacgtgttctttattcctcccgagaagtgtgataccctcctttgcgacatcggcgagtccagccctaatccgacaattgaagaggggcggacgctgagagttctgaaaatggtggaaccctggctccgcggaaaccagttctgtatcaagattctgaatccttatatgccctctgtcgtggagacccttgagcaaatgcagcggaaacacggcggcatgctggttagaaaccctctctcccgcaatagcacacatgaaatgtactgggtgtcttgcgggaccggaaacatcgtctccgcggtgaatatgacaagccggatgctgctgaacagatttaccatggcccaccgcaagcccacgtatgagcgggatgtggacctcggcgctgggaccagacacgtcgccgttgaaccggaggtggctaacctggatatcattggacagcgcatcgaaaatattaaacatgagcacaagtctacatggcattacgacgaggataacccttataagacctgggcctaccacggctcctatgaagtgaaacccagcgggtccgctagctctatggtcaatggagtggttaaacttctgacaaaaccctgggacgtgatccctatggtcacccagattgccatgacagataccacgcccttcggccaacagagagtgtttaaggagaaagttgacacacggacccctaaggcgaagcgcggcaccgcccagatcatggaagtgacagctaaatggctctgggggttcctgagcagaaacaagaaaccgcggatctgtacgagagaggaatttacccggaaggtccgctccaatgccgctattggagccgtgttcgttgacgagaaccaatggaactctgccaaagaggcggtggaagatgagagattttgggaccttgtccatcgggaacgcgagctgcacaagcagggcaagtgcgctacatgcgtgtacaacatgatggggaaaagagaaaagaaactcggagagttcggcaaggccaaagggagccgggccatctggtacatgtggctgggcgctcgcttcctggagtttgaagccctcggattcatgaatgaggatcactggttttccagagaaaactctctgagcggcgtcgagggggagggacttcataagctgggctatattctccgggacatctccaaaattcccgggggaaatatgtacgctgatgacaccgccggctgggatacacgcatcaccgaagacgatctgcagaacgaggcgaagatcacagacattatggaacctgagcacgcccttctggctaagtctatcttcaaactcacctatcagaataaggtggttagagtgcaacggcccgccaaaaacgggacggtcatggatgtgattagccgcagagaccagcggggctccggacaggtgggcacctacgggctgaatacatttaccaacatggaagctcagctgatccgccaaatggagagcgagggaattttctctccttccgaactcgagacacccaacctggccagacgggttcttgattggctggaaaagcatggcgtggagagactcaaacgcatggcgatcagcggggacgactgtgtcgtgaagccgatcgatgaccggtttgccaccgctctgacggcccttaatgatatgggaaaggttagaaaagacattcctcagtgggaaccctctaagggctggaacgattggcaacaggtgcctttctgctcccaccactttcatcaactgatcatgaaagacgggcgcgagattgtcgtgccctgtcggaatcaggatgagctcgtcggcagagctcgcgtgagccagggagccggctggtccctgcgggaaacagcttgcctggggaagtcttatgcccagatgtggcaactcatgtacttccacagacgcgacctgcggcttgcggccaacgctatctgtagcgccgttcctgtggattgggtccccacctccagaacaacctggagcattcatgcccaccatcagtggatgacgaccgaggacatgctgtctgtgtggaatcgcgtttggatcgaagagaacccgtggatggaagataaaacacacatttccagctggggagacgtgccttatctcggcaagcgggaggaccagtggtgcgggtctctgatcggacttaccgctagagccacatgggcgaccaatatccaagtcgctattaaccaggtgcggagactgatcggcaatgagaactacctcgattacatgacaagcatgaagcgctttaaaaatgaatccgaccccgagggggccctgtggtga

SEQ ID NO: 18834 - RNA, 9879 nt, synthetic construct
  misc_feature 1..9879: note = derived and/or modified CDS sequence (opt5) from DENV-1__EU677162__SS-prME
  source 1..9879: mol_type = other RNA
agcgtgaccatgctgctgatgctgatgcccacagcccttgctttccacctgacgacccggggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggagaatgttcgaggccaccgctcgcggcgcccggagaatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattcccgcagcacctctctctccatgacatgtatcgccgttggcctggtgaccctgtaccttggggtcatggtgcaggctgatagcggatgcgttattaactggaaaggccgggaactcaagtgtgggtccggaatctttgtgacaaatgaggtccacacctggacagaacagtataagttccaagccgactctcctaaaagactgagcgcggccattggcaaggcttgggaggagggggtgtgcggcatccgctccgccacccggctggaaaacatcatgtggaaacagatttctaacgagctcaatcatatcctgcttgaaaacgacatgaagtttacggttgtggtcggagatgtggctggcattctggcccaggggaaaaagatgatcagaccgcagcccatggagtacaaatatagctggaagtcctggggaaaggccaaaattatcggcgctgacgtgcaaaatacaaccttcatcattgatgggcctaacacccccgaatgtcctgacgatcagcgcgcgtggaatatctgggaggtcgaggactacggatttggcattttcacaaccaacatctggctcaagctgcgggatagctatacgcaggtttgcgaccacagactgatgtctgccgctattaaagattccaaggccgtgcacgccgacatgggctactggatcgaaagcgagaaaaatgaaacatggaaacttgctcgcgcctctttcatcgaggtgaagacctgtatttggcccaaatcccatacactctggagcaacggggtcctggaatctgagatgatcattccgaagatctatggaggccctattagccagcacaattaccggcccgggtactttacccaaacagcgggaccttggcatctgggcaaactcgagctggatttcgacctttgcgaagggaccacggtggttgtggatgagcactgcggaaacagaggcccctccctgcggaccacaaccgtcacaggcaagatcatccacgaatggtgttgccgcagctgtaccctccctcccctgagatttaaaggggaggacggatgctggtatggcatggagattcggccggtgaaggaaaaggaggaaaatctggttaaatctatggtgtccgctgggagcggagaggtcgactccttctctcttggcctcctgtgtatcagcattatgatcgaagaggtgatgagatcccgctggtctcggaagatgctgatgacggggacactcgccgtctttttcctgcttattatgggacagctgacctggaacgatctcatcagactgtgcattatggtgggcgccaatgctagcgaccgcatgggcatggggacaacctacctggcccttatggcgacctttaaaatgagacctatgttcgctgtcggactgctctttcggcgcctgacatccagagaggtgctcctgcttacgatcggcctgtctctcgtggccagcgtcgaactgcccaactccctggaggaacttggggatggactggccatgggcatcatgattctcaagctgctcaccgacttccagagccatcaactgtgggctacacttctgtctctcacctttatcaaaacaaccttctccctgcactatgcctggaagacgatggctatggttctgagcattgtgtctctttttcccctgtgtctctccacaaccagccagaagaccacatggctgcctgtgctcctggggtctcttggatgcaaaccgctgaccatgttcctgatcgccgagaataagatttggggccggaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggacaatgaagatcaaagatgaggagcgcgacgatacgctcaccatcctgcttaaggccacactgctcgctgtgagcggagtctatcctctgtccattcccgccaccctcttcgtgtggtacttttggcagaagaaaaagcaaagatctggcgtcctgtgggacacaccttcccctcccgaagtggagcgggccgttcttgatgacggcatctatcgcattatgcagagagggctgctgggacggtcccaggtgggcgtcggggtgttccaggaaaacgtttttcataccatgtggcacgtgacgcgcggagctgtcctcatgtaccaaggcaaaagactggagcccagctgggcctctgtgaagaaagaccttatctcctacgggggaggctggcggctgcagggcagctggaataccggggaggaagtgcaggttattgcggtcgagcccggaaagaaccctaagaatgtgcagacagctcccggcaccttcaaaacatctgaaggggaggtgggagccatcgccctcgattttaagccgggcacctccgggagccctattgtcaacagagaaggaaaaatcgtgggcctgtatggcaatggggttgtgacaacgtccggaacctacgtctctgctatcgcccaagcgaaggctagccaggagggccccctccctgagattgaagacgaggtgttccgcaaacggaacctgacaatcatggatcttcaccccgggtccggaaagaccagacgctatctgcccgccattgttcgggaagccatcaagagaaaactgcgcaccctcattctggctcctacacgggtggtcgccagcgagatggctgaagcccttaagggcatgccgatcagataccagacgaccgcggtgaaatctgagcatacagggaaggagatcgttgacctgatgtgccacgccacctttacaatgcgcctcctgtcccccgtgcgggtccctaattataacatgattatcatggatgaagctcatttcaccgaccccagctctattgccgctagaggctacatcagcacgcgggtgggaatgggcgaggccgccgctatttttatgacagcgacccctcccgggtccgtggaagccttccctcaatctaatgctgtcatccaggatgaggaacgcgacatcccggagagaagctggaactccggatatgagtggattaccgattttcccggcaaaacagtttggttcgtgccttctatcaagagcgggaatgacattgccaactgtctgcggaagaatggaaaacgcgtgatccagctctccagaaagaccttcgatacagaataccagaaaaccaagaacaacgactgggactacgtcgtgacgacagatattagcgagatgggcgccaattttcgggctgacagagttatcgatccccgccggtgccttaaacctgtgattctgaaggacgggcccgaaagagtcatcctggccggcccgatgcctgtgaccgttgcgtctgctgcccaacgccggggaagaatcggccgcaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgggaaaagtccgcggccattgatggggagtatagactccgcggagaggctagaaaaacgtttgtggaactgatgcggcgcggcgacctgcctgtctggctcagctacaaggtggcctccgaggggttccagtattctgatagacggtggtgctttgacggcgaacgcaacaatcaagtccttgaggaaaacatggatgtggagatctggaccaaagagggagaaagaaagaaactgcggccgagatggctggacgctcgcacatacagcgaccccctcgccctgcgggagttcaaggaatttgctgccggcagacgctccgtttctggggatcttatcctggagattggaaagctccctcagcacctgacccagcgggcgcagaatgccctggacaacctcgtgatgcttcataatagcgaacaaggcgggagagcttatcggcacgccatggaggagctgcccgatacaatcgaaaccctgatgctcctggctcttattgccgtgctgacaggaggcgtcaccctcttctttctgtccggccgcgggctgggaaaaacgagcatcggcctcctttgtgttatggcctcttccgtgctgctgtggatggctagcgtggagcctcattggattgcggcctctatcatcctcgagttctttctgatggtccttctgattcccgagccggacagacagcggacacctcaggataaccagctcgcttacgtggttatcgggctgctgttcatgattctcaccgtggccgccaatgagatgggacttctggaaaccacaaagaaagacctgggcatcgggcacgtcgctgtggagaaccaccatcacgccgcgatgctcgatgtcgacctgcatcccgcctccgcttggaccctttacgccgtggctacaacgattatcacccctatgatgcgccacacaattgaaaacaccacagccaatatcagcctgaccgcgatcgccaaccaagctgccattctcatgggactggataagggctggcccatctctaaaatggacattggcgttcctctgctcgctcttgggtgctatagccaggtgaatcccctgacgctgaccgccgctgtcctcatgctggtggcccattacgcgatcattggaccgggccttcaggccaaggctacaagagaggcccaaaagcggaccgctgccgggatcatgaaaaaccctacagttgatggaatcgtggccattgacctggatcccgtcgtgtatgacgcgaagtttgaaaaacagctcggccagatcatgctgctgattctctgtacctcccagatccttctgatgcgcacgacatgggctctgtgcgagtctattaccctcgccacagggcccctgaccaccctttgggagggaagccctggcaagttctggaatacaacgatcgctgtgtccatggccaacatcttcagaggcagctacctggccggggctggactcgccttttccctgatgaaatctctgggcgggggacggcgcggcaccggggcgcaaggagaaacactcggcgagaagtggaagagacagcttaatcagctgagcaaatccgagttcaacacctataagcggtctggcattatggaggttgacagaagcgaagccaaagaggggctgaagcgcggagagacaaccaaacacgctgtctcccggggcacggccaagctcagatggtttgtggaacgcaatctggtgaagccggaggggaaagtcatcgatcttggatgtggcagagggggatggtcttactattgcgctggcctgaagaaagttacagaagtgaagggctacaccaaagggggacccggccacgaggaacctattcccatggccacctacgggtggaacctcgtgaagctgcatagcggaaaagacgtcttctttatccctcccgagaagtgtgatacactgctctgcgacattggcgagtccagccctaatccgaccatcgaagaggggagaacacttcgcgtgctgaagatggttgaaccctggctgcggggaaaccagttctgtattaaaatcctcaatccttatatgccctctgtggtcgagacgctggagcaaatgcagagaaagcacggcggcatgcttgtgcgcaaccctctgtcccggaatagcacccatgaaatgtactgggtttcttgcgggacaggaaacatcgtgtccgcggtcaatatgaccagcagaatgctcctgaaccgctttacaatggcccaccggaaacccacctatgagagagatgtggacctgggcgctgggacgcgccacgtggccgtcgaaccggaggttgctaacctcgatattatcggacagagaattgaaaatatcaagcatgagcacaaatctacctggcattacgacgaggataacccttataagacatgggcctaccacggctcctatgaagtgaagcccagcgggtccgctagctctatggtgaatggagtcgtgaaactgcttaccaagccctgggacgttattcctatggtgacacagatcgccatgaccgatacaacccccttcggccaacagcgggtctttaaagagaaggtggacacgcgcacacctaaagcgaagagaggcaccgcccagatcatggaagttaccgctaagtggctgtgggggttcctcagccggaacaaaaagccgagaatttgtacacgggaggaatttacgcgcaaagtgagatccaatgccgctatcggagccgtcttcgtggacgagaaccaatggaactctgccaaggaggcggttgaagatgagcggttttgggacctggtgcatcgcgaaagagagcttcacaaacagggcaagtgcgctacctgcgtctacaacatgatggggaagcgggagaagaagctgggagagttcggcaaagccaaggggagccgcgccatttggtacatgtggctcggcgctagattcctggagtttgaagccctgggattcatgaatgaggatcactggttttcccgggaaaactctctcagcggcgtggagggggagggactgcataaacttggctatatcctgcgcgacatttccaagatccccgggggaaatatgtacgctgatgacacagccggctgggataccagaatcacagaagacgatctccagaacgaggcgaaaattaccgacatcatggaacctgagcacgccctgcttgctaagtctattttcaagctgacatatcagaataaagtcgtgcgggttcaacgccccgccaagaacgggaccgtgatggatgtcatcagcagacgggaccagcgcggctccggacaggtgggcacgtacgggctcaatacctttacaaacatggaagctcagctgattagacaaatggagagcgagggaatcttctctccttccgaactggagacccccaacctcgccggccgggtgctggattggcttgaaaaacatggggttgagagactgaagcgcatggcgatcagcggagacgactgtgtggtcaaaccgattgatgaccggtttgccacagctctcaccgccctgaatgatatgggcaaggtgagaaaggacatccctcagtgggaaccctctaaagggtggaacgattggcagcaggttcctttctgctcccaccactttcatcaacttattatgaaggacggccgcgagatcgtggtcccctgtcggaatcaggatgagctggtgggcagagctcgcgtcagccagggagccgggtggtccctccgggaaacggcttgcctgggaaaatcttatgcccagatgtggcaactgatgtacttccacagacgcgacctccggctggcggccaacgctatttgtagcgccgtgcctgttgattgggtgcccacatccagaaccacatggagcatccatgcccaccatcagtggatgaccacggaggacatgctttctgtctggaatcgcgtgtggattgaagagaacccgtggatggaagataagacccacatctccagctggggcgacgttccttatctggggaaacgggaggaccagtggtgcggatctctcatcggcctgacagctagagccacctgggcgacaaatattcaagtggctatcaaccaggtccggagacttattgggaatgagaactacctggattacatgaccagcatgaagcgctttaagaatgaatccgaccccgagggcgccctctggtga

SEQ ID NO: 18835 - RNA, 9879 nt, synthetic construct
  misc_feature 1..9879: note = derived and/or modified CDS sequence (opt5) from DENV-1__EU677164__SS-prME
  source 1..9879: mol_type = other RNA
agcgtgacaatgctgctgatgctgatgcccacagcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggattgcgatcctcggagataccgcctgggactttggcagcatcgggggagttttcacatccgtcggcaagctggtgcatcagatttttgggaccgcttacggagtgctgttcagcggcgtctcttggacgatgaaaatcgggattggcgtgctcctgacctggcttggactcaattccagaagcacatctctctccatgacctgtatcgccgttggcctggtgacactgtaccttggggtcatggtgcaggctgatagcggatgcgttattaactggaagggccgcgaactcaagtgtgggtccggaatctttgtgaccaatgaggtccacacatggaccgaacagtataaattccaagccgactctcctaagcggctgagcgcggccattggcaaggcttgggaggagggggtgtgcggcatcagatccgccacgcgcctggaaaacatcatgtggaagcagatttctaacgagctcaatcatatcctgcttgaaaacgacatgaaatttacagttgtggtcggagatgtggctggcattctggcccaggggaagaaaatgatccggccgcagcccatggagtacaagtatagctggaagtcctggggaaaagccaagattatcggcgctgacgtgcaaaataccaccttcatcattgatgggcctaacacacccgaatgtcctgacgatcagagagcgtggaatatctgggaggtcgaggactacggatttggcattttcaccacgaacatctggctcaaactgcgcgatagctatacacaggtttgcgaccaccggctgatgtctgccgctattaaggattccaaagccgtgcacgccgacatgggctactggatcgaaagcgagaagaatgaaacctggaaacttgctagagcctctttcatcgaggtgaaaacatgtatttggcccaagtcccataccctctggagcaacggggtcctggaatctgagatgatcattccgaaaaattatggaggccctatcagccagcacaactaccgccccgggtactttacacaaaccgcgggaccttggcatctgggcaagctcgagctggatttcgacctttgcgaagggacgaccgtggttgtggatgagcactgcggaaatcggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaacctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgttctgtttcttctgatcatgggacagctcacatggaatgatctgattcggctgtgcatcatggtgggcgccaacgctagcgacagaatgggcatggggaccacctaccttgccctgatggcgacattcaagatgcgccctatgtttgctgtcggactcctgttcagacggctcacgtcccgcgaggtgctgcttctgaccattggcctctctctggtggccagcgtcgaactgcccaattcccttgaggaactgggggatggactcgccatgggcatcatgatcctgaaactcctgacagactttcagagccatcaactttgggctaccctgctctctctgacattcattaagaccacgttttccctgcactatgcctggaagacaatggctatggttcttagcatcgtgtctctgttccccctctgtctgtccaccaccagccagaaaacaacctggctccctgtgctgcttgggtctctgggatgcaagccgctgacaatgtttctcattgccgagaacaaaatctggggcagaaagtcctggcccctgaacgaaggcattatggcggtcgggatcgtgagcatccttctgtccagcctcctgaaaaatgatgttcctctcgccggacccctgattgctggcgggatgcttatcgcctgttacgtgatttctggaagctccgctgacctgtctctggagaaggccgccgaggtcagctgggaagaggaagctgagcattccggcgcgtctcacaacatcctcgtggaagttcaggatgacgggacgatgaaaattaaggatgaggagcgggacgataccctgacaacccttctgaaggccacactcctggctgtgagcggagtctatcctctctccatccccgccaccctgttcgtgtggtacttctggcagaaaaagaaacaacgctctggcgtcctttgggacacgccttcccctcccgaagtggagagagccgttctggatgacggcatctatcggattatgcagcgcgggctgctcggaagatcccaggtgggcgtcggggtgtttcaggaaaatgttttccataccatgtggcacgtgacacggggagctgtcctgatgtaccaaggcaagcgccttgagcccagctgggcctctgtgaaaaaggacctgatctcctacgggggaggctggagactccagggcagctggaacaccggggaggaagtgcaggttattgcggtcgagcccggaaagaatcctaaaaacgtgcagacagctcccggcacctttaagacatctgaaggggaggtgggagccatcgccctggatttcaaaccgggcacgtccgggagccctattgtcaatcgggaaggaaagatcgtgggcctctatggcaacggggttgtgaccacatccggaacctacgtctctgctattgcccaagcgaaagctagccaggagggccccctgcctgagatcgaagacgaggtgtttagaaagcgcaatcttaccatcatggatctgcaccccgggtccggaaagacacggagatatctgcccgccattgttcgcgaagccatcaaacggaagctcagaacgctgattcttgctcctacccgcgtggtcgccagcgagatggctgaagccctgaaaggcatgccgatccggtaccagacaaccgcggtgaagtctgagcatacagggaaagagattgttgacctcatgtgccacgccaccttcacgatgagactgctgtcccccgtgcgcgtccctaactataatatgatcatcatggatgaagctcattttacagaccccagctctattgccgctcggggctacatcagcaccagagtgggaatgggcgaggccgccgctattttcatgaccgcgacacctcccgggtccgtggaagcctttcctcaatctaacgctgtcatccaggatgaggaacgggacattccggagcgcagctggaactccggatatgagtggatcaccgatttccccggcaagacagtttggtttgtgccttctatcaagagcgggaacgacattgccaattgtctccgcaagaatggaaagcgggtgatccagctttcccgcaaaaccttcgatacggaataccagaagaccaagaacaatgactgggactacgtcgtgaccacagatattagcgagatgggcgccaacttcagagctgaccgggttatcgatcccagacgctgcctgaagcctgtgattctgaaggacgggcccgaacgggtcatcctcgccggcccgatgcctgtgaccgttgcgtctgctgcccaaagacgcggacggattggcagaaatcacaacaaagagggggatcagtatatctacatgggacagcccctgaataacgacgaggatcatgcccactggacggaagctaagatgcttctggacaatatcaacacccccgagggcattatccctgccctctttgaacccgagcgcgaaaaatccgcggccattgatggggagtatcggctgagaggagaggctcgcaagacattcgtggaactgatgagacggggcgacctccctgtctggcttagctacaaagtggcctccgaggggtttcagtattctgatcgcagatggtgcttcgacggcgaacggaataaccaagtcctggaggaaaatatggatgtggagatctggaccaaggagggagaacgcaaaaagctgagaccgcggtggctcgacgctagaacatacagcgaccccctggcccttcgcgagtttaaggagttcgctgccggccggagatccgtttctggggatctgattctcgagatcggaaaactgcctcagcacctgacccagcgcgcgcagaacgccctcgacaatcttgtgatgctgcataacagcgaacaaggcgggcgggcttatagacacgccatggaggagctgcccgatacaatcgaaaccctcatgctgcttgctctgattgccgtgctcacgggaggcgtcacactgtttttcctgtccggccgggggctcggaaagaccagcatcggccttctgtgtgttatggcctcttccgtgctgctctggatggctagcgtggagcctcattggattgcggcctctatcattctggaatttttccttatggtcctgctcatccccgagccggaccgccagagaacccctcaggataatcagctggcttacgtggttatcgggctgctctttatgattcttacagtggccgccaacgagatgggactgctggaaaccaccaagaaggacctcggcatcgggcacgtcgctgtggagaaccaccatcacgccgcgatgctggatgtcgaccttcatcccgcctccgcttggacgctgtacgccgtggctaccacaattatcacccctatgatgcggcacacaattgaaaataccacggccaacatcagcctcaccgcgattgccaatcaagctgccatcctgatgggactggataaaggctggcccatctctaagatggacattggcgttcctctccttgctctggggtgctatagccaggtgaaccccctgacactcaccgccgctgtcctgatgcttgtggcccattacgcgatcattggaccgggcctgcaggccaaggctacacgcgaggcccagaaaagaaccgctgccgggatcatgaagaatcctacggttgatggaattgtggccatcgacctcgatcccgtcgtgtatgacgcgaaattcgaaaagcagctgggccagatcatgctgctcattctttgtacatcccagatcctgctgatgcggaccacatgggctctctgcgagtctattaccctggccaccgggccccttacaacgctgtgggagggaagccctggcaaattttggaacaccacaatcgctgtgtccatggccaatattttccgcggcagctacctcgccggggctggactggccttctccctgatgaagtctctcggcgggggaagacggggcaccggggcgcaaggagaaacacttggcgagaagtggaaacgccagctgaaccagctgagcaagtccgaatttaatacctataaaagatctggcatcatggaggttgaccggagcgaagccaaggaggggctcaaaagaggagagacgacaaagcacgctgtctcccgcggcaccgccaagctgcggtggttcgtggaaagaaaccttgtgaaaccggaggggaaggtcatcgatctgggatgtggccgcgggggatggtcttactattgcgctggcctcaaaaaggttaccgaagtgaaaggctacacaaaagggggacccggccacgaggaacctattcccatggccacctacgggtggaatctggtgaaactgcatagcggaaaggacgtctttttcatccctcccgagaagtgtgatacactcctttgcgacattggcgagtccagccctaacccgacgatcgaagaggggcggaccctgagagtgctgaaaatggttgaaccctggctccgcggaaatcagttttgtattaagatcctgaacccttatatgccctctgtggtcgagacacttgagcaaatgcagcggaaacacggcggcatgctggtgagaaatcctctctcccgcaacagcacccatgaaatgtactgggtttcttgcgggacaggaaatattgtgtccgcggtcaacatgaccagccggatgctgctgaacagattcacgatggcccaccgcaagcccacctatgagcgggatgtggacctcggcgctgggacaagacacgtggccgtcgaaccggaggttgctaatctggatatcatcggacagcgcattgaaaacatcaaacatgagcacaagtctacctggcattacgacgaggataatccttataagacatgggcctaccacggctcctatgaagtgaaacccagcgggtccgctagctctatggtgaacggagtcgtgaaacttctgaccaaaccctgggacgttattcctatggtgacacagatcgccatgaccgatacgacaccctttggccaacagagagtcttcaaggagaaagtggacacccggacccctaaggcgaagcgcggcacagcccagattatggaagttacggctaaatggctctgggggtttctgagcagaaataagaaaccgcggatctgtaccagagaggagttcacacggaaggtgcgctccaacgccgctatcggagccgtctttgtggacgagaatcaatggaactctgccaaagaggcggttgaagatgagagattctgggaccttgtgcatcgggaacgcgagctgcacaagcagggcaagtgcgctacctgcgtctacaatatgatggggaaaagagaaaagaaactcggagagtttggcaaggccaaagggagccgggccatttggtacatgtggctgggcgctcgcttcctggagttcgaagccctcggatttatgaacgaggatcactggttctccagagaaaattctctgagcggcgtggagggggagggacttcataagctgggctatatcctccgggacatttccaaaatccccgggggaaacatgtacgctgatgacacagccggctgggatacccgcattacagaagacgatctgcagaatgaggcgaagatcaccgacatcatggaacctgagcacgcccttctggctaagtctatttttaaactcacgtatcagaacaaggtcgtgagagttcaacggcccgccaaaaatgggaccgtgatggatgtcatcagccgcagagaccagcggggctccggacaggtgggcacatacgggctgaacaccttcacaaacatggaagctcagctgattcgccaaatggagagcgagggaatcttttctccttccgaactcgagacccccaatctggccggcagagtgcttgattggctggaaaagcatggggttgagcggctcaaaagaatggcgattagcggagacgactgtgtggtcaagccgatcgatgaccgcttcgccacggctctgacagcccttaacgatatgggcaaggtgcggaaagacatccctcagtgggaaccctctaaggggtggaatgattggcagcaggttcctttttgctcccaccacttccatcaactgattatgaaagacggcagagagatcgtggtcccctgtcgcaaccaggatgagctcgtgggacgggctagagtcagccagggcgccgggtggtccctgcgcgaaaccgcttgcctgggaaagtcttatgcccagatgtggcaactcatgtactttcaccggagagacctgcgccttgcggccaatgctatttgtagcgccgtgcctgttgattgggtgcccacatcccggaccacgtggagcatccatgcccaccatcagtggatgaccacagaggacatgctgtctgtctggaacagagtgtggattgaagagaatccgtggatggaagataaaacccacatctccagctggggcgacgttccttatctcgggaagcgcgaggaccagtggtgcggatctctgattggccttacagctcgggccacctgggcgacaaacatccaagtggctatcaatcaggtcagacggctgattgggaacgagaattacctcgattacatgaccagcatgaagagattcaaaaacgaatccgaccccgagggcgccctgtggtga

SEQ ID NO: 18836 - RNA, 9879 nt, synthetic construct
  misc_feature 1..9879: note = derived and/or modified CDS sequence (opt5) from DENV-1__EU677165__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagatacaatcacctacaaatgccccagaattacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagatccagcgggttgaaacctgggccctgcgccaccccggcttcacagtgattgctctttttctggcccatgcgatcgggacctctatcacccagaagggaattatcttcattctcctgatgcttgccacacctagcatggctatgagatgcgtcggcatcgggtcccgggattttgtggagggactgagcggcgccacgtgggttgacgtggtcctcgagcacgggtcttgtgtgaccacaatggctaaggataaacccaccctggacattgaactgctcaagacagaggtgaccaaccctgccgtcctgcgcaaactttgcatcgaagcgaagatttccaatacgacaaccgatagcagatgtccgacccaaggagaggccacactggttgaagaacaggacgctaacttcgtgtgccggcgcacctttgtggatagaggctggggcaatgggtgtggactcttcggcaaagggtctctgatcacatgcgccaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgctacgatcacaccccaggcccctacaaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcttccacatctcaagagacctggaatcgccaggacctgctcgtcaccttcaaaacagcgcacgccaagaagcaggaagtggtcgtgctgggaagccaagagggcgctatgcacacggccctgaccggggccacagaaatccagacctccggaacaaccacgatttttgctggccatctcaaatgcagactgaagatggataaacttacactgcgggggatgagctatgttatgtgtaccggctctttcaagctcgagaaagaagtggccgagacccagcacggaacagtcctggtgcagatcaagtacgagggcaccgacgcgccgtgcaagatccctttctccacacaagatgaaaaaggggttacgcagaacggaagactgattaccgctaatcccatcgtgacagacaaggagaaacctgtcaacattgaagccgagccgccctttggcgagagctatatcgtgattggggccggagaaaaggctcttaaactctcttggttcaagaagggcagctccatcgggaaaatgtttgaggccaccgctcgcggcgcccggagaatggcgatcctgggagatacagcctgggacttcggctctattgggggagtgtttaccagcgttggcaagctggtccatcagatcttcgggacggcttacggagtgctcttttccggcgtgagctggaccatgaaaattgggatcggcgtcctgcttacatggctgggactcaattctcgctccaccagcctgtctatgacatgtattgccgtgggcctggttaccctttacctcggggtgatggtccaggctgattccggatgcgtgatcaactggaagggccgggaactgaaatgtgggagcggaattttcgttacaaatgaggtgcacacctggacggaacaatataagtttcaggccgactcccctaagagactgtctgcggccatcggcaaggcttgggaggagggggtctgcggcatccgcagcgccacacggctcgaaaacattatgtggaagcagatctccaacgagctgaatcatattcttctggaaaacgacatgaaattcaccgtggttgtgggagatgtcgctggcatcctcgcccaggggaagaaaatgattagaccgcaacccatggagcacaagtactcttggaaaagctggggaaaggccaagatcatcggcgctgacgtgcagaataccacatttattatcgatgggcctaacacccccgaatgtcctgacgatcagcgcgcgtggaatatttgggaggtggaggactatggattcggcatctttacgacaaacatttggctgaaactgcgggattcctacacccaggtctgcgaccacagacttatgagcgccgctatcaaggattctaaagccgttcatgccgacatgggctattggatcgaatccgagaagaatgaaacatggaaactcgctcgcgccagcttcattgaggtgaagacctgtatctggcccaagtctcacacactgtggtccaacggggtgctggaaagcgagatgattatcccgaaaatttacggaggccctatctctcaacataattatcggcccgggtacttcacccagacggcgggaccttggcacctcggcaagctggagcttgattttgacctgtgcgaagggaccacagtcgtggttgatgagcactgcggaaacagaggccccagcctccggaccacaaccgtgacgggcaaaatcattcatgaatggtgttgccgctcctgtacactgcctcccctgagattcagaggggaagacggatgctggtacggcatggagatccggccggtcaaggaaaaagaggaaaatcttgtgaaaagcatggtttctgctgggtccggagaggtggacagcttttccctcggcctgctgtgtatttctatcatgattgaagaggtcatgcgcagccggtggtccagaaagatgctcatgaccgggacactggccgtgttctttcttctgatcatgggacagctcacctggaacgatctgattcgcctgtgcatcatggttggcgccaatgcttctgacagaatgggcatggggaccacatatcttgccctgatggcgacgttcaaaatgcggcctatgtttgctgtgggactcctgttccgcagactcaccagccgggaggtcctgcttctgacaatcggcctctccctggtggcctctgtggaactgcccaacagccttgaggaactgggggatggactcgccatgggcattatgatcctgaagctcctgaccgactttcaatcccaccagctttgggctacactgctcagcctgaccttcattaaaacgacattttctctgcattacgcctggaagaccatggctatggtcctttccatcgttagcctgttccccctctgtctgtctaccacatcccagaaaaccacatggctccctgtgctgcttgggagcctgggatgcaagccgctgacgatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttatgttattagcggatctagcgctgacctgtccctggagaaggccgccgaggtgtcttgggaagaggaagctgagcacagcggcgcgtcccataatatcctcgtcgaagtgcaggatgacgggaccatgaaaatcaaggatgaggagcgggacgatacactgaccattcttctgaaagccacactcctggctgtttctggagtgtaccctctcagcatccccgccaccctgttcgtctggtatttctggcaaaagaaaaagcagcgctccggcgtgctttgggacacgccttctcccccggaagtcgagagagccgtgctggatgacggcatttaccggatcatgcagcgcgggctgctcggaagaagccaggttggcgtgggggtctttcaagaaaacgtgttccacaccatgtggcacgttacacggggagctgtgctgatgtatcagggcaagagacttgagccttcctgggccagcgtcaaaaaggacctgatttcttacgggggaggctggcgcctccagggctcctggaataccggggaggaagtccaggtgatcgcggttgagcccggcaagaatcctaagaatgtccaaacagctcccggcacctttaaaacaccggaaggggaggtgggagccattgccctggatttcaagcctggcacgagcgggtctcccatcgtgaaccgggaaggaaagatcgtcggcctctacggcaatggggtggttaccacatccggaacctatgtgagcgctattgcccaggcgaaggcttcccaggagggccctctgcccgagatcgaagacgaggtctttagaaagcgcaaccttaccattatggatctgcatcccgggtctggaaaaacacggagatacctgcctgccatcgtgcgcgaagccattaagcggaaactcagaacgctgatccttgctccgacccgcgttgtggccagcgagatggctgaagccctgaagggcatgcccatccggtatcaaacaaccgcggtcaagtccgagcacacagggaaagagattgtggacctcatgtgccatgccaccttcacgatgagactgctgagccctgttcgggtgcccaattacaacatgatcattatggatgaagctcactttacagacccttcttccatcgccgctcgcggctatattagcaccagagtcggaatgggcgaggccgccgctatcttcatgaccgcgacaccccctgggtctgtggaagcctttccgcagagcaatgctgtgatccaggatgaggaacgggacattcccgagcgctcctggaactctggatacgagtggatcaccgatttccctggcaagacagtctggtttgttcccagcattaaatccgggaatgacatcgccaactgtctcagaaagaatggaaaacgggtgattcagctttctagaaagaccttcgatacggaatatcaaaagaccaaaaacaacgactgggactacgtggtcaccacagatatcagcgagatgggcgccaatttccgcgctgaccgggtgattgatcctagacgctgcctgaagcccgttatcctgaaagacgggccggaacgggtgatcctcgccggccctatgcccgtcaccgtggcgtccgctgcccagagacgcggacggattggcagaaaccataataaggagggggatcagtacatctatatgggacagcccctgaacaatgacgaggatcacgcccactggacggaagctaaaatgcttctggacaacattaatacccctgagggcatcattcccgccctctttgaacctgagcgcgaaaagagcgcggccatcgatggggagtacagactgcggggagaggctcgcaagacattcgttgaactgatgagacggggcgacctcccggtgtggctttcttataaagtcgcctccgaggggtttcaatacagcgatcgcagatggtgcttcgacggcgaacggaacaatcaggtgctggaggaaaacatggatgtcgagatctggaccaaggagggagaacgcaaaaagctgcgcccccggtggctcgacgctagaacatattccgaccctctggcccttcgcgagtttaaagagttcgctgccggccggagatctgtgagcggggatctgattctcgagatcggaaagctgccccagcatctgacccagcgggcgcaaaatgccctcgacaaccttgttatgctgcacaattccgaacagggcgggcgcgcttacagacatgccatggaggagctgcctgatacaattgaaaccctcatgctgcttgctctgatcgccgtgctcacgggaggcgtgacactgtttttcctgtctggccgggggctcggaaaaaccagcattggccttctgtgtgtcatggcctccagcgttctgctctggatggcttctgtggagccccactggatcgcggcctccatcattctggaatttttccttatggtgctgctcatcccggagcctgaccgccagagaacaccccaggataaccaactggcttatgtcgtgattgggctgctctttatgatccttacagttgccgccaatgagatgggactgctggaaaccacaaagaaggacctcggcattgggcacgtggctgtcgagaaccatcaccatgccgcgatgctggatgtggaccttcaccctgccagcgcttggacgctgtacgccgtcgctaccacaatcattacccccatgatgcggcatacaatcgaaaacaccacggccaatatctctctcaccgcgattgccaaccaggctgccatcctgatgggactggataaaggctggcctatttccaagatggacatcggcgtgcccctccttgctctggggtgctacagccaggttaatccgctgacactcaccgccgctgtgctgatgcttgtcgcccactatgcgattatcggacctggcctgcaagccaaagctacacgcgaggcccagaagagaaccgctgccgggatcatgaaaaaccccacggtggatggaattgttgccatcgacctcgatcccgtggtctacgacgcgaagttcgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattttggaataccacaatcgctgtgtctatggccaacattttccgcggcagctatctcgccggggctggactggccttctccctgatgaaaagcctcggcgggggaagacggggcaccggggcgcagggagaaacacttggcgagaaatggaagagacagctgaatcagctgtccaaatctgaatttaacacctacaagcgcagcggcatcatggaggtggaccggtccgaagccaaggaggggctcaaaagaggagagacgacaaagcacgctgtttctcgcggcaccgccaaactgcggtggttcgtcgaaagaaatcttgtgaagcccgaggggaaagtgattgatctgggatgtggccgcgggggatggagctattactgcgctggcctcaagaaggtcaccgaagttaaaggctatacaaaagggggacctggccatgaggaacccatccctatggccacctacgggtggaacctggtgaaactgcactccggaaaggacgtgtttttcattccccctgagaaatgtgatacactcctttgcgacatcggcgagtctagcccgaatcccacgattgaagaggggcggaccctgagagtcctgaagatggtggaaccttggctccgcggaaaccaattttgtatcaaaatcctgaatccctacatgccttccgttgtggagacacttgagcagatgcagcggaagcatggcggcatgctggtcagaaaccccctcagccgcaattctacccacgaaatgtattgggtgtcctgcgggacaggaaacattgttagcgcggtgaatatgacctctcggatgctgctgaacagattcacgatggcccaccgcaagccgacctacgagagagatgtcgacctcggcgctgggacacggcatgtggccgtggaacctgaggtcgctaacctggatatcattggacagcgcatcgaaaatattaaacacgagcataagtccacctggcactatgacgaggataacccctacaaaacatgggcctatcatggcagctacgaagttaagccctctgggtccgctagctccatggtgaatggagtggtcaaacttctgaccaagccttgggacgtgatccccatggttacacaaatcgccatgaccgatacgacaccttttggccagcagagagtgttcaaggagaaagtcgacacccggaccccgaaggcgaaaagaggcacagcccaaattatggaagtgacggctaagtggctctgggggtttctggcccggaacaaaaagccccgcatctgtaccagagaggagttcacacggaaggttcgcagcaatgctgccattggagccgtgtttgtcgacgagaaccagtggaactctgcgaaagaggctgtggaagatgagagattctgggaccttgttcaccgggaacgcgagctgcacaagcagggcaaatgcgctacctgcgtgtataacatgatggggaagagagagaaaaagctcggagagtttggcaaggccaaagggagccgggctatctggtacatgtggctgggcgcccgcttcctggagttcgaagctctcggatttatgaatgaggatcattggttctccagagaaaactctctgagcggcgtcgagggggagggacttcacaagctgggctacattctccgggacatctccaaaatccctgggggaaatatgtatgccgatgacacagcgggctgggatacccgcattacagaagacgatctgcagaacgaggccagaatcaccgacattatggaacccgagcatgcccttctggccaagtctatctttaaactcacgtaccaaaataaggtggtccgggtgcagcgccctgctaaaaacgggaccgttatggatgtgattagcagacgggaccagagaggctccggacaggtcggcacatatgggctgaataccttcacaaacatggaagcccaactgatccgccagatggagtctgagggaatctttagcccctccgaactcgagaccccgaacctggcggaacgggtgcttgattggctggagaagtacggcgtggaaagactcaagcgcatggccattagcggggacgactgtgttgtgaaacctatcgatgaccggttcgctacggccctgacagctcttaatgatatgggaaaggtcagaaaagacattccccagtgggagccttctaagggctggaacgattggcagcaagtgcccttttgctcccaccacttccatcagctgatcatgaaagacgggcgcgagattgttgtgccttgtcggaatcaggatgaactcgtcggcagagcccgcgtgagccagggagctggctggtctctgcgggagaccgcctgcctggggaagtcctatgcgcaaatgtggcagctcatgtactttcacagacgcgacctgcggcttgccgctaacgccatctgtagcgccgtccccgtggattggattccgacatccagaaccacgtggtctatccatgctcaccatcagtggatgaccacagaagacatgctgagcgtttggaatcgggtgtggatcgaggaaaacccttggatggaggataagacccacatttccagctggggagacgtcccctatctcggcaaaagagaggaccaatggtgcgggtctctgatcggacttacagcccgcgcgacctgggctacaaatattcaggtggccatcaaccaggttcggagactgattggcaatgaaaactacctcgattacatgacctccatgaagcgcttcaaaaatgagagcgaccccgaaggggccctgtggtga

SEQ ID NO: 18837 - RNA, 9879 nt, synthetic construct
  misc_feature 1..9879: note = derived and/or modified CDS sequence (opt5) from DENV-1__EU677140__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgaggtcgccaacctggatatcattggacagcggatcgaaaatattaagcacgagcataaatccacctggcactatgacgaggataacccctacaagacatgggcttatcatggcagctacgaagttaaaccctctgggtccgccagctccatggtgaatggagtggtcaaacttctgaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctctgggggtttctgagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggaccttgttcacagagaacgggagctgcacaaacagggcaagtgcgcgacctgcgtgtataacatgatggggaaacgcgaaaagaagctcggagagtttggcaaagctaaggggtccagagccatctggtacatgtggctgggcgcccggttcctggagttcgaagctctcggatttatgaatgaggatcattggttctctcgcgaaaacagcctgtccggcgtcgagggggagggacttcacaaactgggctacattctcagagacatctctaagatccctgggggaaatatgtatgccgatgacacagctggctgggatacccggattacagaagacgatctgcagaacgaggcccgcatcaccgacattatggaacccgagcatgcgcttctggccaaaagcatctttaagctcacgtaccaaaataaagtggtcagagtgcagcggcctgctaagaacgggaccgttatggatgtgatttcccgcagagaccagcggggctctggacaggtcggcacatatgggctgaataccttcacaaacatggaagcccaactgatcagacagatggagagcgagggaatcttttcccccagcgaactcgagaccccgaacctggctgaacgcgtgcttgattggctgaagaaatacggcgtggagcggctcaagagaatggccatttctggggacgactgtgttgtgaaacctatcgatgaccgcttcgcgacggccctgacagctcttaatgatatgggaaaggtccggaaagacattccccagtgggaaccttccaagggctggaacgattggcagcaagtgcccttttgcagccaccacttccatcagctgatcatgaaggacgggagagagattgttgtgccttgtcgcaatcaggatgagctcgtcggccgggccagagtgtctcagggagctggctggtccctgcgcgaaaccgcctgcctggggaaaagctatgctcaaatgtggcagctcatgtactttcaccggagagacctgcgccttgccgcgaacgccatctgttccgctgtccccgtggattggattccgacatctcggaccacgtggagcatccatgcccaccatcagtggatgaccacagaggacatgctgtccgtttggaatagagtgtggatcgaagagaacccttggatggaagataagacccacattagctcttggggagacgtcccctatctcggcaaacgggaggaccaatggtgcgggtccctgatcggacttacagccagagctacctgggccacaaatattcaggtggcgatcaaccaggttcgccggctgattggcaatgagaactacctcgattacatgaccagcatgaagagattcaaaaatgaaggggaccccgagggcgctctgtggtga

SEQ ID NO: 18838 - RNA, 9879 nt, synthetic construct
  misc_feature 1..9879: note = derived and/or modified CDS sequence (opt5) from DENV-1__EU677166__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtgctcacgggaggcgtcacactgtttttcctgtctggcagagggctcggaaagaccagcatcggccttctgtgtgttatggcctccagcgtgctgctctggatggcctctgtggagccccattggattgctgcgtccatcatcctggaatttttccttatggtcctgctcattccggagcctgaccggcagcgcacaccccaggataaccaactggcctacgtggttatcgggctgctctttatgattcttacagtggctgccaatgagatgggactgctggaaaccacaaagaaagacctcggcatcgggcacgtcgccgtggagaaccaccatcacgctgccatgctggatgtcgaccttcatcctgcgagcgcctggacgctgtacgctgtggccaccacaattatcacccccatgatgagacacacaattgaaaacaccacggctaatatctctctcaccgccatcgcgaaccaggccgctattctgatgggactggataagggctggcctatctccaaaatggacattggcgttcccctccttgccctggggtgctatagccaggtgaatccgctgacactcaccgctgccgtcctgatgcttgtggctcattacgccatcattggacctggcctgcaagcgaaggccacacgggaggctcagaaacgcaccgccgctgggatcatgaagaaccccacggttgatggaatcgtggccattgacctcgatcccgtcgtgtatgacgccaagttcgaaaaacagctgggccagatcatgctgctcattctttgtacatctcaaatcctgctgatgagaaccacatgggcgctctgcgagagcattaccctggctaccgggcctcttacaacgctgtgggagggatccccgggcaagttttggaataccacaatcgccgtgtctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgtggcagagggggatggagctactattgcgccggcctcaagaaagttaccgaagtgaagggctacacaaaagggggacctggccacgaggaacccattcctatggctacctacgggtggaacctggtgaagctgcattccggaaaagacgtctttttcattccccctgagaagtgtgatacactcctttgcgacattggcgagtctagcccgaatcccacgatcgaagaggggcgcaccctgcgggtgctgaaaatggttgaaccttggctcagaggaaaccaattttgtattaagatcctgaatccctatatgccttccgtggtcgagacacttgagcagatgcagcgcaagcacggcggcatgctggtgcggaaccccctcagcagaaattctacccatgaaatgtactgggtttcctgcgggacaggaaacatcgtgagcgccgtcaatatgacctctcgcatgctgctgaaccggttcacgatggcgcacagaaaaccgacctatgagcgcgatgtggacctcggcgccgggacaagacacgtggctgtcgaacctgaggttgccaacctggatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaaacttctgaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctctgggggtttctgagcagaaacaagaagccccggatttgtacccgcgaggagttcacaagaaaagtgcggtctaatgctgccatcggagctgtctttgtggacgagaaccagtggaatagcgccaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtggagggggagggacttcataaactgggctatatcctcagagacatttctaagatccctgggggaaatatgtacgccgatgacacagctggctgggatacccggatcacagaagacgatctgcagaacgaggcccgcattaccgacatcatggaacccgagcacgcgcttctggccagaagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgaacctggctgaacgggtgcttgattggctggagaagtatggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaacgccatttgttccgctgtgcccgttaattggatcccgacatctagaaccacgtggagcattcacgcccatcaccagtggatgaccacagaagatatgctgtccgtgtggaaccgggtctggatcgaggaaaatccttggatggaggacaagacccatatcagctcttggggagatgtgccctacctcggcaaaagagaggaccaatggtgcgggtccctgattggacttacagcccgcgctacctgggccacaaacatccaggttgcgattaatcaggtgcggagactgatcggcaacgaaaattacctcgactatatgaccagcatgaagcgcttcaaaaacgagtctgatcccgaaggggctctgtggtga

SEQ ID NO: 18839 - RNA, 9879 nt, synthetic construct
  misc_feature 1..9879: note = derived and/or modified CDS sequence (opt5) from DENV-1__EU677170__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggatgaagctgcgcgattcctatacccaggtttgcgaccaccggctgatgagcgcggccattaaagattctaaggctgtgcacgccgacatgggctactggatcgaatccgagaaaaatgaaacatggaaacttgccagagctagcttcatcgaggtgaagacctgtatttggcccaaatctcatacactctggtccaacggggtcctggaaagcgagatgatcattccgaagatctatggaggccctatttctcaacacaattaccgccccgggtacttcacccagacggccggaccttggcatctgggcaaactcgagctggattttgacctttgcgaagggaccacagtggttgtggatgagcactgcggaaaccggggccccagcctgagaaccacaaccgtcacgggcaagatcatccacgaatggtgttgccggtcctgtacactccctcccctgcgcttcagaggggaggacggatgctggtatggcatggagattcggccggtgaaagaaaaggaggaaaatctggttaagagcatggtgtctgcggggtccggagaggtcgacagcttttcccttggcctcctgtgtatctctattatgatcgaagaggtgatgagaagccgctggtcccggaaaatgctgatgaccgggacactcgctgttttctttctgcttattatgggacagctgacctggaacgatctcatcagactgtgcattatggtgggcgccaatgcctctgaccgcatgggcatggggaccacatacctggctcttatggccacgttcaagatgagacctatgtttgcggtcggactcctgttccggcgcctgaccagcagagaggtgctcctgcttacaatcggcctgtccctcgtggcttctgtcgaactgcccaacagcctggaggaacttggggatggactggccatgggcatcatgattctcaaactgctcaccgactttcaatcccatcagctgtgggccacacttctgagcctcaccttcatcaagacgacattttctctgcactatgcttggaaaaccatggccatggttctgtccattgtgagccttttccccctgtgtctctctaccacatcccagaagaccacatggctgcctgtgctcctggggagccttggatgcaagccgctgacgatgtttctgatcgctgagaataaaatttggggccggcgctcttggcccctcaacgaaggcatcatggccgtcgggatcgtgtccattctgcttagctccctgctcaagaacgatgttcctctggcgggacccctcatcgccggcgggatgctgattgcttgttacgtgatcagcggatctagcgccgacctttccctggagaaagctgccgaggtctcttgggaagaggaagccgagcatagcggcgcttcccacaatattctggtggaagttcaggatgacgggaccatgaagatcaaagatgaggagagagacgatacactcaccatcctgcttaaggcgacactgctcgccgtgtctggagtctatcctctgagcattcccgctaccctcttcgtgtggtacttctggcagaagaagaagcagcggtccggcgtcctgtgggacacgccttctcccccggaagtggagcgcgccgttcttgatgacggcatctatagaattatgcagcgggggctgctgggacgcagccaggtgggcgtcggggtgtttcaagaaaacgttttccataccatgtggcacgtgacaagaggagccgtcctcatgtaccagggcaaacggctggagccttcctgggctagcgtgaagaaagaccttatctcttacgggggaggctggagactgcagggctcctggaataccggggaggaagtgcaggttattgccgtcgagcccggaaagaaccctaaaaatgtgcaaacagcgcccggcacctttaagacaccggaaggggaggtgggagctatcgccctcgatttcaagcctggcacgagcgggtctcccattgtcaaccgcgaaggaaaaatcgtgggcctgtatggcaatggggttgtgaccacatccggaacctacgtcagcgccatcgctcaggccaaggcgtcccaggagggccctctccccgagattgaagacgaggtgtttcggaaaagaaacctgaccatcatggatcttcaccccgggtctggaaagacacgccggtatctgcctgctattgttagagaagccatcaaacgcaagctgcggacgctcattctggccccgaccagagtggtcgctagcgagatggccgaagctcttaagggcatgcccatccgctaccaaacaaccgccgtgaaatccgagcatacagggaaggagatcgttgacctgatgtgccacgcgaccttcacgatgcggctcctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctgcgcaaaaatggaaagagagtgatccagctctctcggaagaccttcgatacggaataccagaaaaccaagaacaacgactgggactacgtcgtgaccacagatattagcgagatgggcgccaatttcagagccgaccgcgttatcgatcctcggagatgccttaaacccgtgattctgaaggacgggccggaacgcgtcatcctggctggccctatgcccgtgaccgttgcctccgcggctcagcggagaggacgcatcggccggaaccacaataaagagggggatcagtatatttacatgggacagcccctcaacaatgacgaggatcatgcccactggacggaagccaagatgctgcttgacaacatcaatacccctgagggcattatccccgctctgtttgaacctgagagagaaaagagcgccgcgattgatggggagtatcgcctcagaggagaggcccggaaaacattcgtggaactgatgcgcagaggcgacctgccggtctggctctcttacaaggtggcttccgaggggtttcaatatagcgatcggcgctggtgcttcgacggcgaaagaaacaatcaggtccttgaggaaaacatggatgtggagatctggaccaaagagggagaacggaagaaactgagaccccgctggctggacgcccggacatactccgaccctctcgctctgagagagtttaaggagttcgccgctggccgccggtctgttagcggggatcttatcctggagattggaaaactcccccagcacctgacccagagagcccaaaatgcgctggacaacctcgtgatgcttcataattccgaacagggcgggcgggcctatcgccacgctatggaggagctgcctgatacaatcgaaaccctgatgctcctggcccttattgctgtgctgacgggaggcgtcacactctttttcctgtctggcagagggctgggaaagaccagcatcggcctcctttgtgttatggcctccagcgtgctgctgtggatggcctctgtggagccccattggattgctgcgtccatcatcctcgaatttttcctgatggtccttctgattccggagcctgaccggcagcgcacaccccaggataaccaactcgcctacgtggttatcgggctgctgtttatgattctcacagtggctgccaatgagatgggacttctggaaaccacaaagaaagacctgggcatcgggcacgtcgccgtggagaaccaccatcacgctgccatgctcgatgtcgacctgcatcctgcgagcgcctggacgctttacgctgtggccaccacaattatcacccccatgatgagacacacaattgaaaacaccacggctaatatctctctgaccgccatcgcgaaccaggccgctattctcatgggactggataagggctggcctatctccaaaatggacattggcgttcccctgctcgcccttgggtgctatagccaggtgaatccgctgacactgaccgctgccgtcctcatgctggtggctcattacgccatcattggacctggccttcaagcgaaggccacacgggaggctcagaaacgcaccgccgctgggatcatgaagaaccccacggttgatggaatcgtggccattgacctggatcccgtcgtgtatgacgccaagttcgaaaaacagctcggccagatcatgctgctgattctctgtacatctcaaatccttctgatgagaaccacatgggcgctgtgcgagagcattaccctcgctaccgggcctctgacaacgctttgggagggatccccgggcaagttttggaataccacaatcgccgtgtctatggctaacatcttccggggcagctacctggccggggccggactcgctttctccctgatgaaaagcctgggcgggggacgcagaggcaccggggcccagggagaaacactcggcgagaagtggaaacggcagcttaatcagctgtccaagtctgaatttaacacctataagagaagcggcattatggaggttgaccgctccgaagcgaaagaggggctgaagcggggagagacgacaaaacacgccgtctctagaggcaccgctaagctccgctggttcgtggaacggaatctggtgaaacccgaggggaaggtcatcgatcttggatgtggcagagggggatggagctactattgcgccggcctgaagaaagttaccgaagtgaagggctacacaaaagggggacctggccacgaggaacccattcctatggctacctacgggtggaacctcgtgaagctgcattccggaaaagacgtctttttcattccccctgagaagtgtgatacactgctctgcgacattggcgagtctagcccgaatcccacgatcgaagaggggcgcacccttcgggtgctgaaaatggttgaaccttggctgagaggaaaccaattttgtattaagatcctcaatccctatatgccttccgtggtcgagacactggagcagatgcagcgcaagcacggcggcatgcttgtgcggaaccccctgagcagaaattctacccatgaaatgtactgggtttcctgcgggacaggaaacatcgtgagcgccgtcaatatgacctctcgcatgctcctgaaccggttcacgatggcgcacagaaaaccgacctatgagcgcgatgtggacctgggcgccgggacaagacacgtggctgtcgaacctgaggttgccaacctcgatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaagctgcttaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctgtgggggtttctcagcagaaacaagaagccccggatttgtacccgcgaggagttcacaagaaaagtgcggtctaatgctgccatcggagctgtctttgtggacgagaaccagtggaatagcgccaaggaggccgttgaagatgagcgcttctgggacctggtgcatagagaacgggagcttcacaaacagggcaagtgcgcgacctgcgtctacaacatgatggggaaacgcgaaaagaagctgggagagtttggcaaagctaaggggtccagagccatttggtacatgtggctcggcgcccggttcctggagttcgaagctctgggatttatgaatgaggatcactggttctctcgcgaaaacagcctctccggcgtggagggggagggactgcataaacttggctatatcctgagagacatttctaagatccctgggggaaatatgtacgccgatgacacagctggctgggatacccggatcacagaagacgatctccagaacgaggcccgcattaccgacatcatggaacccgagcacgcgctgcttgccagaagcatttttaaactgacgtatcaaaataaggtcgtgcgggttcagcgccctgctaaaaacgggaccgtgatggatgtcatctccagacgggaccagagaggctctggacaggtgggcacatacgggctcaataccttcacaaacatggaagcccaactgattcgccagatggagagcgagggaatcttttcccccagcgaactggagaccccgatcctcgctgaacgggtgctggattggcttgagaagtatggcgttgaaagactgaagcgcatggccatttctggggacgactgtgtggtcaaacctatcgatgaccggttcgcgacggccctcacagctctgaacgatatgggaaaggtgagaaaagacattccccagtgggagccttccaagggctggaatgattggcagcaagttcccttttgcagccatcacttccaccagcttatcatgaaagacgggcgcgagattgtggtcccttgtcggaaccaggatgaactggtgggcagagcccgcgtctctcagggagctggctggtccctccgggagaccgcctgcctgggaaagagctacgctcaaatgtggcagctgatgtattttcatagacgcgacctccggctggccgcgaatgccatctgttccgctgtgcccgttgattggattccgacatctagaaccacgtggagcatccacgcccatcaccagtggatgaccacagaagacatgctttccgtgtggaaccgggtctggatcgaggaaaatccttggatggaggataagacccatattagctcttggggagacgtgccctacctgggcaaaagagaggaccaatggtgcgggtccctcatcggactgacagcccgcgctacctgggccacaaacattcaggttgcgatcaatcaggtgcggagacttattggcaacgaaaattacctggattatatgaccagcatgaagcgcttcaaaaacgagtctgaccccgaaggggctctctggtga

SEQ ID NO: 18840 - RNA, 9879 nt, synthetic construct
  misc_feature 1..9879: note = derived and/or modified CDS sequence (opt5) from DENV-1__EU677171__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtgctcacgggaggcgtcacactgtttttcctgtctggcagagggctcggaaagaccagcatcggccttctgtgtgttatggcctccagcgtgctgctctggatggcctctgtggagccccattggattgctgcgtccatcatcctggaatttttccttatggtcctgctcattccggagcctgaccggcagcgcacaccccaggataaccaactggcctacgtggttatcgggctgctctttatgattcttacagtggctgccaatgagatgggactgctggaaaccacaaagaaagacctcggcatcgggcacgtcgccgtggagaaccaccatcacgctgccatgctggatgtcgaccttcatcctgcgagcgcctggacgctgtacgctgtggccaccacaattatcacccccatgatgagacacacaattgaaaacaccacggctaatatctctctcaccgccatcgcgaaccaggccgctattctgatgggactggataagggctggcctatctccaaaatggacattggcgttcccctccttgccctggggtgctatagccaggtgaatccgctgacactcaccgctgccgtcctgatgcttgtggctcattacgccatcattggacctggcctgcaagcgaaggccacacgggaggctcagaaacgcaccgccgctgggatcatgaagaaccccacggttgatggaatcgtggccattgacctcgatcccgtcgtgtatgacgccaagttcgaaaaacagctgggccagatcatgctgctcattctttgtacatctcaaatcctgctgatgagaaccacatgggcgctctgcgagagcattaccctggctaccgggcctcttacaacgctgtgggagggatccccgggcaagttttggaataccacaatcgccgtgtctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgtggcagagggggatggagctactattgcgccggcctcaagaaagttaccgaagtgaagggctacacaaaagggggacctggccacgaggaacccattcctatggctacctacgggtggaacctggtgaagctgcattccggaaaagacgtctttttcattccccctgagaagtgtgatacactcctttgcgacattggcgagtctagcccgaatcccacgatcgaagaggggcgcaccctgcgggtgctgaaaatggttgaaccttggctcagaggaaaccaattttgtattaagatcctgaatccctatatgccttccgtggtcgagacacttgagcagatgcagcgcaagcacggcggcatgctggtgcggaaccccctcagcagaaattctacccatgaaatgtactgggtttcctgcgggacaggaaacatcgtgagcgccgtcaatatgacctctcgcatgctgctgaaccggttcacgatggcgcacagaaaaccgacctatgagcgcgatgtggacctcggcgccgggacaagacacgtggctgtcgaacctgaggttgccaacctggatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaaacttctgaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctctgggggtttctgagcagaaacaagaagccccggatttgtacccgcgaggagttcacaagaaaagtgcggtctaatgctgccatcggagctgtctttgtggacgagaaccagtggaatagcgccaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtggagggggagggacttcataaactgggctatatcctcagagacatttctaagatccctgggggaaatatgtacgccgatgacacagctggctgggatacccggatcacagaagacgatctgcagaacgaggcccgcattaccgacatcatggaacccgagcacgcgcttctggccagaagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgaacctggctgaacgggtgcttgattggctggagaagtatggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaacgccatttgttccgctgtgcccgttgattggatcccgacatctagaaccacgtggagcattcacgcccatcaccagtggatgaccacagaagacatgctgtccgtgtggaatcgggtctggatcgaggaaaacccttggatggaggataagacccatatcagctcttggggagacgtgccctacctcggcaaaagagaggaccaatggtgcgggtccctgattggacttacagcccgcgctacctgggccacaaatatccaggttgcgattaaccaggtgcggagactgatcggcaatgaaaactacctcgattatatgaccagcatgaagcgcttcaaaaatgagtctgaccccgaaggggctctgtggtga

SEQ ID NO: 18841 - RNA, 9879 nt, synthetic construct
  misc_feature 1..9879: note = derived and/or modified CDS sequence (opt5) from DENV-1__EU677172__SS-prME
  source 1..9879: mol_type = other RNA
agcgtgaccatgctgctcatgctgatgcccacagcccttgctttccacctgacgaccagaggcggggaacctcatatgattgtctccaagcaggaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgctcagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctaaggccgtccacgccgacatgggctactggatcgaatccgagaaaaatgaaacatggaagctggctagagccagcttcatcgaggttaagacctgtatttggcccaaatctcatacactgtggtccaacggggtgctcgaaagcgagatgatcattccgaagatctatggaggccctatttctcaacacaattaccgccccgggtacttcacccagacggcgggaccttggcatctgggcaaacttgagctggattttgacctctgcgaagggaccacagtggtcgtggatgagcactgcggaaaccggggccccagcctgagaaccacaaccgttacgggcaagatcatccacgaatggtgttgccggtcctgtacactgcctccccttcgcttcagaggggaggacggatgctggtatggcatggagattcggccggtgaaagaaaaggaggaaaatctcgtcaagagcatggtgtctgctgggtccggagaggttgacagcttttccctgggcctgctctgtatctctattatgatcgaagaggtgatgagaagccgctggtcccggaaaatgctgatgaccgggacacttgccgtcttctttctgctcaccatgggacagctgacctggaacgatctgattagactttgcatcatggtgggcgccaatgcttctgaccgcatgggcatggggacaacgtacctggccctcatggcgaccttcaagatgagacctatgtttgctgttggactgctgttccggcgcctgacaagcagagaggtgcttctgctcaccattggcctgtccctggtcgcctctgtggaacttcccaacagcctggaggaactcggggatggactggccatgggcatcatgatcctcaaactgcttacagactttcaatcccatcagctgtgggctaccctcctgagcctgacgttcattaagacaaccttttctcttcactatgcctggaaaaccatggctatggtgctgtccatcgtcagcctcttccccctgtgtctctctacaacctcccagaagacaacgtggctgcctgttcttctggggagcctgggatgcaagccgctcaccatgtttctgattgccgagaataaaatctggggccggcgctcttggccccttaacgaaggcattatggcggtggggatcgtgtccatcctgctcagctccctgctcaagaacgatgtccctctggccggaccccttattgctggcgggatgctgatcgcctgttacgtgattagcggatctagcgctgacctgtccctcgagaaagccgccgaggtttcttgggaagaggaagctgagcatagcggcgcgtcccacaatatcctggtggaagtccaggatgacgggacaatgaagattaaagatgaggagagagacgatacccttacaatcctgctcaaggccaccctgctcgctgtgtctggagtttatcctctgagcatccccgccacgcttttcgtgtggtacttctggcagaagaagaagcagcggtccggcgtcctgtgggacaccccttctcccccggaagtggagcgcgccgtcctggatgacggcatttatagaatcatgcagcgggggctcctgggacgcagccaggtgggcgttggggtgtttcaagaaaacgtcttccatacaatgtggcacgtgaccagaggagctgttcttatgtaccagggcaaacggctggagccttcctgggccagcgtgaagaaagacctcatttcttacgggggaggctggagactgcagggctcctggaatacaggggaggaagtccaggtgatcgcggtggagcccggaaagaaccctaaaaatgttcaaaccgctcccggcacatttaagacgccggaaggggaggtcggagccattgccctcgatttcaagcctggcaccagcgggtctcccatcgtgaaccgcgaaggaaaaattgtgggcctgtatggcaatggggtcgtgacaacctccggaacctacgttagcgctatcgcccaggcgaaggcttcccaggagggccctcttcccgagatcgaagacgaggtgtttcggaaaagaaacctgacaattatggatctgcaccccgggtctggaaagacgcgccggtatctccctgccatcgtcagagaagccattaaacgcaagctgcggacccttatcctggctccgacaagagtggttgccagcgagatggctgaagccctcaagggcatgcccattcgctaccaaaccacagcggtgaaatccgagcataccgggaaggagatcgtcgacctgatgtgccacgccacgttcacaatgcggctgctcagccctgtgagagttcccaattataacatgatcattatggatgaagctcattttaccgacccttcttccatcgccgctcggggctacattagcacccgcgtgggaatgggcgaggccgccgctatcttcatgacagcgacaccccctgggtctgtcgaagcctttccgcagagcaatgctgtgattcaggatgaggaaagagacatccccgagcggtcctggaactctggatatgagtggatcacagatttccctggcaaaaccgtgtggtttgtccccagcattaagtccgggaatgacatcgccaactgtcttcgcaaaaatggaaagagagttattcagctgtctcggaagacgttcgatacagaataccagaagaccaagaacaacgactgggactacgtggtgacaaccgatatcagcgagatgggcgccaatttcagagctgaccgcgtcattgatcctcggagatgcctgaaacccgtgatcctcaaggacgggccggaacgcgttattctggccggccctatgcccgtgacggtcgcgtccgctgcccagcggagaggacgcatcggccggaaccacaataaagagggggatcagtatatctacatgggacagccccttaacaatgacgaggatcatgcccactggaccgaagctaagatgctgctcgacaacattaatacacctgagggcatcattcccgccctgtttgaacctgagagagaaaagagcgcggccatcgatggggagtatcgcctgagaggagaggctcggaaaaccttcgtggaactcatgcgcagaggcgaccttccggtttggctgtcttacaaggtggcctccgaggggtttcaatatagcgatcggcgctggtgcttcgacggcgaaagaaacaatcaggtcctggaggaaaacatggatgtggagatttggacaaaagagggagaacggaagaaactcagaccccgctggctggacgctcggacctactccgaccctcttgccctgagagagtttaaggagttcgctgccggccgccggtctgtcagcggggatctcatcctggagatcggaaaactgccccagcacctcacacagagagcgcaaaatgcccttgacaacctggtgatgctgcataattccgaacagggcgggcgggcttatcgccacgccatggaggagctccctgataccattgaaacgctgatgcttctggctctcatcgccgttctgacaggaggcgtgaccctgtttttcctctctggcagagggcttggaaagaccagcattggcctgctgtgtgtgatggcctccagcgtcctcctgtggatggcttctgttgagccccattggatcgcggcctccattatccttgaatttttcctgatggtgctcctgatcccggagcctgaccggcagcgcacaccccaggataaccaactggcttacgtggtcattgggctcctttttatgatcctgaccgtggccgccaatgagatgggactgctcgaaacaacgaagaaagacctgggcattgggcacgttgctgtggagaaccaccatcacgccgcgatgcttgatgtcgacctgcatcctgccagcgcttggaccctctacgccgtggctacaaccatcattacacccatgatgagacacaccatcgaaaacacgaccgccaatatttctctgacagcgatcgccaaccaggctgccatcctgatgggactcgataagggctggcctatttccaaaatggacatcggcgtcccccttctggctctggggtgctatagccaggtgaatccgctcaccctgacagccgctgttcttatgctggtggcccattacgcgattatcggacctggcctccaagccaaggctacccgggaggcccagaaacgcacggctgccgggattatgaagaaccccacagtcgatggaatcgtggccatcgacctggatcccgttgtgtatgacgcgaagttcgaaaaacagctgggccagattatgctccttatcctgtgtacctctcaaattctgctcatgagaacaacctgggctctgtgcgagagcatcacccttgccacagggcctctgacgaccctctgggagggatccccgggcaagttttggaatacaaccattgctgtctctatggccaacatcttccggggcagctacctggccggggctggactggccttctccctcatgaaaagccttggcgggggacgcagaggcacaggggcgcagggagaaaccctgggcgagaagtggaaacggcagctgaatcagctctccaagtctgaatttaacacgtataagagaagcggcatcatggaggtggaccgctccgaagccaaagaggggctgaagcggggagagacaaccaaacacgctgtgtctagaggcaccgccaaacttcgctggttcgttgaacggaatctggtcaaacccgaggggaaggtgattgatctcggatgtggcagagggggatggagctactattgcgctggcctgaagaaagtgacagaagtcaagggctacaccaaagggggacctggccacgaggaacccatccctatggccacatacgggtggaacctggttaagctccattccggaaaagacgtgtttttcattccccctgagaagtgtgatacgcttctgtgcgacatcggcgagtctagcccgaatcccaccattgaagaggggcgcacactgcgggtgctcaaaatggtcgaaccttggctgagaggaaaccaattttgtatcaagattcttaatccctatatgccttccgtggttgagaccctggagcagatgcagcgcaagcacggcggcatgctcgtgcggaaccccctgagcagaaattctacacatgaaatgtactgggtctcctgcgggaccggaaacatcgtgagcgcggttaatatgacgtctcgcatgctgctcaaccggttcaccatggcccacagaaaaccgacatatgagcgcgatgtggacctgggcgctgggaccagacacgtcgccgtggaacctgaggtggctaaccttgatatcattggacagcggatcgaaaatattaagcatgagcacaaatccacatggcattacgacgaggataacccctataagacctgggcctaccacggcagctatgaagtcaaaccctctgggtccgctagctccatggttaatggagtggtgaagctgctcacaaagccttgggacgtcatccccatggtgacccaaattgccatgacggatacaaccccttttggccagcagcgcgttttcaaagagaaggtggacaccagaacaccgaaagcgaagcggggcacggcccaaatcatggaagtcaccgctaaatggctgtgggggtttcttagcagaaacaagaagccccggatctgtacacgcgaggagttcaccagaaaagtgcggtctaatgccgctattggagccgtttttgtggacgagaaccagtggaatagcgccaaggaggcggtcgaagatgagcgcttctgggacctggtgcatagagaacgggagctccacaaacagggcaagtgcgctacatgcgtttacaacatgatggggaaacgcgaaaagaagctgggagagtttggcaaagccaaggggtccagagccatctggtacatgtggctgggcgctcggttcctcgagttcgaagccctgggatttatgaatgaggatcactggttctctcgcgaaaacagcctttccggcgtggagggggagggactgcataaactcggctatattctgagagacatctctaagattcctgggggaaatatgtacgctgatgacaccgccggctgggatacacggatcaccgaagacgatcttcagaacgaggcgcgcatcacggacattatggaacccgagcacgccctgctcgctaaaagcatctttaagctgacctatcaaaataaagtcgtgagagtccagcggcctgccaagaacgggacagtgatggatgttatttcccgcagagaccagcggggctctggacaggtgggcacctacgggctgaatacattcaccaacatggaagctcaactcatcagacagatggagagcgagggaatcttttcccccagcgaactggagacgccgaaccttgccgaacgcgtcctggattggctcgagaagtatggcgtggaacggctgaaaagaatggcgatctctggggacgactgtgtggttaagcctatcgatgaccgcttcgccacagctcttaccgccctgaatgatatgggaaaagtgcggaaggacattccccagtgggagccttccaaaggctggaacgattggcagcaagtccccttttgcagccatcacttccaccagctcatcatgaaggacgggagagagattgtggttccttgtcgcaatcaggatgaactggtgggccgggctagagtctctcagggagccggctggtccctgcgcgagacagcttgcctcggaaagagctacgcccaaatgtggcagctgatgtattttcatcggagagaccttcgcctggcggccaacgctatctgttccgccgtgcccgtcgattggattccgacctctcggacgacctggagcatccacgcccatcaccagtggatgacaaccgaagacatgctctccgtgtggaatagagtttggattgaggaaaacccttggatggaggataaaacacatatcagctcttggggagacgtgccctacctgggcaagcgggaggaccaatggtgcgggtcccttatcggactgaccgctagagccacatgggcgaccaatattcaggtcgctatcaaccaggtgcgccggctcattggcaatgaaaactacctggattatatgacgagcatgaaaagattcaagaatgagtctgaccccgaaggggccctgtggtga

SEQ ID NO: 18842 - RNA, 9879 nt, synthetic construct
  misc_feature 1..9879: note = derived and/or modified CDS sequence (opt5) from DENV-1__EU677173__SS-prME
  source 1..9879: mol_type = other RNA
tccgtgaccatgctgctcatgctgatgcccaccgcccttgctttccacctgacgaccagaggcggggaacctcatatgatcgtcacaaagcaggaacggggaaaatccctcctgtttaagacctctgccggcgttaatatgtgcacacttattgcgatggacctgggggaactctgtgaagataccatgacatacaaatgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggctaccacatcccaagagacctggaatcgccaggacctgctcgtcaccttcaaaacagcgcacgccaagaagcaggaagtggtcgtgctgggatctcaagagggcgctatgcacacggccctgaccggggccacagaaattcagaccagcggaacaaccacgatctttgctggccatctcaaatgcagactgaagatggataaacttacactgaaggggatgtcctatgttatgtgtaccggcagcttcaaactcgagaaggaagtggccgagacccagcacggaacagtcctggtgcagattaagtacgagggcaccgacgcgccgtgcaaaatccctttctctacacaagatgaaaagggggttacgcagaacggacggctgatcaccgctaatcccattgtgacagacaaagagaagcctgtcaacatcgaagccgagccgccctttggcgagtcctatattgtgatcggggccggagaaaaagctcttaagctcagctggttcaagaaaggctctagcattgggaagatgtttgaggccaccgctagaggcgcccgccggatggcgatcctgggagatacagcctgggacttcggctccatcgggggagtgtttacctctgttggcaaactggtccatcagattttcgggacggcttacggagtgctctttagcggcgtgtcctggaccatgaagatcgggattggcgtcctgcttacatggctgggactcaatagcagatctacctccctgagcatgacatgtatcgccgtgggcctggttaccctttacctcggggtgatggtccaggctgattctggatgcgtgattaactggaaaggccgcgaactgaagtgtgggtccggaatcttcgttacaaatgaggtgcacacctggacggaacaatataagtttcaggccgacagccctaaacggctgtccgcggccattggcaaggcttgggaggagggggtctgcggcatcagatctgccacacgcctcgaaaacatcatgtggaaacagattagcaacgagctgaatcatatccttctggaaaacgacatgaagttcaccgtggttgtgggagatgtcgtgggcattctcgctcaggggaaaaagatgatccggccgcaacccatggagcacaaatactcctggaagtcttggggaaaggccaaaattatcggcgccgacgtgcagaataccacatttatcattgatgggcctaacacccccgaatgtcctgacgatcagagagcttggaatatctgggaggtcgaggactatggattcggcatttttacgacaaacatctggctgaagctgcgcgatagctacacccagatgtgcgaccaccggcttatgtccgcggccattaaagatagcaaggctgttcatgccgacatgggctattggatcgaatctgagaaaaatgaaacatggaagctcgccagagcttccttcatcgaggtgaagacctgtatttggcccaaaagccacacactgtggtctaacggggtgctggaatccgagatgatcattccgaagatctacggaggccctattagccaacataattatcgccccgggtacttcacccagacggccggaccttggcacctcggcaaactggagcttgattttgacctgtgcgaagggaccacagtcgtggttgatgagcactgcggaaaccggggcccctctctcagaaccacaaccgtgacgggcaagatcatccatgaatggtgttgccggagctgtacactgcctcccctgcgcttcaaaggggaggacggatgctggtacggcatggagattagaccggtcaaggaaaaggaggaaaatcttgtgaaatccatggttagcgcggggtctggagaggtggactcctttagcctcggcctgctgtgtatctccattatgatcgaagaggtcatgcggtctagatggagccgcaagatgctcatgaccgggacactggctgtgttccttctgctcattatgggacagctgacctggaacgatctgatccggctttgcattatggttggcgccaatgcctccgacagaatgggcatggggaccacatatctggctctcatggccacgtttaaaatgcgccctatgttcgcggtgggactgctctttagacggctgacctctcgcgaggtccttctgctcacaatcggcctgagcctggtggcttccgtggaacttcccaactctctggaggaactcggggatggactggccatgggcatcatgattctcaagctgcttaccgacttccaaagccaccagctgtgggccacactcctgtccctgacctttatcaaaacgacacttagcctgcattacgcttggaagaccatggccatggtcctctctattgtttccctgttccccctctgtctgagcaccacatctcagaagaccacatggcttcctgtgctgctggggtccctcggatgcaaaccgctgacgatgtttcttatcaccgagaataagatttggggcagaaaaagctggcccctgaacgaaggcatcatggctgtgggggtcgtgtctatcctcctgtccagcctcctgaagaacgatgttcctcttgccggacccctgattgcgggcgggatgctgatcgcctgttatgtgatttccggaagctctgctgacctcagcctggagaaagccgctgaggtctcctgggaagaggaagccgagcactctggcgccagccataatatccttgtggaagttcaggatgacgggacaatgaagattaaagatgaggagcgggacgataccctgacaatcctcctgaaggctaccctcctggcggtgtccggagtctaccctctttctatccccgccacgctgttcgtgtggtatttttggcaaaagaaaaagcagcgcagcggcgtcctgtgggacacccctagccctcccgaagtggagagagctgttctcgatgacggcatttaccggatcatgcagcgcgggctgcttggaagatctcaggtgggcgtcggggtgttccaagaaaacgttttccacacaatgtggcacgtgacccggggagccgtcctgatgtatcagggcaaacgcctcgagcccagctgggcctccgtgaagaaagacctgattagctacgggggaggctggagactccagggctcttggaatgctggggaggaagtgcaggttatcgccgtcgagcccggaaagaaccctaagaatgtgcaaacagcgcccggcacctttaaaacaccggaaggggaggtgggagctattgccctggatttcaagcctggcacgtccgggagccccatcgtcaaccgggaaggaaaaattgtgggcctttacggcaatggggttgtgaccacatctggaacctatgtctccgccatcgctcaggccaaggcgagccaggagggccctctgcccgagatcgaagacgaggtgtttagaaaacgcaacctgaccattatggatctccatcccgggtccggaaagacacggagatacctgcctgctatcgttcgcgaagccattaagcggaaacttagaacgctgatcctcgccccgacccgcgtggtcgcttctgagatggccgaagctctgaagggcatgcccattcggtatcaaacaaccgccgtgaaaagcgagcacacagggaaggagatcgttgacctgatgtgccatgcgaccttcacgatgagactcctttcccctgtgcgcgtccccaattacaacatgatcattatggatgaagcccactttacagaccctagctctatcgctgcccggggctatatttccaccagagtgggaatgggcgaggctgccgccatcttcatgaccgctacaccccctgggagcgtggaagcgtttccgcagtctaatgccgtcattcaggatgaggaacgggacatccccgagcgcagctggaactccggatacgagtggatcaccgatttccctggcaaaacagtttggtttgtgccctctattaagagcgggaatgacatcgctaactgtctgagaaagaatggaaaacgggtgattcagctgtcccgcaagaccttcgatacggaatatcagaagaccaagaacaacgactgggactacgtcgtgaccacagatatctctgagatgggcgccaattttagagccgaccgggttattgatcctagacgctgcctcaaacccgtgatcctgaaggacgggccggaacgggtcattcttgctggccctatgcccgtgaccgttgccagcgcggctcagagacgcggacggatcggcagaaaccataataaggagggggatcagtacatctatatgggacagcccctgaacaatgacgaggatcacgcccactggacggaagccaaaatgctcctggacaacattaatacccctgagggcatcattcccgctctgttcgaacctgagcgcgaaaagtccgccgcgatcgatggggagtaccggctcagaggagaggcccgcaaaacattcgtggaacttatgagacggggcgacctgccggtctggctgagctataaggtggcttctgaggggtttcaatactccgatcgcagatggtgcttcgacggcgaacggaacaatcaggtcctcgaggaaaacatggatgtggagatttggaccaaagagggagaacgcaagaaactgagaccccggtggcttgacgccagaacatatagcgaccctctggctctccgcgagtttaaggagttcgccgctggccggagatccgtttctggggatctgatcctggagatcggaaagctcccccagcatcttacccagcgcgcccaaaatgcgctggacaacctggtgatgctccacaatagcgaacagggcgggcgggcctacagacatgctatggaggagctgcctgatacaattgaaacccttatgctgctcgccctgatcgctgtgctgacgggaggcgtcacactctttttcctttccggccgggggctgggaaaaacctctattggcctgctctgtgttatggccagctccgtgctgctttggatggccagcgtggagccccactggatcgctgcgtctattatcctggaatttttcctcatggtcctgctgatcccggagcctgaccgccagagaacaccccaggataaccaactcgcctatgtggttattgggcttctgtttatgatcctgacagtggctgccaatgagatgggactcctggaaaccacaaagaaagaccttggcattgggcacgtcgccgtggagaaccatcaccatgctacgatgctggatgtcgacctccaccctgcctccgcgtggaccctgtacgccgtggctacaaccatcattacacccatgatgcggcataccatcgaaaacacgaccgccaatattagcctgacagctatcgccaaccaggcggccatcctcatgggacttgataagggctggcctatttctaaaatggacatcggcgttcccctgctggctctcgggtgctactcccaggtgaatccgctgacccttacagccgctgtcctgatgctcgtggcccactatgctattatcggacctggcctgcaagccaaggcgacccgcgaggcccagaagagaacggctgccgggattatgaaaaaccccacagttgatggaatcgtggctatcgacctggatcccgtcgtgtacgacgccaagttcgaaaaacagctcggccagattatgcttctgatcctgtgtaccagccaaattctcctgatgcggacaacctgggccctttgcgagtctatcaccctggcgacagggcctctcacgaccctgtgggagggaagcccgggcaagttttggaatacaaccattgctgtgtccatggccaacatcttccgcggctcttatctggctggggccggactcgcctttagccttatgaaatccctgggcgggggaagacggggcacaggggctcagggagaaaccctgggcgagaagtggaagcgccagctcaatcagctgagcaaatccgagttcaacatctacaagagatctggcattatggaggttgaccggagcgaagccaaagaggggcttaagagaggagagacgacacgccacgcggtctcccggggcaccgccaaactgagatggttcgtggaacgcaatctcgtgaagcccgaggggaaggtcatcgatctgggatgtggcagagggggatggtcttattactgcgctggcctgaaaaaggttaccgaagtgaaaggctatacaaaagggggacctggccatgaggaacccattcctatggccacctacgggtggaacctcgtgaaacttcacagcggaaaggacgtctttttcacaccccctgagaaatgtgatacgctgctgtgcgacatcggcgagtcctctccgaatcccaccattgaagaggggagaacactccgcgtgctgaagatggttgaaccttggcttcggggaaaccaattttgtatcaagattctgaatccctacatgcctagcgtggtcgagaccctcgagcagatgcagagaaaatatggcggcatgctggtgcgcaaccccctgtcccggaatagcacacatgaaatgtactgggtttcttgcgggaccggaaacatcgtgtccgctgtcaatatgacgagcagaatgctcctgaaccgcttcaccatggcccaccggaagccgacatatgagagagatgtggaccttggcgcggggacccgccacgtggccgtcgaacctgaggttgctaacctggatatcattggacagagaatcgaaaatattaaacatgagcacaagtctacatggcattacgacgaggataacccctataaaacctgggcctaccacggctcctatgaagtgaagcccagcgggtctgcttccagcatggtgaatggagtcgtgaagctcctgacaaaaccttgggacgttatccccatggtgacccaaattgccatgacggatacaaccccttttggccagcagcgggtcttcaaggagaaagtggacacccgcacaccgaaggctaaaagaggcacggcccaaatcatggaagttaccgcgcggtggctttgggggtttctgtccagaaacaagaagccccggatctgtacacgcgaggagttcaccagaaaagtgcggagcaatgccgctattggagccgtctttgtggacgagaaccagtggaactctgctaaggaggccgttgaagatgagcgcttctgggacctcgtgcagaaagaaagagagctgcataagcagggcaaatgcgccacatgcgtctacaacatgatggggaagcgggaaaagaaactgggagagtttggcaaggcgaaagggagccgcgctatctggtacatgtggctcggcgccagattcctggagtttgaagcccttggattcatgaatgaggatcactggttctcccgggaaaactctctgagcggcgtggagggggagggactccacaagctgggctatattcttcgcgacatctccaaaattcctgggggaaatatgtacgctgatgacaccgccggctgggatacaagaatcaccgaagacgatctgcaaaacgaggctaagatcacggacattatggaacccgagcatgccctcctggcgacctctatctttaaactgacatatcagaataaggtcgtgcgggttcagcgccctgccaagaacgggaccgtgatggatgtcattagcagacgggaccagcgcggctccggacaagtgggcacatacgggctcaataccttcacgaacatggaagctcagctgatcagacagatggagtctgagggaatttttcttcccagcgaactggagacaccgaacctcgccgaacgggtgctggattggcttgagaaatatggcgttgaaagactgaagcgcatggctatctccggggacgactgtgtggtcaaacctatcgatgaccggttcgccaccgcgctcacagccctgaatgatatgggaaaggtgagaaaagacattccccagtgggagcctagcaagggctggaacgattggcaacaggttcccttttgctctcaccatttccaccagctgatcatgaaggacgggcgcgagattgtggtcccttgtcggaatcaggatgaactcgtgggcagagctcgcgtctcccaaggagccggctggagcctgcgggagaccgcttgccttgggaaatcttacgcccagatgtggcagctgatgtattttcacagacgcgacctccggctggctgccaacgcgatctgttccgccgtgcccgttgattgggtgccgacgagcagaaccacatggtccattcatgctcaccatcaatggatgaccacagaagacatgctttctgtctggaatcgcgtgtggatcgaggaaaacccttggatggaggataagacccacgttagctcctggggagacgtgccctacctgggcaaacgggaggaccagtggtgcgggagcctcattggactgacagccagagccacctgggcttctaatatccaggtcgccatcaaccaggtgcggagactgattggcaatgaaaactacctcgattatatgacgtccatgaagcgcttcaaaaatgagggggaccccgaaggcgcgctgtggtga

SEQ ID NO: 18843 - RNA, 9879 nt, synthetic construct
  misc_feature 1..9879: note = derived and/or modified CDS sequence (opt5) from DENV-1__EU726779__SS-prME
  source 1..9879: mol_type = other RNA
agcgtgaccatgctgctgatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcttctctatgacatgtatcgctgttggcctggtgaccctgtaccttggggtcatggtgcaggccgattccggatgcgttattaactggaaaggccgcgaactcaagtgtgggagcggaatctttgtgacaaatgaggtccacacctggacggaacaatataagttccaggctgactcccctaaacggctgtctgccgcgattggcaaggcctgggaggagggggtgtgcggcatcagaagcgctacacgcctggaaaacatcatgtggaaacagatttccaacgagctcaatcatatcctgcttgaaaacgacatgaagtttaccgttgtggtcggagatgtggccggcattctggctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtcgaggactacggatttggcattttcacgacaaacatctggctcaagctgcgcgattcctatacccaggtttgcgaccaccggctgatgagcgcggccattaaagattctaaggctgtgcacgccgacatgggctactggatcgaatccgagaaaaatgaaacatggaaacttgccagagctagcttcatcgaggtgaagacctgtatttggcccaaatctcatacactctggtccaacggggtcctggaaagcgagatgatcattccgaagatctatggaggccctatttctcaacacaattaccgccccgggtactttacccagacggccggaccttggcatctgggcaaactcgagctggatttcgacctttgcgaagggaccacagtggttgtggatgagcactgcggaaaccggggccccagcctgagaaccacaaccgtcacgggcaagatcatccacgaatggtgttgccggtcctgtacactccctcccctgcgctttagaggggaggacggatgctggtatggcatggagattcggccggtgaaagaaaaggaggaaaatctggttaagagcatggtgtctgcggggtccggagaggtcgacagcttctcccttggcctcctgtgtatctctattatgatcgaagaggtgatgagaagccgctggtcccggaaaatgctgatgaccgggacactcgctgtctttttcctgcttattatgggacagctgacctggaacgatctcatcagactgtgcattatggtgggcgccaatgcctctgaccgcatgggcatggggaccacatacctggctcttatggccacgtttaagatgagacctatgttcgcggtcggactgctctttcggcgcctgaccagcagagaggtgctcctgcttacaatcggcctgtccctcgtggcttctgtcgaactgcccaacagcctggaggaacttggggatggactggccatgggcatcatgattctcaaactgctcaccgacttccaatcccatcagctgtgggccacacttctgagcctcacctttatcaagacgacattctctctgcactatgcttggaaaaccatggccatggttctgtccattgtgagcctttttcccctgtgtctctctaccacatcccagaagaccacatggctgcctgtgctcctggggagccttggatgcaagccgctgacgatgttcctgatcgctgagaataaaatttggggccggcgctcttggcccctcaacgaaggcatcatggccgtcgggatcgtgtccattctgcttagctccctgctcaagaacgatgttcctctggcgggacccctcatcgccggcgggatgctgattgcttgttacgtgatcagcggatctagcgccgacctttccctggagaaagctgccgaggtctcttgggaagaggaagccgagcatagcggcgcttcccacaatattctggtggaagttcaggatgacgggaccatgaagatcaaagatgaggagagagacgatacactcaccatcctgcttaaggcgacactgctcgccgtgtctggagtctatcctctgagcattcccgctaccctcttcgtgtggtacttttggcagaagaagaagcagcggtccggcgtcctgtgggacacgccttctcccccggaagtgggccgcgccgttcttgatgacgggatctatagaattatgcagcggggactgctgggccgcagccaggtgggggtcggagtgttccaagagaacgtttttcataccatgtggcacgtgacaagaggcgccgtcctcatgtaccaggggaaacggctggaaccttcctgggctagcgtgaagaaagaccttatctcttacggaggcggctggagactgcaggggtcctggaataccggagaggaggtgcaggttattgccgtcgaacccggcaagaaccctaaaaatgtgcaaacagcgcccgggaccttcaagacaccggagggagaagtgggcgctatcgccctcgattttaagcctgggacgagcggatctcccattgtcaaccgcgagggcaaaatcgtgggcctgtatgggaatggagttgtgaccacatccggcacctacgtcagcgccatcgctcaggccaaggcgtcccaggaagggcctctccccgagattgaggacgaagtgttccggaaaagaaacctgaccatcatggatcttcaccccggatctggcaagacacgccggtatctgcctgctattgttagagaggccatcaaacgcaagctgcggacgctcattctggccccgaccagagtggtcgctagcgaaatggccgaggctcttaaggggatgcccatccgctaccaaacaaccgccgtgaaatccgaacatacaggcaaggagatcgttgacctgatgtgccacgcgacctttacgatgcggctcctgagccctgtgagagtccccaattataacatgattatcatggatgaggcccatttcacagacccttcttccattgctgcccggggatacatcagcacccgcgtgggcatgggggaagctgccgccatttttatgaccgctacaccccctggatctgtggaggcgttcccgcagagcaatgccgtcatccaggatgaagagagagacatccccgaacggtcctggaactctggctatgagtggattaccgattttcctgggaaaacagtttggttcgtgcccagcatcaagtccggaaatgacattgctaactgtctgcgcaaaaatggcaagagagtgatccagctctctcggaagaccttcgatacggagtaccagaaaaccaagaacaacgactgggactacgtcgtgaccacagatattagcgaaatgggggccaattttagagccgaccgcgttatcgatcctcggagatgccttaaacccgtgattctgaaggacggcccggagcgcgtcatcctggctggacctatgcccgtgaccgttgcctccgcggctcagcggagaggccgcatcgggcggaaccacaataaagaaggagatcagtatatttacatgggccagcccctcaacaatgacgaggatcatgcccactggacggaggccaagatgctgcttgacaacatcaatacccctgaagggattatccccgctctgttcgagcctgaaagagaaaagagcgccgcgattgatggagaatatcgcctcagaggcgaggcccggaaaacatttgtggagctgatgcgcagaggggacctgccggtctggctctcttacaaggtggcttccgaaggcttccaatatagcgatcggcgctggtgctttgacggagagagaaacaatcaggtccttgaagagaacatggatgtggaaatctggaccaaagagggcgagcggaagaaactgagaccccgctggctggacgcccggacatactccgaccctctcgctctgagagagttcaaggagtttgccgctgggcgccggtctgttagcggagatcttatcctggaaattggcaaactcccccagcacctgacccagagagcccaaaatgcgctggacaacctcgtgatgcttcataattccgagcaagggggacgggcctatcgccacgctatggaggaactgcctgatacaatcgagaccctgatgctcctggcccttattgctgtgctgacgggcggcgtcacactcttctttctgtctgggagaggactgggcaagaccagcatcgggctcctttgtgttatggcctccagcgtgctgctgtggatggcctctgtggaaccccattggattgctgcgtccatcatcctcgagttctttctgatggtccttctgattccggaacctgaccggcagcgcacaccccaggataaccaactcgcctacgtggttatcggactgctgttcatgattctcacagtggctgccaatgagatgggccttctggagaccacaaagaaagacctggggatcggacacgtcgccgtggaaaaccaccatcacgctgccatgctcgatgtcgacctgcatcctgcgagcgcctggacgctttacgctgtggccaccacaattatcacccccatgatgagacacacaattgagaacaccacggctaatatctctctgaccgccatcgcgaaccaggccgctattctcatgggcctggataagggctggcctatctccaaaatggacattggggttcccctgctcgcccttggatgctatagccaggtgaatccgctgacactgaccgctgccgtcctcatgctggtggctcattacgccatcattggccctgggcttcaagcgaaggccacacgggaagctcagaaacgcaccgccgctggaatcatgaagaaccccacggttgatggcatcgtggccattgacctggatcccgtcgtgtatgacgccaagtttgagaaacagctcgggcagatcatgctgctgattctctgtacatctcaaatccttctgatgagaaccacatgggcgctgtgcgaaagcattaccctcgctaccggacctctgacaacgctttgggagggctccccgggcaagttctggaataccacaatcgccgtgtctatggctaacatcttccgggggagctacctggccggagccggcctcgctttttccctgatgaaaagcctcgggggaggccgcagagggaccggagcccagggcgagacactcggcgaaaagtggaaacggcagcttaatcagctgtccaagtctgagttcaacacctataagagaagcgggattatggaagttgaccgctccgaggcgaaagaaggactgaagcggggcgagacgacaaaacacgccgtctctagagggaccgctaagctccgctggtttgtggagcggaatctggtgaaacccgaaggaaaggtcatcgatcttggctgtgggagaggaggctggagctactattgcgccggcctgaagaaagttaccgaggtgaaggggtacacaaaaggaggccctgggcacgaggaacccattcctatggctacctacggatggaacctcgtgaagctgcattccggcaaagacgtcttctttattccccctgaaaagtgtgatacactgctctgcgacattggggagtctagcccgaatcccacgatcgaggaaggacgcacccttcgggtgctgaaaatggttgagccttggctgagaggcaaccaattctgtattaagatcctcaatccctatatgccttccgtggtcgaaacactggagcagatgcagcgcaagcacggcgggatgcttgtgcggaaccccctgagcagaaattctacccatgagatgtactgggtttcctgcggaacaggcaacatcgtgagcgccgtcaatatgacctctcgcatgctcctgaaccggtttacgatggcgcacagaaaaccgacctatgaacgcgatgtggacctgggggccggaacaagacacgtggctgtcgagcctgaagttgccaacctcgatattatcggccagcggattgagaatatcaagcatgaacacaaatccacctggcattacgacgaggataacccctataagacatgggcttaccacgggagctatgaggtgaaaccctctggatccgccagctccatggtgaatggcgtcgtgaagctgcttaccaagccttgggacgttattcccatggtgacacaaatcgctatgaccgatacgacacctttcggccagcagcgcgtctttaaagaaaaggtggacaccagaaccccgaaagccaagcgggggacagcgcaaatcatggaggttacggccaaatggctgtggggattcctcagcagaaacaagaagccccggatttgtacccgcgaagagtttacaagaaaagtgcggtctaatgctgccatcggcgctgtcttcgtggacgaaaaccagtggaatagcgccaaggaggccgttgaggatgaacgcttttgggacctggtgcatagagagcgggaacttcacaaacaggggaagtgcgcgacctgcgtctacaacatgatgggaaaacgcgagaagaagctgggcgagttcgggaaagctaagggctccagagccatttggtacatgtggctcggagcccggttcctggagtttgaggctctgggcttcatgaatgaagatcactggttttctcgcgagaacagcctctccggggtggaaggagagggcctgcataaacttgggtatatcctgagagacatttctaatatccctggaggcaacatgtacgccgatgacacagctgggtgggatacccggatcacagaggacgatctccagaatgaagcccgcattaccgacatcatggagcccgaacacgcgctgcttgccaagagcattttcaaactgacgtatcaaaacaaggtcgtgagagttcagcggcctgctaaaaatggcaccgtgatggatgtcatctcccgcagagaccagcggggatctggccaggtggggacatacggactcaacacctttacaaacatggaggcccaactgattagacagatggaaagcgagggcatcttctcccccagcgagctggaaaccccgaatctcgctgagcgcgtgctggattggcttgaaaagtatggggttgagcggctgaagagaatggccatctctggagacgactgtgtggtcaaacctattgatgaccgctttgcgacggccctcacagctctgaacgatatgggcaaggtgcggaaagacatcccccagtgggaaccttccaaggggtggaatgattggcagcaagttcccttctgcagccatcactttcaccagcttattatgaaagacggcagagagatcgtggtcccttgtcgcaaccaggatgagctggtgggacgggccagagtctctcagggcgctgggtggtccctccgcgaaaccgcctgcctgggaaagagctacgctcaaatgtggcagctgatgtatttccatcggagagacctccgcctggccgcgaatgccatttgttccgctgtgcccgttgattggatcccgacatctcggaccacgtggagcattcacgcccatcaccagtggatgaccacagaggacatgctttccgtgtggaacagagtctggatcgaagagaatccttggatggaagataagacccatatcagctcttggggcgacgtgccctacctggggaaacgggaggaccaatggtgcggatccctcattggcctgacagccagagctacctgggccacaaacatccaggttgcgattaatcaggtgcgccggcttatcgggaacgagaattacctggattatatgaccagcatgaagagatttaaaaacgaatctgaccccgagggcgctctctggtga

SEQ ID NO: 18844 - RNA, 9879 nt, synthetic construct
  misc_feature 1..9879: note = derived and/or modified CDS sequence (opt5) from DENV-1__EU677176__SS-prME
  source 1..9879: mol_type = other RNA
agcgtgaccatgctgctgatgctgatgcccacggcccttgctttccacctgacgacccggggcggggaacctcatatgatcgtgtccaagcaggaacggggaaagtctctcctgtttaagaccagcgccggcgttaatatgtgcacccttattgcgatggacctgggggagctctgtgaagatacaatgacctacaagtgcccgcgcatcacagaggtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaagcagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaggataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaagacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagagctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggcctcttcaagctggagaaggaagtggctgagacacagcacggaaccgttctggtgcagattaaatacgagggcaccgacgccccgtgcaagatccctttctccacacaagatgaaaaaggggtcacccagaacggaagacttatcacagcgaatcccattgtgacggacaaggagaaacctgtgaacatcgaagctgagccgccctttggcgagagctatattgttatcggggccggagaaaaggccctcaagctgtcttggttcaaaaagggcagctccattgggaaaatgtttgaggctaccgcccggggcgctagacgcatggccatcctgggagatacagcgtgggacttcggctctatcgggggagtctttaccagcgtgggcaagctcgtgcatcagattttcgggacagcctacggagtcctgttttccggcgtgagctggaccatgaaaatcgggattggcgttcttctgacgtggctcggactcaattctcggtccaccagcctgtctatgacatgtatcgctgtgggccttgtcaccctctacctgggggtgatggttcaggccgattccggatgcgtgattaactggaagggcagagaactgaagtgtgggagcggaatcttcgtcacaaatgaggtgcacacctggacagaacaatataaatttcaggctgactcccctaagcgcctctctgccgcgattggcaaagcctgggaggagggggtttgcggcatccggagcgctaccagactggaaaacatcatgtggcgccagatttccaacgagcttaatcatatcctgctcgaaaacgacatgaagttcacggtggtcgtgggagatgtggtcggcattctggcccaggggaaaaagatgatccggccgcaacccatggagcacaaatactcttggaaaagctggggaaaggctaagattatcggcgccgacgttcagaatacaacctttatcattgatgggcctaacacccccgaatgtcctgacgatcagagagcctggaatatctgggaggtggaggactatggattcggcatttttacaaccaacatctggctgaaacttcgcgattcctacacacaggtgtgcgaccaccggctcatgagcgctgcgattaaagattctaaggccgtccatgctgacatgggctattggatcgaatccgagaaaaatgaaacatggaagctggccagagccagcttcatcgaggtgaagacctgtatttggcccaaatctcacacactgtggtccaacggggttctcgaaagcgagatgatcattccgaagatctacggaggccctatttctcaacataattatcgccccgggtacttcacccagacagctggaccttggcacctgggcaaacttgagctggattttgacctctgcgaagggaccacggtggtcgtggatgagcactgcggaaaccggggccccagcctgagaaccacaaccgttacaggcaagatcatccatgaatggtgttgccggtcctgtaccctgcctccccttcgcttcaaaggggaggacggatgctggtacggcatggagattagaccggtgaaggaaaaggaggaaaatctcgtcaaaagcatggtgtctgccgggtccggagaggttgacagcttttccctgggcctgctctgtatctctattatgatcgaagaggtgatgcggagcagatggtcccgcaagatgctgatgacggggacacttgcggtcttctttctgctcattatgggacagctgacctggaacgatctgatccggtcttgcattatggtgggcgctaatgccagcgacagaatgggcatggggacaacctatcttgccctgatggctaccttcaaaatgcgccctatgtttgccgtgggactcctgttcagacggctcacatcccgcgaggtcctgcttctgacgatcggcctctctctggttgcgagcgtggaactgcccaactcccttgaggaactgggggatggactcgctatgggcatcatgattctgaagctcctgaccgactttcaaagctaccagctttgggccacactgctctctctgaccttcatcaaaacaaccttttccctgcactatgcctggaagacgatggctatggtgcttagcattgtctctctgctccccctgtgtctctccacaaccagccagaagaccacatggctgcctgtgcttctggggtctctgggatgcaaaccgctcaccatgttcctgatcgccgagaataagatttggggcagaaaatcctggccccttaacgaaggcatcatggctgttgggatcgtgagcattctgctctccagcctgctcaagaacgatgtccctctggccggaccccttatcgcgggcgggatgctgattgcctgttacgtgatctctggaagctccgctgacctgtctctcgagaaagccgctgaggttagctgggaagaggaagccgagcattccggcgcctctcacaatattctggtggaagtccaggatgacgggacaatgaagatcaaagatgaggagcgggacgatacgcttaccatcctgctcaaggctacactgctcgcggtgagcggagtctatcctctgtccattcccgccaccctttttgtgtggtacttctggcaaaagaaaaagcagcgctctggcgttctgtgggacacacctagccctcccgaagtggagagagctgtcctggatgacggcatctatcggattatgcagcgcgggctcctgggaagatcccaggtgggcgttggggtgttccaagaaaacgtctttcataccatgtggcacgtgacgcggggagccgtgcttatgtaccagggcaaacgcctggagcccagctgggcctctgttaagaaagacctcatctcctacgggggaggctggagactgcagggcagctggaataccggggaggaagtccaggtgattgctgtggagcccggaaagaaccctaagaatgtccaaacagcccccggcaccttcaaaacaccggaaggggaggtgggagcgatcgctctcgattttaagcctggcacctctgggtcccccattgttaaccgggaaggaaaaatcgtgggcctgtatggcaatggggtcgtgacaacgagcggaacctacgtttccgccatcgcccaggctaaggcctctcaggagggccctcttcccgagattgaagacgaggtgttcagaaaacgcaacctgacaatcatggatctgcaccccgggagcggaaagaccaagcggtatctccctgcgattgtcagagaagctatcaaacgcaagctgcggacccttattctggccccgacaagagtggttgcctccgagatggctgaagccctcaaaggcatgcccatccgctaccaaacgaccgctgtcaagagcgagcatacagggcgggagatcgtcgacctgatgtgccacgccacctttacaatgagactgctctctcctgtgcgcgtgcccaattataacatgattatcatggatgaagcgcatttcaccgacccttccagcattgccgctcggggctacatctctacgagagtcggaatgggcgaggccgctgccatttttatgacagccacaccccctgggagcgttgaggctttcccgcagtccaatgcggtgatccaggatgaggaacgggacatccccgagcgctcttggaacagcggatatgagtggattaccgattttcctggcaaaacagtgtggttcgtcccctccatcaagtctgggaatgacattgccaactgtcttagaaagaatggaaaacgggtgatccagctgagccgcaagacctttgatacagaataccagaagaccaagaacaacgactgggactacgttgtgacgacagatatttccgagatgggcgctaatttcagagccgaccgggtcatcgatcctagacgctgcctgaaacccgtgattctcaaggacgggccggaacgggttatcctggccggccctatgcccgtgaccgtcgctagcgccgcgcagagacgcggacggatcggcagaaaccacaataaggagggggatcagtatatttacatgggacagccccttaacaatgacgaggatcatgctcactggacagaagccaaaatgctgctcgacaacatcaatacccctgagggcattatccccgccctgttcgaacctgagcgcgaaaagtctgctgccattgatggggagtatcggctgagaggagaggcgcgcaaaacgtttgtggaactcatgagacggggcgaccttccggtctggctgtcctacaaggtggccagcgaggggttccaatattccgatcgcagatggtgctttgacggcgaacggaacaatcaggttctggaggaaaacatggatgtggagatctggaccaaagagggagaacgcaagaaactcagaccccggtggctggacgctagaacatactctgaccctcttgccctgcgcgagttcaaggaatttgctgccggccggagaagcgtgtccggggatctcatcctggagattggaaagctgccccagcacctcacccagcgcgctcaaaatgcccttgacaacctggtcatgctgcataattctgaacagggcgggcgggcgtatagacacgccatggaggagctccctgatacaatcgaaaccctgatgcttctggctctcattgccgttctgacaggaggcgtgaccctgttctttctcagcggccgggggcttggaaaaacgtccatcggcctgctgtgtgtgatggctagctctgccctcctgtggatggcctccgtcgagccccattggattgctgcgagcatcatccttgagttctttctgatggtgctcctgattccggagcctgaccgccagagaacaccccaggataaccaactggcctacgttgtgatcgggctccttttcatgattctgaccgtcgctgccaatgagatgggactgctcgaaaccacaaagaaagacctgggcatcgggcacgtggccgtcgagaaccaccatcacgctaccatgcttgatgtggacctgcatcctgcctctgcgtggacactctacgccgttgctacgaccattatcacacccatgatgcggcacaccattgaaaacacaaccgccaatatctccctgacggctatcgccaaccaggcggccattctgatgggactcgataagggctggcctatcagcaaaatggacattggcgtgccccttctggctctggggtgctattctcaggtcaatccgctcaccctgacagccgctgtgcttatgctggttgcccattacgctatcattggacctggcctccaagccaaggcgacccgcgaggcccagaagagaacagctgccgggatcatgaaaaaccccaccgtggatggaatcgtcgctattgacctggatcccgtggtgtatgacgccaagtttgaaaaacagctgggccagatcatgctccttattctgtgtacgagccaaatcctgctcatgcggacaacctgggccctgtgcgagtccattacacttgcgaccgggcctctgaccacactctgggagggatctccgggcaagttctggaatacgaccatcgctgttagcatggccaacatctttcgcggctcctacctggctggggccggactggccttcagcctcatgaaatcccttggcgggggaagacggggcacaggggctcagggagaaaccctgggcgagaagtggaagcgccagctgaatcagctctctaaaagcgagttcaacacatataagagatccggcattatggaggtcgaccggtctgaagccaaagaggggctgagacgcggagagaccacgaagcacgcggtgagccggggcacagccaaacttagatggtttgtggaacgcaatctggtcaagcccgaggggaaggttatcgatctcggatgtggcagaggcgggtggtcctactattgcgctgggctgaaaaaggtgaccgaagtgaaaggctacaccaaagggggacctggccacgaggaacccattcctatggccacatacgggtggaacctggtcaaactccattctggaaaggacgtgttctttattccccctgagaaatgtgatacccttctgtgcgacatcggcgagagctccccgaatcccacaatcgaagaggggagaacgctgcgcgttctcaagatggtggaaccttggctgcggggaaaccaattctgtattaagatccttaatccctatatgcctagcgtcgtggagaccctggagcagatgcagagaaaacacggcggcatgctcgttcgcaaccccctgtctagaaattccacacatgaaatgtactgggtgagctgcgggaccggaaacatcgtctctgctgtgaatatgacatccagaatgctgctcaaccgctttaccatggcccaccggaagccgacgtatgagagagatgtggacctgggcgcggggacccgccacgtcgccgttgaacctgaggtggctaaccttgatattatcggacagagaattgaaaatatcaaacatgagcacaagagcacatggcattacgacgaggataacccctataaaacctgggcctaccacggctcttatgaagtgaagccctccgggagcgcttccagcatggtcaatggagtggttaagctgctcacaaaaccttgggacgtgattcccatggtcacccaaatcgccatgacagataccacgcctttcggccagcagcgggtgtttaaggagaaagttgacacacgcaccccgaaggctaaaagaggcaccgcccaaatcatggaagtgacagcgcggtggctgtgggggttcctttctagaaacaagaagccccggatttgtacgcgcgaggaatttaccagaaaagtccggagcaatgccgctatcggagccgtgttcgttgacgagaaccagtggaactccgctaaggaggccgtggaagatgagcgcttttgggacctggtccatagagaacgggagctccacaaacagggcaagtgcgccacatgcgtgtacaacatgatggggaaacgcgaaaagaagctgggagagttcggcaaagcgaaggggtctagagctatttggtacatgtggctgggcgcccggtttctcgagttcgaagccctgggattcatgaatgaggatcactggtttagccgcgaaaactccctttctggcgtcgagggggagggactgcataaactcggctatatcctgagagacattagcaagatccctgggggaaatatgtacgctgatgacaccgccggctgggatacacggatcaccgaagacgatcttcagaacgaggctaaaattacagacatcatggaacccgagcacgccctgctcgcgacctccattttcaagctgacgtatcaaaataaagtggttcgcgtgcagagacctgcccggaacgggaccgtcatggatgtgatctctcgcagagaccagcggggcagcggacaggtgggcacatacgggctgaatacctttacaaacatggaagctcaactcattagacagatggagtccgagcgcatcttcagcccctctgaactggagaccccgaaccttgccgaacgggttctggattggctcgagaagcatggagtggaaagactgaagcgcatggctatctccggcgacgactgtgtcgtgaaacctattgatgaccggtttgccacggcgcttagcgccctgaatgatatggggaaggttagaaaagacatcccccagtgggagccttctaagggatggaacgattggcagcaagtgcccttctgctcccaccactttcatcagctcattatgaaagacggccgcgagatcgtcgtgccttgtcggaatcaggatgaactggtcgggagagctcgcgtgagccagggcgccggatggtccctgcgggagacagcttgcctcggcaagtcttatgcccaaatgtggcagctgatgtacttccacagacgcgaccttcggctggctgccaacgcgatttgtagcgccgttcccgtggattgggtcccgacctccagaacaacctggagcatccatgctcaccatcagtggatgacgaccgaagacatgctctctgtgtggaatcgggtttggattgaggaaaacccttggatggaggataagacacacatctccagctggggagacgtgccctatctgggaaaaagagaggaccaatggtgcggctctcttatcgggctgaccgcccgcgccacatgggctaccaatattcaggtcgccatcaaccaggtgcggagactcattggaaatgaaaactacctggattacatgacaagcatgaagcgctttaaaaatgactccgatcccgagggcgcgctgtggtga

SEQ ID NO: 18845 - RNA, 9879 nt, synthetic construct
  misc_feature 1..9879: note = derived and/or modified CDS sequence (opt5) from DENV-1__EU726780__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagagaaaacccttaagctctcttggttcaagaaaggcagctccattgggaagatgtttgaggccacagctagaggcgcccgccggatggctatcctgggagataccgcctgggacttcggctctatcgggggagtttttacgagcgtcggcaaactggtgcatcagattttcgggaccgcgtacggagtgctcttttccggcgtcagctggacaatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacgtggacagaacaatataagtttcaggccgactcccctaaacggctgtctgctgccattggcaaggcgtgggaggagggggtgtgcggcatcagaagcgccacccgcctcgaaaacatcatgtggaaacagatttccaacgagctgaatcatatccttctggaaaacgacatgaagttcaccgttgtggtcggagatgtggctggcattctcgcccaggggaaaaagatgatccggccgcaacccatggagtacaaatattcttggaaaagctggggaaaggctaagattatcggcgccgacgtgcagaatacaacctttatcattgatgggcctaacacgcccgaatgtcctgacgatcagagagcctggaatatctgggaggtcgaggactacggattcggcatttttacaaccaacatctggctgaagctgcgcgattcctatacacaggtttgcgaccaccggcttatgagcgctgcgattaaagattctaaggccgtgcacgctgacatgggctactggatcgaatccgagaaaaatgaaacctggaagctcgccagagccagcttcatcgaggtgaagacatgtatttggcccaaatctcataccctgtggtccaacggggtcctggaaagcgagatgatcattccgaagatctatggaggccctatttctcaacacaattaccgccccgggtacttcacgcagaccgctggaccttggcatctcggcaaactggagcttgattttgacctgtgcgaagggacaaccgtggttgtggatgagcactgcggaaaccggggccccagcctcagaacaaccacggtcacaggcaagatcatccacgaatggtgttgccggtcctgtaccctgcctcccctgcgcttcagaggggaggacggatgctggtatggcatggagattcggccggtgaaagaaaaggaggaaaatcttgttaagagcatggtgtctgccgggtccggagaggtcgacagcttttccctcggcctgctgtgtatctctattatgatcgaagaggtgatgagaagccgctggtcccggaaaatgctcatgacagggaccctggcggttttctttcttctgattatgggacagctcacctggaacgatctgatcagactgtgcattatggtgggcgctaatgcctctgaccgcatgggcatggggacaacgtaccttgccctgatggctaccttcaagatgagacctatgtttgccgtcggactcctgttccggcgcctcacaagcagagaggtgctgcttctgaccatcggcctctccctggtggcgtctgtcgaactgcccaacagccttgaggaactgggggatggactcgctatgggcatcatgattctgaaactcctgacagactttcaatcccatcagctttgggttaccctgctcagcctgacgttcatcaagacaaccttttctctgcactatgcctggaaaaccatggccatggtgctttccattgtgagcctgttccccctctgtctgtctacaacctcccagaagacaacgtggctccctgtcctgcttgggagcctgggatgcaagccgctgaccatgtttctcatcgctgagaataaaatttggggccggcgctcttggcccctgaacgaaggcatcatggccgtggggatcgtttccattcttctgagctccctcctgaagaacgatgtgcctctcgctggacccctgatcgccggcgggatgcttattgcgtgttacgtcatcagcggatctagcgccgacctgtccctggagaaagctgccgaggtgtcttgggaagaggaagctgagcatagcggcgcctcccacaatattctcgttgaagtgcaggatgacgggacaatgaagatcaaagatgaggagagagacgataccctgacaatccttctgaaggccaccctcctggctgtctctggagtgtatcctctcagcattcccgcgacgctgttcgtctggtacttctggcagaaaaagaagcagcggtccggcgtgctttgggacaccccttctcccccggaagttgagcgcgccgtgctggatgacggcatctatagaattatgcagcgggggctgctcggacgcagccaggtcggcgtgggggtttttcaagaaaacgtgttccatacaatgtggcacgtcaccagaggagctgtgctgatgtaccagggcaaacggcttgagccttcctgggccagcgtgaagaaagacctgatctcttacgggggaggctggagactccagggctcctggaatacaggggaggaagttcaggtcattgccgtggagcccggaaagaaccctaaaaatgtgcaaaccgctcccggcacatttaagacgccggaaggggaggtcggagccatcgcgctggatttcaagcctggcaccagcgggtctcccattgtgaaccgcgaaggaaaaatcgttggcctctatggcaatggggtggtcacaacctccggaacctacgtgagcgctatcgcccaggccaaggcttcccaggagggccctctgcccgagattgaagacgaggtttttcggaaaagaaaccttacaatcatggatctgcaccccgggtctggaaagacgcgccggtatctgcctgccattgtgagagaagcgatcaaacgcaagctccggaccctgattcttgctccgacaagagtcgtggccagcgagatggccgaagctctgaagggcatgcccatccgctaccaaaccacagccgttaaatccgagcataccgggaaggagatcgtggacctcatgtgccacgctacgttcacaatgcggctgctgagccctgtcagagtgcccaattataacatgattatcatggatgaagcccattttaccgacccttcttccattgcggcccggggctacatcagcacccgcgtgggaatgggcgaggctgccgctattttcatgacagccacaccccctgggtctgtcgaagcctttccgcagagcaatgctgttatccaggatgaggaaagagacatccccgagcggtcctggaactctggatatgagtggattaccgatttccctggcaaaaccgtgtggtttgtgcccagcatcaagtccgggaatgacattgcgaactgtctccgcaaaaatggaaagagagtcatccagctttctcggaagacgttcgatacagaataccagaaaaccaagaacaacgactgggactacgtggttacaaccgatattagcgagatgggcgccaatttcagagctgaccgcgtgatcgatcctcggagatgcctgaaacccgtcattctgaaggacgggccggaacgcgtgatcctcgccggccctatgcccgttacggtggcctccgctgcccagcggagaggacgcatcggccggaaccacaataaagagggggatcagtatatttacatgggacagcccctgaacaatgacgaggatcatgcgcactggaccgaagctaagatgcttctggacaacatcaatacacctgagggcattatccccgccctctttgaacctgagagagaaaagagcgccgctattgatggggagtatcgcctgagaggagaggcccggaaaaccttcgtcgaactgatgcgcagaggcgacctcccggtgtggctttcttacaaggtcgcgtccgaggggtttcaatatagcgatcggcgctggtgcttcgacggcgaaagaaacaatcaggtgctggaggaaaacatggatgttgagatctggacaaaagagggagaacggaagaaactgagaccccgctggctcgacgcccggacctactccgaccctctggctcttagagagtttaaggagttcgccgctggccgccggtctgtgagcggggatctgatctccgagattggaaaactcccccagcacctgacacagagagcccaaaatgctctggacaacctcgtgatgcttcataattctgaacagggcgggcgggcctatcgccacgcgatggaggagctgcctgataccatcgaaacgctgatgctcctggcccttattgctgtcctgacaggaggcgttaccctctttttcctgagcggcagagggctgggaaagacctccatcggcctcctttgtgtgatggccagctctgtgctgctgtggatggcttccgtcgagccccattggattgccgccagcatcatcctcgaatttttcctgatggtgcttctgattccggagcctgaccggcagcgcacaccccaggataaccaactcgcttacgttgtgatcgggctgctgtttatgattctcaccgtcgcggccaatgagatgggacttctggaaacaacgaagaaagacctgggcatcgggcacgtggctgtcgagaaccaccatcacgccgccatgctcgatgtggacctgcatcctgcttctgcctggaccctttacgcggttgccacaaccattatcacacccatgatgagacacaccattgaaaacacgaccgctaatatctccctgacagccatcgctaaccaggccgcgattctcatgggactggataagggctggcctatcagcaaaatggacattggcgtgcccctgctcgcccttgggtgctattctcaggtcaatccgctgaccctgacagctgccgtgctcatgctggttgctcattacgccatcattggacctggccttcaagctaaggccacccgggaggcgcagaaacgcacggccgctgggatcatgaagaaccccacagtggatggaatcgtcgccattgacctggatcccgtggtgtatgacgctaagttcgaaaaacagctcggccagatcatgctgctgattctctgtaccagccaaatccttctgatgagaacaacctgggccctgtgcgagtccattaccctcgccacagggcctctgacgaccctttgggagggatctccgggcaagttttggaatacaaccatcgcggttagcatggctaacatcttccggggctcctacctggccggggctggactcgccttcagcctgatgaaatccctgggcgggggacgcagaggcacaggggcccagggagaaaccctcggcgagaagtggaaacggcagcttaatcagctgtctaagagcgaatttaacacgtataagagatccggcattatggaggtcgaccgctctgaagctaaagaggggctgaagcggggagagacaaccaaacacgccgtgagcagaggcaccgcgaagctccgctggttcgtggaacggaatctggtcaaacccgaggggaaggttatcgatcttggatgtggcagagggggatggtcctactattgcgccggcctgaagaaagtgacagaagtgaagggctacaccaaagggggacctggccacgaggaacccattcctatggctacatacgggtggaacctcgtcaagctgcattctggaaaagacgtgtttttcattccccctgagaagtgtgatacgctgctctgcgacattggcgagagctccccgaatcccaccatcgaagaggggcgcacacttcgggttctgaaaatggtggaaccttggctgagaggaaaccaattttgtattaagatcctcaatccctatatgcctagcgtcgtggagaccctggagcagatgcagcgcaagcacggcggcatgcttgttcggaaccccctgtctagaaattccacacatgaaatgtactgggtgagctgcgggaccggaaacatcgtctctgccgtgaatatgacgtcccgcatgctcctgaaccggttcaccatggctcacagaaaaccgacatatgagcgcgatgtggacctgggcgccgggaccagacacgtcgcggttgaacctgaggtggccaacctcgatattatcggacagcggattgaaaatatcaagcatgagcacaaaagcacatggcattacgacgaggataacccctataagacctgggcttaccacggctcttatgaagtgaaaccctccgggagcgcctccagcatggtcaatggagtggttaagctgcttacaaagccttgggacgtgattcccatggtcacccaaatcgctatgacggatacaaccccttttggccagcagcgcgtgttcaaagagaaggttgacaccagaacaccgaaagccaagcggggcacggctcaaatcatggaagtgaccgccaaatggctgtgggggtttctctctagaaacaagaagccccggatttgtacacgcgaggagttcaccagaaaagtccggagcaatgcggccatcggagctgtgtttgttgacgagaaccagtggaactccgccaaggaggctgtggaagatgagcgcttctgggacctggtccatagagaacgggagcttcacaaacagggcaagtgcgccacatgcgtgtacaacatgatggggaaacgcgaaaagaagctgggagagtttggcaaagccaaggggtctagagcgatttggtacatgtggctcggcgctcggttcctggagttcgaagccctgggatttatgaatgaggatcactggttcagccgcgaaaactccctctctggcgtcgagggggagggactgcataaacttggctatatcctgagagacattagcaagatccctgggggaaatatgtacgccgatgacaccgctggctgggatacacggatcaccgaagacgatctccagaacgaggcccgcattacggacatcatggaacccgagcacgctctgcttgccaaatccatttttaagctgacctatcaaaataaagtggttagagtgcagcggcctgcgaagaacgggacagtcatggatgtgatctctcgcagagaccagcggggcagcggacaggtgggcacctacgggctcaatacattcaccaacatggaagcccaactgattagacagatggagtccgagggaatctttagcccctctgaactggagacgccgaacctcgctgaacgcgttctggattggcttgagaagtatggcatcgaacggctgaaaagaatggccatttccggggacgactgtgtggtcaagcctatcgatgaccgcttcgctacagccctcaccgcgctgaatgatatgggaaaagtgcggaaggacattccccagtgggagcctagcaaaggctggaacgattggcagcaagttcccttttgctctcatcacttccaccagcttatcatgaaggacgggagagagattgtggtcccttgtcgcaatcaggatgaactggtgggccgggccagagtctcccagggagctggctggagcctccgcgagacagcctgcctggggaagtcctacgctcaaatgtggcagctgatgtattttcatcggagagacctccgcctggccgctaacgccatctgttctgcggtgcccgttgattggattccgaccagccggacgacctggtccatccacgcccatcaccagtggatgacaaccgaagacatgcttagcgtgtggaatagagtctggatcgaggaaaacccttggatggaggataaaacacatatttcttcctggggagacgtgccctacctgggcaagcgggaggaccaatggtgcgggagcctcatcggactgaccgctagagccacatgggccaccaatattcaggttgctatcaaccaggtgcgccggcttattggcaatgaaaactacctggattatatgacgtctatgaaaagattcaagaatgagagcgaccccgaaggggccctctggtga

SEQ ID NO: 18846 - RNA, 9879 nt, synthetic construct
  misc_feature 1..9879: note = derived and/or modified CDS sequence (opt5) from DENV-1__EU726781__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaacatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgttgtgggcctggtcacactgtaccttggggtgatggttcaggccgatagcggatgcgtgatcaactggaagggccgcgaactcaagtgtgggtccggaatttttgtcaccaatgaggtgcacacatggaccgaacagtataaattccaagctgactctcctaagcggctgagcgccgcgatcggcaaagcctgggaggagggggtttgcggcattagatccgctacgcgcctggaaaacatcatgtggaagcagatctctaacgagctcaatcatattctgcttgaaaacgacatgaaatttacagtggtcgtgggagatgtggccggcatcctggctcaggggaagaaaatgattcggccgcagcccatggagtacaagtatagctggaagtcctggggaaaagccaagatcattggcgccgacgtccaaaataccaccttcatcatcgatgggcctaacacacccgaatgtcctgacgatcagagagcttggaatatttgggaggttgaggactacggatttggcatcttcaccacgaacatttggctcaaactgcgcgatagctatacacaggtgtgcgaccaccggctgatgtctgcggccatcaaggattccaaagctgtgcacgccgacatgggctactggattgaaagcgagaagaatgaaacctggaaacttgccagagcttctttcatcgaggtcaaaacatgtatctggcccaagtcccataccctctggagcaacggggtgctggaatctgagatgattatcccgaaaaattatggaggccctattagccagcacaactaccgccccgggtactttacacaaaccgccggaccttggcatctgggcaagctcgagctggatttcgacctttgcgaagggacgaccgttgtggtcgatgagcactgcggaaatcggggcccctccctgagaacaaccacagtgaccggcaaaatcattcacgaatggtgttgccggagctgtacgctccctcccctgcgctttaagggggaggacggatgctggtatggcatggagatcagaccggttaaggaaaaagaggaaaacctggtgaagtctatggtctccgcggggagcggagaggtggactccttctctcttggcctcctgtgtatcagcattatgatcgaagaggttatgcggtccagatggtctcgcaaaatgctgatgacagggaccctcgctgtgctgtttcttctgattatgggacagctcacatggaatgatctgatccggctgtgcattatggtcggcgccaacgccagcgacagaatgggcatggggaccacctaccttgctctgatggccacattcaagatgcgccctatgtttgcggtgggactcctgttcagacggctcacgtcccgcgaggtgctgcttctgaccatcggcctctctctggtcgctagcgttgaactgcccaattcccttgaggaactgggggatggactcgccatgggcattatgatcctgaaactcctgacagactttcagagccatcaactttgggccaccctgctctctctgacattcatcaagaccacgttttccctgcactatgcttggaagacaatggccatggtgcttagcattgtgtctctgttccccctctgtctgtccaccaccagccagaaaacaacctggctccctgtcctgcttgggtctctgggatgcaagccgctgacaatgtttctcatcgctgagaacaaaatttggggcagaaagtcctggcccctgaacgaaggcatcatggccgtggggattgttagcatccttctgtccagcctcctgaaaaatgatgtgcctctcgcgggacccctgatcgccggcgggatgcttattgcttgttacgtcatctctggaagctccgccgacctgtctctggagaaggctgccgaggtgagctgggaagaggaagccgagcattccggcgcttctcacaacattctcgttgaagtgcaggatgacgggacgatgaaaatcaaggatgaggagcgggacgataccctgacaattcttctgaaggcgaccctcctggccgtcagcggagtgtatcctctctccatccccgctacactgttcgtctggtacttctggcagaaaaagaaacaacgctctggcgtgctttgggacaccccttcccctcccgaagttgagagagccgtgctggatgacggcatctatcggattatgcagcgcgggctgctcggaagatcccaggtcggcgtgggggtttttcaggaaaatgtgttccatacgatgtggcacgtcacccggggagccgtgctgatgtaccaaggcaagcgccttgagcccagctgggcttctgtgaaaaaggacctgatctcctacgggggaggctggagactccagggcagctggaacacaggggaggaagttcaggtcattgccgtggagcccggaaagaatcctaaaaacgtgcagaccgcgcccggcacatttaagacctctgaaggggaggtcggagctatcgccctggatttcaaaccgggcacatccgggagccctattgtgaatcgggaaggaaagatcgttggcctctatggcaacggggtggtcacgacctccggaacatacgtgtctgccattgctcaagccaaagcgagccaggagggccccctgcctgagatcgaagacgaggtttttagaaagcgcaatcttaccatcatggatctgcaccccgggtccggaaagacccggagatatctgcccgctattgtgcgcgaagccatcaaacggaagctcagaacactgattcttgcccctacgcgcgtcgtggctagcgagatggccgaagctctgaaaggcatgccgatccggtaccagaccacagccgttaagtctgagcataccgggaaagagattgtggacctcatgtgccacgcgacattcaccatgagactgctgtcccccgtccgcgtgcctaactataatatgatcatcatggatgaagcccattttacggaccccagctctattgctgcccggggctacatcagcacaagagtgggaatgggcgaggctgccgccattttcatgaccgctacccctcccgggtccgtcgaagcgtttcctcaatctaacgccgttatccaggatgaggaacgggacattccggagcgcagctggaactccggatatgagtggatcacagatttccccggcaagaccgtgtggtttgtgccttctatcaagagcgggaacgacattgctaattgtctccgcaagaatggaaagcgggtcatccagctttcccgcaaaacattcgataccgaataccagaagacgaaaaacaatgactgggactacgtggttacaaccgatattagcgagatgggcgccaacttcagagccgaccgggtgatcgatcccagacgctgcctgaagcctgtcattctgaaggacgggcccgaacgggtgatcctcgctggcccgatgcctgttacagtggcctctgcggctcaaagacgcggacggattggcagaaatcacaacaaagagggggatcagtatatctacatgggacagcccctgaataacgacgaggatcatgcccactggaccgaagccaagatgcttctggacaatatcaacacgcccgagggcattatccctgctctctttgaacccgagcgcgaaaaatccgccgcgattgatggggagtatcggctgagaggagaggcccgcaagaccttcgtcgaactgatgagacggggcgacctccctgtgtggcttagctacaaagtcgcttccgaggggtttcagtattctgatcgcagatggtgcttcgacggcgaacggaataaccaagtgctggaggaaaatatggatgttgagatctggacaaaggagggagaacgcaaaaagctgagaccgcggtggctcgacgccagaacctacagcgaccccctggctcttagagagtttaaggagttcgccgctggccggagatccgtgtctggggatctgattctcgagatcggaaaactgcctcagcacctgacacagcgcgcccagaacgcgctcgacaatcttgtgatgctgcataacagcgaacaaggcgggcgggcctatagacacgctatggaggagctgcccgataccatcgaaacactcatgctgcttgccctgattgctgtcctcaccggaggcgttacgctgtttttcctgtccggccgggggctcggaaagacaagcatcggccttctgtgtgtgatggcctcttccgtgctgctctggatggccagcgtcgagcctcattggattgctgcgtctatcattctggaatttttccttatggtgctgctcatccccgagccggaccgccagagaacccctcaggataatcagctggcctacgttgtgatcgggctgctctttatgattcttaccgtcgctgccaacgagatgggactgctggaaacaaccaaaaaggacctcggcatcgggcacgtggccgtcgagaaccaccatcacgctgccatgctggatgtggaccttcatcccgcgtccgcctggacactgtacgctgttgccacgaccattatcacacctatgatgcggcacaccattgaaaatacaaccgctaacatcagcctcacggccattgcgaatcaagccgctatcctgatgggactggataaaggctggcccatctctaagatggacattggcgtgcctctccttgccctggggtgctatagccaggtcaaccccctgaccctcacagctgccgtgctgatgcttgttgctcattacgccatcattggaccgggcctgcaggcgaaggccacccgcgaggctcagaagagaacagccgctgggatcatgaagaatcctaccgtggatggaattgtcgccatcgacctcgatcccgtggtgtatgacgccaaattcgaaaagcagctgggccagatcatgctgctcattctttgtacgtcccagatcctgctgatgcggacaacctgggcgctctgcgagtctattacactggctaccgggccccttaccacactgtgggagggaagccctggcaaattttggaacacgaccatcgccgtttccatggctaatattttccgcggcagctacctcgccggggccggactggctttctccctgatgaagtctctcggcgggggaagacggggcacaggggcccaaggagaaacccttggcgagaagtggaaacgccagctgaaccagctgagcaagtccgaatttaatacatataaaagatctggcatcatggaggtcgaccggagcgaagcgaaggaggggctcaaaagaggagagaccacgaagcacgccgtgtcccgcggcacagctaagctgcggtggttcgtggaaagaaaccttgtcaaaccggaggggaaggttatcgatctgggatgtggccgcgggggatggtcttactattgcgccggcctcaaaaaggtgaccgaagtgaaaggctacaccaaagggggacccggccacgaggaacctattcccatggctacatacgggtggaatctggtcaaactgcatagcggaaaggacgtgtttttcatccctcccgagaagtgtgataccctcctttgcgacattggcgagtccagccctaacccgacaatcgaagaggggcggacgctgagagttctgaaaatggtggaaccctggctccgcggaaatcagttttgtattaagatcctgaacccttatatgccctctgtcgtggagacccttgagcaaatgcagcggaaacacggcggcatgctggttagaaatcctctctcccgcaacagcacacatgaaatgtactgggtgtcttgcgggaccggaaatattgtctccgccgtgaacatgacaagccggatgctgctgaacagattcaccatggcgcaccgcaagcccacgtatgagcgggatgtggacctcggcgccgggaccagacacgtcgctgttgaaccggaggtggccaatctggatatcatcggacagcgcattgaaaacatcaaacatgagcacaagtctacatggcattacgacgaggataatccttataagacctgggcttaccacggctcctatgaagtgaaacccagcgggtccgccagctctatggtcaacggagtggttaaacttctgacaaaaccctgggacgtgattcctatggtcacccagatcgctatgacagataccacgccctttggccaacagagagtgttcaaggagaaagttgacacacggacccctaaggccaagcgcggcaccgcgcagattatggaagtgacagccaaatggctctgggggtttctgagcagaaataagaaaccgcggatctgtacgagagaggagttcacccggaaggtccgctccaacgctgccatcggagctgtgtttgttgacgagaatcaatggaactctgccaaagaggccgtggaagatgagagattctgggaccttgtccatcgggaacgcgagctgcacaagcagggcaagtgcgcgacatgcgtgtacaatatgatggggaaaagagaaaagaaactcggagagtttggcaaggctaaagggagccgggccatttggtacatgtggctgggcgcccgcttcctggagttcgaagctctcggatttatgaacgaggatcactggttctccagagaaaattctctgagcggcgtcgagggggagggacttcataagctgggctatatcctccgggacatttccaaaatccccgggggaaacatgtacgccgatgacaccgctggctgggatacacgcattaccgaagacgatctgcagaatgaggccaagatcacagacatcatggaacctgagcacgcgcttctggccaagtctatttttaaactcacctatcagaacaaggtggttagagtgcaacggcccgctaaaaatgggacggtcatggatgtgatcagccgcagagaccagcggggctccggacaggtgggcacctacgggctgaacacattcaccaacatggaagcccagctgattcgccaaatggagagcgagggaatcttttctccttccgaactcgagacacccaatctggctggcagagttcttgattggctggaaaagcatggggtggagcggctcaaaagaatggccattagcggagacgactgtgtcgtgaagccgatcgatgaccgcttcgcgaccgccctgacggctcttaacgatatgggcaaggttcggaaagacatccctcagtgggaaccctctaaggggtggaatgattggcaacaggtgcctttttgctcccaccacttccatcaactgattatgaaagacggcagagagatcgtcgtgccctgtcgcaaccaggatgagctcgtcggacgggccagagtgagccagggcgctgggtggtccctgcgcgaaacagcctgcctgggaaagtcttatgctcagatgtggcaactcatgtactttcaccggagagacctgcgccttgccgcgaatgccatttgtagcgctgttcctgtggattgggtccccacctcccggacaacctggagcatccatgcccaccatcagtggatgacgaccgaggacatgctgtctgtgtggaacagagtttggattgaagagaatccgtggatggaagataaaacacacatctccagctggggcgacgtgccttatctcgggaagcgcgaggaccagtggtgcggatctctgattggccttaccgcccgggctacatgggccaccaacatccaagtcgcgatcaatcaggtgagacggctgattgggaacgagaattacctcgattacatgacaagcatgaagagattcaaaaacgaatccgaccccgagggcgctctgtggtga

SEQ ID NO: 18847 - RNA, 9879 nt, synthetic construct
  misc_feature 1..9879: note = derived and/or modified CDS sequence (opt5) from DENV-1__EU726782__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagctatacccaggtctgcgaccaccggctcatgtccgcggccatcaaagatagcaaggctgttcacgccgacatgggctactggatcgaatctgagaaaaatgaaacatggaagctggccagagcttccttcattgaggtgaagacctgtatctggcccaaaagccatacactgtggtctaacggggtgctcgaatccgagatgattatcccgaagatttatggaggccctatcagccaacacaattaccgccccgggtacttcacccagacggccggaccttggcatctgggcaaacttgagctggattttgacctctgcgaagggaccacagtcgtggttgatgagcactgcggaaaccggggcccctctctgagaaccacaaccgtgacgggcaagatcattcacgaatggtgttgccggagctgtacactgcctccccttcgcttcagaggggaggacggatgctggtatggcatggagatccggccggtcaaagaaaaggaggaaaatctcgtgaagtccatggttagcgcggggtctggagaggtggactcctttagcctgggcctgctctgtatttccatcattatcgaagaggtcatgagatctcgctggagccggaaaatgctgatgaccgggacacttgctgtgttctttctgctcattatgggacagctgacctggaacgatctgatcagactttgcatcatggttggcgccaatgcctccgaccgcatgggcatggggaccacatacctggctctcatggccacgttcaagatgagacctatgtttgcggtgggactcctgttccggcgcctgacctctagagaggtccttctgctcacaattggcctgagcctggtggcttccgtggaacttcccaactctctggaggaactcggggatggactggccatgggcatcatgattctcaaactgcttaccgactttcaaagccatcagctgtgggccacactcctgtccctgaccttcatcaagacgacatttagccttcactatgcttggaaaaccatggccatggtcctgtctattgtttccctcttccccctgtgtctcagcaccacatctcagaagaccacatggctgcctgtgcttctggggtccctgggatgcaagccgctcacgatgtttctgatcgctgagaataaaatctggggccggcgcagctggccccttaacgaaggcattatggccgtggggatcgtctctattctgctctccagcctgctcaagaacgatgtgcctctggcgggaccccttatcgccggcgggatgctgattgcttgttacgttatctccggaagctctgccgacctgagcctcgagaaagctgccgaggtgtcctgggaagaggaagccgagcattctggcgctagccacaatatcctggtcgaagtgcaggatgacgggaccatgaagattaaagatgaggagagagacgatacacttaccatcctgctcaaggcgacactgctcgccgtttccggagtgtatcctctgtctattcccgctacccttttcgtctggtacttctggcagaagaagaagcagcggagcggcgtgctgtgggacacgcctagccctcccgaagtcgagcgcgccgtgctggatgacggcatctatagaattatgcagcgggggctcctgggacgctctcaggttggcgtgggggtctttcaagaaaacgtgttccataccatgtggcacgttacaagaggagccgtgcttatgtaccagggcaaacggctggagcccagctgggcttccgtcaagaaagacctcatcagctacgggggaggctggagactgcagggctcttggaataccggggaggaagtccaggtgattgccgttgagcccggaaagaaccctaaaaatgtccaaacagcgcccggcacctttaagacaccggaaggggaggtgggagctatcgccctcgatttcaagcctggcacgtccgggagccccatcgtgaaccgcgaaggaaaaattgtcggcctgtatggcaatggggtggttaccacatctggaacctacgtgtccgccatcgctcaggccaaggcgagccaggagggccctcttcccgagattgaagacgaggtctttcggaaaagaaacctgaccatcatggatctgcaccccgggtccggaaagacacgccggtatctccctgctattgtgagagaagccatcaaacgcaagctgcggacgcttatcctggccccgaccagagttgtggcttctgagatggccgaagctctcaagggcatgcccattcgctaccaaacaaccgccgtcaaaagcgagcatacagggaaggagatcgtggacctgatgtgccacgcgaccttcacgatgcggctgctctcccctgttagagtgcccaattataacatgattatcatggatgaagcccattttacagaccctagctctattgctgcccggggctacatctccacccgcgtcggaatgggcgaggctgccgccatcttcatgaccgctacaccccctgggagcgtggaagcgtttccgcagtctaatgccgtgattcaggatgaggaaagagacatccccgagcggagctggaactccggatatgagtggattaccgatttccctggcaaaacagtctggtttgttccctctatcaagagcgggaatgacattgctaactgtcttcgcaaaaatggaaagagagtgatccagctgtcccggaagaccttcgatacggaataccagaagaccaagaacaacgactgggactacgtggtcaccacagatatttctgagatgggcgccaatttcagagccgaccgcgtgatcgatcctcggagatgcctgaaacccgttatcctcaaggacgggccggaacgcgtgattctggctggccctatgcccgtcaccgtggccagcgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgtttgaacctgagagagaaaagtccgccgcgatcgatggggagtatcgcctgagaggagaggcccggaaaacattcgttgaactcatgcgcagaggcgaccttccggtgtggctgagctacaaggtcgcttctgaggggtttcaatattccgatcggcgctggtgcttcgacggcgaaagaaacaatcaggtgctggaggaaaacatggatgtcgagatttggaccaaagagggagaacggaagaaactcagaccccgctggctggacgcccggacatacagcgaccctcttgctctgagagagtttaaggagttcgccgctggccgccggtccgtgtctggggatctcatcctggagattggaaaactgccccagcacctcacccagagagcccaaaatgcgcttgacaacctggttatgctgcataatagcgaacagggcgggcgggcctatcgccacgctatggaggagctccctgatacaatcgaaaccctgatgcttctggccctcattgctgtgctgacgggaggcgtgacactgtttttcctctccggcagagggcttggaaagacctctatcggcctgctgtgtgtcatggccagctccgttctcctgtggatggccagcgtggagccccattggatcgctgcgtctattatccttgaatttttcctgatggtgctcctgattccggagcctgaccggcagcgcacaccccaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcctgcgtccgcctggacgctctacgctgtcgccaccacaattatcacccccatgatgagacacacaatcgaaaacaccacggctaatattagcctgaccgccatcgcgaaccaggccgctattctgatgggactcgataagggctggcctatctctaaaatggacattggcgtgccccttctggccctggggtgctattcccaggttaatccgctcacactgaccgctgccgtgcttatgctggtcgctcattacgccatcatcggacctggcctccaagcgaaggccacacgggaggctcagaaacgcaccgccgctgggattatgaagaaccccacggtggatggaatcgttgccattgacctggatcccgtggtctatgacgccaagttcgaaaaacagctgggccagatcatgctccttattctgtgtacaagccaaatcctgctcatgagaaccacatgggcgctgtgcgagtctatcacccttgctaccgggcctctgacaacgctctgggagggaagcccgggcaagttttggaataccacaattgccgtgtccatggctaacatcttccggggctcttacctggccggggccggactggctttcagcctcatgaaatcccttggcgggggacgcagaggcaccggggcccagggagaaacactgggcgagaagtggaaacggcagctgaatcagctcagcaagtccgaatttaacacctataagagatctggcattatggaggtggaccgcagcgaagcgaaagaggggctgaagcggggagagacgacaaaacacgccgtttccagaggcaccgctaaacttcgctggttcgtcgaacggaatctggtgaaacccgaggggaaggtgatcgatctcggatgtggcagagggggatggtcttactattgcgccggcctgaagaaagtcaccgaagttaagggctacacaaaagggggacctggccacgaggaacccattcctatggctacctacgggtggaacctggtgaagctccatagcggaaaagacgtgtttttcattccccctgagaagtgtgatacacttctgtgcgacatcggcgagtcctctccgaatcccacgatcgaagaggggcgcaccctgcgggtcctcaaaatggtggaaccttggctgagaggaaaccaattttgtatcaagattcttaatccctatatgcctagcgttgtggagacactggagcagatgcagcgcaagcacggcggcatgctcgtccggaaccccctgtccagaaatagcacccatgaaatgtactgggtgtcttgcgggacaggaaacatcgtttccgccgtgaatatgaccagccgcatgctgctcaaccggttcacgatggcgcacagaaaaccgacctatgagcgcgatgtcgacctgggcgccgggacaagacacgtggctgtggaacctgaggtcgccaaccttgatattatcggacagcggattgaaaatatcaagcatgagcacaaatctacctggcattacgacgaggataacccctataagacatgggcttaccacggctcctatgaagttaaacccagcgggtctgcctccagcatggtgaatggagtggtcaagctgctcaccaagccttgggacgtgatccccatggttacacaaattgctatgaccgatacgacaccttttggccagcagcgcgtgttcaaagagaaggtcgacaccagaaccccgaaagccaagcggggcacagcgcaaatcatggaagtgacggccaaatggctgtgggggtttctttccagaaacaagaagccccggatttgtacccgcgaggagttcacaagaaaagttcggagcaatgctgccatcggagctgtgtttgtcgacgagaaccagtggaactctgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggagcagagccatttggtacatgtggctgggcgcccggttcctcgagttcgaagctctgggatttatgaatgaggatcactggttctcccgcgaaaactctcttagcggcgtcgagggggagggactgcataaactcggctatatcctgagagacatctccaagattcctgggggaaatatgtacgccgatgacacagctggctgggatacccggatcacagaagacgatcttcagaacgaggcccgcattaccgacatcatggaacccgagcacgcgctgctcgccaaatctatttttaagctgacgtatcaaaataaagtggtcagagtgcagcggcctgctaagaacgggaccgttatggatgtgatcagccgcagagaccagcggggctccggacaggtcggcacatacgggctgaataccttcacaaacatggaagcccaactcatcagacagatggagtctgagggaatttttagcccctccgaactggagatcccgaaccttgctgaacgcgtgctggattggctcgagaagtatggcgtggaacggctgaaaagaatggccattagcggggacgactgtgttgtgaagcctatcgatgaccgcttcgcgaccgcccttacggctctgaatgatatgggaaaagtccggaaggacattccccagtgggagccttctaaaggctggaacgattggcagcaagtgcccttttgctcccatcacttccaccagctcatcatgaaggacgggagagagattgttgtgccttgtcgcaatcaggatgaactggtcggccgggccagagtgagccagggagctggctggtctctgcgcgagacagcctgcctcgggaagtcctacgctcaaatgtggcagctgatgtattttcatcggagagaccttcgcctggccgcgaacgccatctgtagcgctgtccccgtggattggatcccgacctcccggacaacctggtctattcacgcccatcaccagtggatgacgaccgaagacatgctcagcgtttggaatagagtgtggatcgaggaaaacccttggatggaggataaaacacatatttccagctggggagacgtcccctacctgggcaagcgggaggaccaatggtgcgggtctcttatcggactgaccgccagagctacatgggccaccaatattcaggtggcgatcaaccaggttcgccggctcatcggcaatgaaaactacctggattatatgacatccatgaaaagattcaagaatgagggggaccccgaaggcgctctgtggtga

SEQ ID NO: 18848 - RNA, 9879 nt, synthetic construct
  misc_feature 1..9879: note = derived and/or modified CDS sequence (opt5) from DENV-1__EU677178__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagaccagcgccggcgttaatatgtgcacccttattgcgatggacctgggggaactctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagccacacccaggtctgcgaccaccggctcatgtccgcggccatcaaagatagcaaggctgttcatgccgacatgggctattggatcgaatctgagaaaaatgaaacatggaagctggccagagcttccttcattgaggtgaagacctgtatctggcccaaaagccacacactgtggtctaacggggtgctcgaatccgagatgattatcccgaagatttacggaggccctatcagccaacataattatcgccccgggtacttcacccagacggccggaccttggcacctgggcaaacttgagctggattttgacctctgcgaagggaccacagtcgtggttgatgagcactgcggaaaccggggcccctctctgagaaccacaaccgtgacgggcaagatcattcatgaatggtgttgccggagctgtacactgcctccccttcgcttcagaggggaggacggatgctggtacggcatggagatccggccggtcaaagaaaaggaggaaaatctcgtgaagtccatggttagcgcggggtctggagaggtggactcctttagcctgggcctgctctgtatttccatcatgattgaagaggtcatgagatctcgctggagccggaaaatgctgatgaccgggacacttgctgtgttctttctgctcatcatgggacagctgacctggaacgatctgattagactttgcatcatggttggcgccaatacctccgaccgcatgggcatggggacaacgtatctggccctcatggctaccttcaagatgagacctatgtttgccgtgggactcctgttccggcgcctgacatctagagaggtccttctgctcaccatcggcctgagcctggtggcgtccgtggaacttcccaactctctggaggaactcggggatggactggctatgggcattatgatcctcaaactgcttacagactttcaaagccaccagctgtgggccaccctcctgtccctgacgttcattaagacaacctttagccttcattacgcctggaaaaccatggctatggtcctgtctatcgtttccctcttccccctgtgtctcagcacaacctctcagaagacaacgtggctgcctgtgcttctggggtccctgggatgcaagccgctcaccatgtttctgattgccgagaataaaatctggggccggcgcagctggccccttaacgaaggcatcatggctgtggggattgtctctatcctgctctccagcctgctcaagaacgatgtgcctctggccggaccccttattgcgggcgggatgctgatcgcctgttatgttatttccggaagctctgctgacctgagcctcgagaaagccgctgaggtgtcctgggaagaggaagccgagcactctggcgccagccataatatcctggtcgaagtgcaggatgacgggacaatgaagatcaaagatgaggagagagacgatacccttacaattctgctcaaggctaccctgctcgcggtttccggagtgtaccctctgtctatccccgccacgcttttcgtctggtatttctggcagaagaagaagcagcggagcggcgtgctgtgggacacccctagccctcccgaagtcgagcgcgctgtgctggatgacggcatttacagaatcatgcagcgggggctcctgggacgctctcaggttggcgtgggggtctttcaagaaaacgtgttccacacaatgtggcacgttaccagaggagccgtgcttatgtatcagggcaaacggctggagcccagctgggcctccgtcaagaaagacctcattagctacgggggaggctggagactgcagggctcttggaatacaggggaggaagtccaggtgatcgctgttgagcccggaaagaaccctaaaaatgtccaaaccgcccccggcacatttaagacgccggaaggggaggtgggagcgattgctctcgatttcaagcctggcacctccgggagccccatcgtgaaccgcgaaggaaaaatcgtcggcctgtacggcaatggggtggttacaacctctggaacctatgtgtccgccattgcccaggctaaggccagccaggagggccctcttcccgagatcgaagacgaggtctttcggaaaagaaacctgacaattatggatctgcatcccgggtccggaaagacgcgccggtacctccctgcgatcgtgagagaagctattaaacgcaagctgcggacccttatcctggccccgacaagagttgtggcctctgagatggctgaagccctcaagggcatgcccatccgctatcaaaccacagctgtcaaaagcgagcacaccgggaaggagattgtggacctgatgtgccatgccacgttcacaatgcggctgctctcccctgttagagtgcccaattacaacatgatcattatggatgaagcgcactttaccgaccctagctctatcgccgctcggggctatatttccacccgcgtcggaatgggcgaggccgctgccatcttcatgacagccacaccccctgggagcgtggaggcttttccgcagtctaatgcggtgatccaggatgaggaaagagacattcccgagcggagctggaactccggatacgagtggatcacagatttccctggcaaaaccgtctggtttgttccctctattaagagcgggaatgacatcgccaactgtcttcgcaaaaatggaaagagagtgattcagctgtcccggaagacgttcgatacagaatatcagaagaccaagaacaacgactgggactacgtggtcacaaccgatatctctgagatgggcgctaatttcagagccgaccgcgtgattgatcctcggagatgcctgaaacccgttatcctcaaggacgggccggaacgcgtgatcctggccggccctatgcccgtcacggtggctagcgccgcgcagcggagaggacgcattggccggaaccataataaagagggggatcagtacatctatatgggacagccccttaacaatgacgaggatcacgctcactggaccgaagccaagatgctgctcgacaacattaatacacctgagggcatcattcccgccctgtttgaacctgagagagaaaagtccgctgccatcgatggggagtaccgcctgagaggagaggcgcggaaaaccttcgttgaactcatgcgcagaggcgaccttccggtgtggctgagctataaggtcgcctctgaggggtttcaatactccgatcggcgctggtgcttcgacggcgaaagaaacaatcaggtgctggaggaaaacatggatgtcgagatctggacaaaagagggagaacggaagaaactcagaccccgctggctggacgctcggacctatagcgaccctcttgccctgagagagtttaaggagttcgctgccggccgccggtccgtgtctggggatctcattctggagatcggaaaactgccccagcatctcacacagagagctcaaaatgcccttgacaacctggttatgctgcacaatagcgaacagggcgggcgggcgtaccgccatgccatggaggagctccctgataccattgaaacgctgatgcttctggctctcatcgccgtgctgacaggaggcgtgaccctgtttttcctctccggcagagggcttggaaagacctctattggcctgctgtgtgtcatggctagctccgttctcctgtggatggccagcgtggagccccactggatcgccgcttctatcattcttgaatttttcctgatggtgctcctgatcccggagcctgaccggcagcgcacaccccaggataaccaactggcgtatgtcgtgattgggctcctttttatgatcctgaccgttgccgctaatgagatgggactgctcgaaacaacgaagaaagacctgggcattgggcacgtggccgtcgagaaccatcaccatgccgctatgcttgatgtggacctgcaccctgcctccgcgtggaccctctacgccgtcgctacaaccatcattacacccatgatgagacataccatcgaaaacacgaccgccaatatcagcctgacagctattgccaaccaggcggccatcctgatgggactcgataagggctggcctatttctaaaatggacatcggcgtgccccttctggctctggggtgctactcccaggttaatccgctcaccctgacagccgctgtgcttatgctggtcgcccactatgctattatcggacctggcctccaagccaaggcgacccgggaggcccagaaacgcacggctgccgggatcatgaagaaccccacagtggatggaattgttgctatcgacctggatcccgtggtctacgacgccaagttcgaaaaacagctgggccagattatgctccttatcctgtgtaccagccaaattctgctcatgagaacaacctgggccctgtgcgagtctatcacccttgcgacagggcctctgacgaccctctgggagggaagcccgggcaagttttggaatacaaccatcgctgtgtccatggccaacattttccggggctcttatctggctggggccggactggccttcagcctcatgaaatcccttggcgggggacgcagaggcacaggggctcagggagaaaccctgggcgagaagtggaaacggcagctgaatcagctcagcaagtccgaatttaacacgtacaagagatctggcatcatggaggtggaccgcagcgaagccaaagaggggctgaagcggggagagacaaccaaacacgcggtttccagaggcaccgccaaacttcgctggttcgtcgaacggaatctggtgaaacccgaggggaaggtgattgatctcggatgtggcagagggggatggtcttattactgcgctggcctgaagaaagtcacagaagttaagggctataccaaagggggacctggccatgaggaacccatccctatggccacatacgggtggaacctggtgaagctccacagcggaaaagacgtgtttttcattccccctgagaagtgtgatacgcttctgtgcgacatcggcgagtcctctccgaatcccaccattgaagaggggcgcacactgcgggtcctcaaaatggtggaaccttggctgagaggaaaccaattttgtatcaagatccttaatccctacatgcctagcgttgtggagaccctggagcagatgcagcgcaagcatggcggcatgctcgtccggaaccccctgtccagaaatagcacacacgaaatgtattgggtgtcttgcgggaccggaaacattgtttccgctgtgaatatgacgagccgcatgctgctcaaccggttcaccatggcccacagaaaaccgacatacgagcgcgatgtcgacctgggcgcggggaccagacatgtggccgtggaacctgagatcgctaaccttgatattatcggacagcggattgaaaatatcaagcacgagcataaatctacatggcactatgacgaggataacccctacaagacctgggcctatcatggctcctacgaagtcaaacccagcgggtctgcttccagcatggttaatggagtggtgaagctgctcacaaagccttgggacgtcatccccatggtgacccaaattgccatgacggatacaaccccttttggccagcagcgcgttttcaaagagaaggtggacaccagaacaccgaaagctaagcggggcacggcccaaatcatggaagtcaccgcgaaatggctgtgggggtttctttccagaaacaagaagccccggatttgtacacgcgaggagttcaccagaaaagtgcggagcaatgccgctatcggagccgtttttgtggacgagaaccagtggaactctgctaaggaggccgtcgaagatgagcgcttctgggacctggtgcacagagaacgggagctccacaaacagggcaagtgcgccacatgcgtttataacatgatggggaaacgcgaaaagaagctgggagagtttggcaaagcgaaggggagcagagctatttggtacatgtggctgggcgcccggttcctcgagttcgaagccctgggatttatgaatgaggatcattggttctcccgcgaaaactctcttagcggcgtggagggggagggactgcacaaactcggctacatcctgagagacatctccaagattcctgggggaaatatgtatgctgatgacaccgccggctgggatacacggatcaccgaagacgatcttcagaacgaggctcgcattacggacatcatggaacccgagcatgccctgctcgcgaaatctatttttaagctgacctaccaaaataaagtcgtgagagtccagcggcctgccaagaacgggacagtgatggatgttatcagccgcagagaccagcggggctccggacaggtgggcacctatgggctgaatacattcaccaacatggaagctcaactcatcagacagatggagtctgagggaatttttagcccctccgaactggagacgccgaaccttgccgaacgcgtcctggattggctcgagaagtacggcgtggaacggctgaaaagaatggctatcagcggggacgactgtgtggttaagcctattgatgaccgcttcgccacagcgcttaccgccctgaatgatatgggaaaagtgcggaaggacatcccccagtgggagccttctaaaggctggaacgattggcagcaagtccccttttgctcccaccacttccatcagctcattatgaaggacgggagagagatcgtggttccttgtcgcaatcaggatgaactggtgggccgggctagagtcagccagggagccggctggtctctgcgcgagacagcttgcctcgggaagtcctatgcccaaatgtggcagctgatgtactttcaccggagagaccttcgcctggctgccaacgcgatttgtagcgccgtgcccgtcgattggatcccgacctcccggacgacctggtctatccatgctcaccatcagtggatgacaaccgaagacatgctcagcgtgtggaatagagtttggattgaggaaaacccttggatggaggataaaacacacatctccagctggggagacgtgccctatctgggcaagcgggaggaccaatggtgcgggtctcttattggactgaccgccagagccacatgggctaccaatatccaggtcgccattaaccaggtgcgccggctcatcggcaatgaaaactacctggattacatgacgtccatgaaaagattcaagaatgagggggaccccgaaggcgcgctgtggtga

SEQ ID NO: 18849 - RNA, 9879 nt, synthetic construct
  misc_feature 1..9879: note = derived and/or modified CDS sequence (opt5) from DENV-1__EU687251__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgaggtcgccaacctggatatcattggacagcggatcgaaaatattaagcacgagcataaatccacctggcactatgacgaggataacccctacaagacatgggcttatcatggcagctacgaagttaaaccctctgggtccgccagctccatggtgaatggagtggtcaaacttctgaccaagccttgggacgtgatccccatggttacacaaatcgctatgaccgatacgacaccttttggccagcagcgcgtgttcaaagagaaggtcgacaccagaaccccgaaagccaagcggggcacagcgcaaattatggaagtgacggccaaatggctctgggggtttctgagcagaaacaagaagccccggatctgtacccgcgaggagttcacaagaaaagttcggtctaatgctgccattggagctgtgtttgtcgacgagaaccagtggaatagcgccaaggaggccgtggaagatgagcgcttctgggaccttgttcacagagaacgggagctgcacaaacagggcaagtgcgcgacctgcgtgtataacatgatggggaaacgcgaaaagaagctcggagagtttggcaaagctaaggggtccagagccatctggtacatgtggctgggcgcccggttcctggagttcgaagctctcggatttatgaatgaggatcattggttctctcgcgaaaacagcctgtccggcgtcgagggggagggacttcacaaactgggctacattctcagagacatctctaagatccctgggggaaatatgtatgccgatgacacagctggctgggatacccggattacagaagacgatctgcagaacgaggcccgcatcaccgacattatggaacccgagcatgcgcttctggccaaaagcatctttaagctcacgtaccaaaataaagtggtcagagtgcagcggcctgctaagaacgggaccgttatggatgtgatttcccgcagagaccagcggggctctggacaggtcggcacatatgggctgaataccttcacaaacatggaagcccaactgatcagacagatggagagcgagggaatcttttcccccagcgaactcgagaccccgaacctggctgaacgcgtgcttgattggctgaagaaatacggcgtggagcggctcaagagaatggccatttctggggacgactgtgttgtgaaacctatcgatgaccgcttcgcgacggccctgacagctcttaatgatatgggaaaggtccggaaagacattccccagtgggaaccttccaagggctggaacgattggcagcaagtgcccttttgcagccaccacttccatcagctgatcatgaaggacgggagagagattgttgtgccttgtcgcaatcaggatgagctcgtcggccgggccagagtgtctcagggagctggctggtccctgcgcgaaaccgcctgcctggggaaaagctatgctcaaatgtggcagctcatgtactttcaccggagagacctgcgccttgccgcgaacgccatctgttccgctgtccccgtggattggattccgacatctcggaccacgtggagcatccatgcccaccatcagtggatgaccacagaggacatgctgtccgtttggaatagagtgtggatcgaagagaacccttggatggaagataagacccacattagctcttggggagacgtcccctatctcggcaaacgggaggaccaatggtgcgggtccctgatcggacttacagccagagctacctgggccacaaatattcaggtggcgatcaaccaggttcgccggctgattggcaatgagaactacctcgattacatgaccagcatgaagagattcaaaaatgaatctgaccccgagggggctctgtggtga

SEQ ID NO: 18850 - RNA, 9879 nt, synthetic construct
  misc_feature 1..9879: note = derived and/or modified CDS sequence (opt5) from DENV-1__FJ024427__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggagttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacaggctacggcgccctgaccctggactgttctccccggacggggctcgatttcaacgaaatggtgctgcttacaatgaaggagaaatcctggctggtccataagcagtggtttctcgacctgcctcttccctggaccagcggagcctccacatctcaagagacctggaatcgccaggatctgctcgtgaccttcaaaacagctcacgcgaagaagcaggaagtcgtggttctgggcagccaagagggggccatgcacacggctctgaccggagccacagaaattcagacctccggcacaaccacgatctttgccgggcatctcaaatgcagactgaagatggacaaacttacactgaagggcatgagctatgtgatgtgtaccggatctttcaaactcgagaaggaagtcgctgagacccagcacggcacagtgctggttcagattaagtacgagggggccgatgcgccgtgcaaaatccctttctccacccaagacgaaaagggaatcacacagaacggccggctgattacggctaatcccatcgtgaccgataaagagaagcctgtcaacattgaagccgagccgccctttggggagagctatatcgtgattggagccggcgaaaaagctcttaagctctcttggttcaagaaagggagctccatcggcaagatgtttgaggccacagctagaggagcccgccggatggcgatcctgggcgacaccgcctgggatttcgggtctattggaggcgtgtttacaagcgttgggaaactggtccatcagatcttcggaaccgcttacggcgtgctcttttccggggtgagctggacgatgaagattggcatcggagtcctgcttacctggctgggcctcaattctagatccacaagcctgtctatgacctgtattgccgtggggctggttacactttacctcggagtgatggtccaggctgactccggctgcgtgatcaactggaaagggcgcgaactgaagtgtggaagcggcattttcgttaccaatgaggtgcacacatggaccgaacaatataagtttcaggccgattcccctaaacggctgtctgcggccatcgggaaggcttgggaggagggcgtctgcggaatcagaagcgccacgcgcctcgaaaacattatgtggaaacagatctccaacgagctgaatcatattcttctggaaaacgacatgaagttcacagtggttgtgggcgacgtcgctgggatcctcgcccagggcaagaagatgattcggccgcaacccatggagtacaaatattcttggaaaagctggggcaaggccaagatcatcggggctgatgtgcagaataccacctttattatcgacggacctaacacacccgaatgtcctgatgaccagagagcgtggaatatttgggaggtggaggattacggcttcggcatctttaccacgaacatttggctgaagctgcgcgactcctatacacaggtctgcgatcaccggcttatgagcgccgctatcaaagactctaaggccgttcacgccgatatggggtactggatcgaatccgagaaaaatgaaacctggaagctcgctagagccagcttcattgaggtgaagacatgtatctggcccaaatctcataccctgtggtccaacggagtgctggaaagcgagatgattatcccgaagatttatggcgggcctatctctcaacacaattaccgccccggatacttcacacagaccgcgggcccttggcatctcgggaaactggagcttgactttgatctgtgcgaaggaacgaccgtcgtggttgacgagcactgcggcaaccggggccccagcctcagaacaaccacagtgaccgggaagatcattcacgaatggtgttgccggtcctgtacgctgcctcccctgcgcttcagaggagaggatggctgctggtatgggatggagatccggccggtcaaagaaaaggaggaaaatcttgtcaagagcatggtttctgctggatccggcgaggtggacagcttttccctcgggctgctgtgtatttctatcatgattgaagaggtcatgagaagccgctggtcccggaaaatgctcatgacaggaaccctggccgtgttctttcttctgatcatgggccagctcacatggaacgacctgattagactgtgcatcatggttggcgccaatgcttctgatcgcatggggatgggaaccacctaccttgccctgatggcgacattcaagatgagacctatgtttgctgtgggcctcctgttccggcgcctcacgagcagagaggtcctgcttctgaccatcgggctctccctggtggcctctgtggaactgcccaacagccttgaggaactgggagacggcctcgccatggggattatgatcctgaaactcctgacagattttcaatcccatcagctttgggctaccctgctcagcctgacattcattaagaccacgttttctctgcactatgcctggaaaacaatggctatggtcctttccatcgttagcctgttccccctctgtctgtctaccacctcccagaagacaacctggctccctgtgctgcttggaagcctgggctgcaagccgctgacaatgtttctcattgccgagaataaaatctggggccggcgctcttggcccctgaacgaagggatcatggcggtgggaattgtctccatccttctgagctccctcctgaagaacgacgtgcctctcgccggccccctgattgctgggggaatgcttatcgcctgttacgttattagcggctctagcgctgatctgtccctggagaaagccgccgaggtgtcttgggaagaggaagctgagcatagcggggcgtcccacaatatcctcgtcgaagtgcaggacgatggaacgatgaagatcaaagacgaggagagagatgacaccctgacaattcttctgaaggccaccctcctggctgtttctggcgtgtatcctctcagcatccccgccacactgttcgtctggtacttctggcagaaaaagaagcagcggtccggcgtgctttgggataccccttctcccccggaagtcgagcgcgccgtgctggacgatgggatttatagaatcatgcagcggggactgctcggccgcagccaggttggggtgggagtctttcaagaaaacgtgttccatacgatgtggcacgttaccagaggcgctgtgctgatgtaccaggggaaacggcttgagccttcctgggccagcgtcaagaaagacctgatttcttacggaggcggctggagactccaggggtcctggaatacaggagaggaagtccaggtgatcgcggttgagcccggcaagaaccctaaaaatgtccaaaccgctcccgggacatttaagaccccggaaggagaggtgggcgccattgccctggacttcaagcctgggacaagcggatctcccatcgtgaaccgcgaaggcaaaatcgtcggcctctatgggaatggagtggttacgacctccggcacatacgtgagcgctattgcccaggcgaaggcttcccaggaggggcctctgcccgagatcgaagatgaggtctttcggaaaagaaaccttaccattatggacctgcaccccggatctggcaagacccgccggtatctgcctgccatcgtgagagaagccattaaacgcaagctccggacactgatccttgctccgacgagagttgtggccagcgagatggctgaagccctgaaggggatgcccatccgctaccaaaccacagcggtcaaatccgagcataccggcaaggagattgtggatctcatgtgccacgccacattcaccatgcggctgctgagccctgttagagtgcccaattataacatgatcattatggacgaagctcattttacggatccttcttccatcgccgctcggggatacattagcacacgcgtcggcatgggggaggccgccgctatcttcatgaccgcgacaccccctggatctgtggaagcctttccgcagagcaatgctgtgatccaggacgaggaaagagatattcccgagcggtcctggaactctggctatgagtggatcacagacttccctgggaaaaccgtctggtttgttcccagcattaagtccggaaatgatatcgccaactgtctccgcaaaaatggcaagagagtgattcagctttctcggaagacattcgacaccgaataccagaaaacgaagaacaacgattgggactacgtggtcacaaccgacatcagcgagatgggggccaatttcagagctgatcgcgtgattgaccctcggagatgcctgaaacccgttatcctgaaggatggcccggaacgcgtgatcctcgccggacctatgcccgtcacagtggcgtccgctgcccagcggagaggccgcattgggcggaaccacaataaagagggagaccagtatatctacatgggccagcccctgaacaatgatgaggaccatgcccactggaccgaagctaagatgcttctggataacattaatacgcctgaggggatcattcccgccctctttgaacctgagagagaaaagagcgcggccatcgacggagagtatcgcctgagaggcgaggctcggaaaaccttcgttgaactgatgcgcagaggggatctcccggtgtggctttcttacaaggtcgcctccgagggctttcaatatagcgaccggcgctggtgcttcgatggagaaagaaacaatcaggtgctggaggaaaacatggacgtcgagatctggacaaaagagggcgaacggaagaaactgagaccccgctggctcgatgctcggacctactccgaccctctggcccttagagagtttaaggagttcgctgccgggcgccggtctgtgagcggagacctgattctcgagatcggcaaactgccccagcacctgacacagagagcgcaaaatgccctcgataaccttgttatgctgcataattccgaacaagggggacgggcttatcgccacgccatggaggagctgcctgacaccattgaaacactcatgctgcttgctctgatcgccgtgctcaccggcggcgtgacgctgtttttcctgtctgggagaggactcggcaagacaagcattgggcttctgtgtgtcatggcctccagcgttctgctctggatggcttctgtggagccccattggatcgcggcctccatcattctggaatttttccttatggtgctgctcatcccggagcctgatcggcagcgcacaccccaggacaaccaactggcttacgtcgtgattggactgctctttatgatccttaccgttgccgccaatgagatgggcctgctggaaacaaccaagaaagatctcgggattggacacgtggctgtcgagaaccaccatcacgccgcgatgctggacgtggatcttcatcctgccagcgcttggacactgtacgccgtcgctacgaccatcattacacccatgatgagacacaccatcgaaaacacaaccgccaatatctctctcacggcgattgccaaccaggctgccatcctgatgggcctggacaagggctggcctatttccaaaatggatatcggggtgcccctccttgctctgggatgctatagccaggttaatccgctgaccctcacagccgctgtgctgatgcttgtcgcccattacgcgattatcggccctgggctgcaagccaaggctacccgggaggcccagaaacgcacagctgccggaatcatgaagaaccccaccgtggacggcattgttgccatcgatctcgaccccgtggtctatgatgcgaagttcgaaaaacagctggggcagattatgctgctcatcctttgtacgtctcaaattctgctgatgagaacaacctgggctctctgcgagagcatcacactggccaccggacctcttaccacactgtgggagggctccccgggcaagttttggaatacgaccatcgctgtgtctatggccaacattttccgggggagctacctcgccggagctggcctggccttctccctgatgaaaagcctcgggggaggccgcagagggacaggagcgcagggcgaaacccttggcgagaagtggaaacggcagctgaatcagctgtccaagtctgaatttaacacatataagagaagcgggatcatggaggtggaccgctccgaagccaaagagggactcaagcggggcgagaccacgaaacacgctgtttctagagggacagccaagctgcgctggttcgtcgaacggaatcttgtgaaacccgagggaaaggtgattgacctgggctgtgggagaggaggctggagctactattgcgctggcctcaagaaagtcaccgaagttaaggggtacaccaaaggaggccctgggcacgaggaacccatccctatggccacatacggatggaacctggtgaagctgcattccggcaaagatgtgtttttcattccccctgagaagtgtgacaccctcctttgcgatatcggggagtctagcccgaatcccacaattgaagagggacgcacgctgcgggtcctgaaaatggtggaaccttggctcagaggcaaccaattttgtatcaagatcctgaatccctatatgccttccgttgtggagacccttgagcagatgcagcgcaagcacggcgggatgctggtccggaaccccctcagcagaaattctacacatgaaatgtactgggtgtcctgcggaaccggcaacattgttagcgcggtgaatatgacatctcgcatgctgctgaaccggttcaccatggcccacagaaaaccgacgtatgagcgcgacgtcgatctcggggctggaaccagacacgtggccgtggaacctgaggtcgctaacctggacatcattggccagcggatcgaaaatattaagcatgagcacaaatccacatggcattacgatgaggacaacccctataagacctgggcctaccacgggagctatgaagttaaaccctctggatccgctagctccatggtgaatggcgtggtcaaacttctgacaaagccttgggatgtgatccccatggttacccaaatcgccatgacagacaccacgccttttggccagcagcgcgtgttcaaagagaaggtcgatacaagaaccccgaaagcgaagcgggggaccgcccaaattatggaagtgacagctaaatggctctggggatttctgagcagaaacaagaagccccggatctgtacgcgcgaggagttcaccagaaaagttcggtctaatgccgctattggcgccgtgtttgtcgacgagaaccagtggaatagcgccaaggaggcggtggaagacgagcgcttctgggatcttgttcatagagaacgggagctgcacaaacaggggaagtgcgctacatgcgtgtacaacatgatgggaaaacgcgaaaagaagctcggcgagtttgggaaagccaagggctccagagccatctggtacatgtggctgggagctcggttcctggagttcgaagccctcggctttatgaatgaggaccactggttcaaccgcgaaaattctctgagcggggtcgagggagagggccttcataaactggggtatattctcagagatatctccaagatccctggaggcaacatgtacgctgacgataccgccgggtgggacacacggattaccgaagatgacctgcagaatgaggcgcgcatcacagatattatggaacccgagcacgcccttctggctagatctatctttaaactcacctatcaaaacaaggtggtccgggtgcagcgccctgccaaaaatggcacggttatggacgtgattagcagacgggatcagagaggatccggccaggtcgggacctacggactgaacacattcaccaacatggaagctcaactgatccgccagatggagtctgagggcatctttagcccctccgaactcgagacaccgaatctggccgaacgggtgcttgactggctggagaagtatggggtggaaagactcaagcgcatggcgattagcggagatgactgtgttgtgaaacctatcgacgatcggttcgccaccgctctgacggcccttaacgacatgggcaaggtcagaaaagatattccccagtgggagccttctaaggggtggaatgactggcagcaagtgcccttttgctcccatcacttccaccagctgatcatgaaagatggccgcgagattgttgtgccttgtcggaaccaggacgaactcgtcggcagagctcgcgtgagccagggcgccgggtggtctctgcgggagacagcttgcctgggaaagtcctacgcccaaatgtggcagctcatgtattttcatagacgcgatctgcggcttgcggccaatgctatctgtagcgccgtccccgtggactggattccgacctccagaacaacctggtctatccacgcccatcaccagtggatgacgaccgaagatatgctgagcgtttggaaccgggtgtggatcgaggaaaatccttggatggaggacaagacacatatttccagctggggcgatgtcccctacctcgggaaaagagaggaccaatggtgcggatctctgatcggccttaccgctcgcgccacatgggcgaccaacattcaggtggctatcaatcaggttcggagactgattgggaacgaaaattacctcgactatatgacatccatgaagcgcttcaaaaacgagagcgatcccgaaggcgccctgtggtga

SEQ ID NO: 18851 - RNA, 9879 nt, synthetic construct
  misc_feature 1..9879: note = derived and/or modified CDS sequence (opt5) from DENV-1__FJ024428__SS-prME
  source 1..9879: mol_type = other RNA
agcgtgaccatgctgctcatgctgatgcccacagcccttgctttccacctgacgaccagaggcggggaacctcatatgatcgtgtccaagcaagaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgaccgctctttttctggcccatgcgatcgggacctctattacacagaagggaatcatcttcattctcctgatgcttgtcacgcctagcatggccatgagatgcgtgggcatcgggtcccgggattttgttgagggactgagcggcgctacctgggtggacgtcgtgctcgagcacgggtcttgtgtgacaaccatggccaaggataaacccacactggacattgaactgctcaagaccgaggtcacgaaccctgctgttctgcgcaaactttgcatcgaagccaagatttccaatacaaccaccgatagcagatgtccgacacaaggagaggcgaccctggtggaagaacaagacgccaacttcgtgtgccggcgcacatttgtcgatagaggctggggcaatgggtgtggactcttcggcaaagggtctctgatcacgtgcgctaagtttaagtgcgtgaccaaacttgagggaaagattgttcagtacgaaaacctgaaatattccgtgatcgtcacagtgcacaccggcgaccagcatcaagttgggaatgagagcacagaacacggaaccacggccaccatcacaccccaggctcctaccacagagattcagctcaccgactacggcgccctgacgctggattgttctccccggacaggcctcgacttcaacgaaatggtgctgcttaccatgaaggagaaatcctggctggtccataagcagtggtttctcgatctgcctcttccctggacaagcggggcctccacctctcaagagacctggaatcgccaggacctgctcgtgacattcaaaacggctcacgcgaagaagcaggaagtcgtggttctgggaagccaagagggcgccatgcacaccgctctgacaggggccaccgaaatccagacatccggaaccacgacaatttttgccggccatctcaaatgcagactgaagatggataaacttaccctgaaggggatgagctatgtgatgtgtaccggctctttcaaactcgagaaggaactggctgagacacagcacggaaccgtcctggtgcagatcaagtacgagggcacagacgccccgtgcaaaattcctttctccacgcaagatgaaaagggggttacccagaacggacggcttatcacagcgaatcccatcgtgaccgacaaagagaagcctgtcaacattgaagctgagccgccctttggcgagagctatatcgtgattggggccggagaaaaagccctcaagctgtcttggttcaagaaaggcagctccatcgggaagatgtttgaggctacagccagaggcgctcgccggatggccattctgggagataccgcgtgggacttcggctctatcgggggagtgtttacgagcgttggcaaactcgtccatcagatcttcgggaccgcctacggagtgctgttttccggcgtgagctggacaatgaagattgggatcggcgtccttctgacctggctcggactcaattctagatccacaagcctgtctatgacctgtattgctgtgggccttgttacactctacctgggggtgatggtccaggccgattccggatgcgtgatcaactggaaaggccgcgaactgaagtgtgggagcggaattttcgttaccaatgaggtgcacacgtggacagaacaatataagtttcaggctgactcccctaaacggctctctgccgcgatcggcaaggcctgggaggagggggtctgcggcattagaagcgctacccgcctggaaaacatcatgtggaaacagatctccaacgagcttaatcatattctgctcgaaaacgacatgaagttcaccgtggttgtgggagatgtcgccggcatcctggctcaggggaaaaagatgattcggccgcaacccatggagcacaaatactcttggaaaagctggggaaaggccaagatcattggcgccgacgtgcagaatacaacctttatcatcgatgggcctaacacgcccgaatgtcctgacgatcagagagcttggaatatttgggaggtggaggactatggattcggcatctttacaaccaacatttggctgaaacttcgcgattcctacacacaggtctgcgaccaccggctcatgagcgcggccatcaaagattctaaggctgttcatgccgacatgggctattggattgaatccgagaaaaatgaaacctggaagctggccagagctagcttcatcgaggtgaagacatgtatctggcccaaatctcacaccctgtggtccaacggggtgctcgaaagcgagatgattatcccgaagatttacggaggccctatctctcaacataattatcgccccgggtacttcacgcagaccgccggaccttggcacctgggcaaacttgagctggattttgacctctgcgaagggacaaccgtcgtggttgatgagcactgcggaaaccggggccccagcctgagaacaaccacggtgacaggcaagattatccatgaatggtgttgccggtcctgtaccctgcctccccttcgcttcagaggggaggacggatgctggtacggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgacagggacccttgctgtgttctttctgctcatcgttggacagctgacctggaacgatctgattagactttgcatcatggtgggcgccaatgcctctgaccgcatgggcatggggacaacgtatctggctctcatggccaccttcaagatgagacctatgtttgcggtcggactgctgttccggcgcctgacaagcagagaggtgcttctgctcaccattggcctgtccctggtggcttctgtcgaacttcccaacagcctggaggaactcggggatggactggccatgggcatcatgatcctcaaactgcttacagactttcaatcccaccagctgtgggccaccctcctgagcctgacgttcattaagacaaccttttctcttcattacgcttggaaaaccatggccatggttctgtccgtggtgagcctcttccccctgtgtctctctacaacctcccagaagacaacgtggctgcctgtccttctggggagcctgggatgcaagccgctcaccatgtttctgatcgctgagaataaaatttggggccggcgctcttggccccttaacgaaggcatcatggccgtggggattgtttccatcctgctcagctccctgctcaagaacgatgtgcctctggcgggaccccttatcgccggcgggatgctgattgcttgttatgtcatcagcggatctagcgccgacctgtccctcgagaaagctgccgaggtgtcttgggaagaggaagccgagcacagcggcgcttcccataatattctggttgaagtgcaggatgacgggacaatgaagatcaaagatgaggagagagacgatacccttacaattctgctcaaggcgaccctgctcgccgtctctggagtgtaccctctgagcatccccgctacgcttttcgtctggtatttctggcagaagaagaagcagcggtccggcgtgctgtgggacaccccttctcccccggaagttgagcgcgccgtgctggatgacggcatctacagaattatgcagcgggggctcctgggacgcagccaggtcggcgtgggggtttttcaagaaaacgtgttccacacaatgtggcacgtcaccagaggagccgtgcttatgtatcagggcaaacggctggagccttcctgggctagcgtgaagaaagacctcatctcttacgggggaggctggagactgcagggctcctggaatacaggggaggaagttcaggtcattgccgtggagcccggaaagaaccctaaaaatgtgcaaaccgcgcccggcacatttaagacgccggaaggggaggtcggagctatcgccctcgatttcaagcctggcaccagcgggtctcccattgtgaaccgcgaaggaaaaatcgttggcctgtacggcaatggggtggtcacaacctccggaacctatgtgagcgccattgctcaggccaaggcgtcccaggagggccctcttcccgagatcgaagacgaggtttttcggaaaagaaacctgacaatcatggatctgcatcccgggtctggaaagacgcgccggtacctccctgctattgtgagagaagccatcaaacgcaagctgcggacccttattctggccccgacaagagtcgtggctagcgagatggccgaagctctcaagggcatgcccatccgctatcaaaccacagccgttaaatccgagcacaccgggaaggagattgtggacctgatgtgccatgcgacgttcacaatgcggctgctcagccctgtcagagtgcccaattacaacatgatcatcatggatgaagcccactttaccgacccttcttccattgctgcccggggctatatcagcacccgcgtgggaatgggcgaggctgccgccattttcatgacagctacaccccctgggtctgtcgaagcgtttccgcagagcaatgccgttatccaggatgaggaaagagacattcccgagcggtcctggaactctggatacgagtggatcacagatttccctggcaaaaccgtgtggtttgtgcccagcatcaagtccgggaatgacattgctaactgtcttcgcaaaaatggaaagagagtcatccagctgtctcggaagacgttcgatacagaatatcagaagaccaagaacaacgactgggactacgtggttacaaccgatattagcgagatgggcgccaatttcagagccgaccgcgtgatcgatcctcggagatgcctgaaacccgtcattctcaaggacgggccggaacgcgtgatcctggctggccctatgcccgttacggtggcctccgcggctcagcggagaggacgcattggccggaaccataataaagagggggatcagtacatctatatgggacagccccttaacaatgacgaggatcacgcccactggaccgaagccaagatgctgctcgacaacatcaatacacctgagggcattatccccgctctgtttgaacctgagagagaaaagagcgccgcgattgatggggagtaccgcctgagaggagaggcccggaaaaccttcgtcgaactcatgcgcagaggcgaccttccggtgtggctgtcttataaggtcgcttccgaggggtttcaatacagcgatcggcgctggtgcttcgacggcgaaagaaacaatcaggtgctggaggaaaacatggatgttgagatctggacaaaagagggagaacggaagaaactcagaccccgctggctggacgcccggacctattccgaccctcttgctctgagagagtttaaggagttcgccgctggccgccggtctgtgagcggggatctcattctggagatcggaaaactgccccagcatctcacacagagagcccaaaatgcgcttgacaacctggtgatgctgcacaattccgaacagggcgggcgggcctaccgccatgctatggaggagctccctgataccatcgaaacgctgatgcttctggccctcattgctgtcctgacaggaggcgttaccctgtttttcctctctggcagagggcttggaaagaccagcatcggcctgctgtgtgtgatggcctccagcgtgctcctgtggatggcctctgtcgagccccactggattgctgcgtccatcattcttgaatttttcctgatggtgctcctgatcccggagcctgaccggcagcgcacaccccaggataaccaactggcctatgttgtgatcgggctcctttttatgattctgaccgtcgctgccaatgagatgggactgctcgaaacaacgaagaaagacctgggcatcgggcacgtggccgtcgagaaccatcaccatgctgccatgcttgatgtggacctgcaccctgcgagcgcctggaccctctacgctgttgccacaaccattatcacacccatgatgagacataccattgaaaacacgaccgctaatatctctctgacagccattgcgaaccaggccgctatcctgatgggactcgataagggctggcctatctccaaaatggacattggcgtgccccttctggccctggggtgctacagccaggtcaatccgctcaccctgacagctgccgtgcttatgctggttgctcactatgccatcattggacctggcctccaagcgaaggccacccgggaggctcagaaacgcacggccgctgggatcatgaagaaccccacagtggatggaattgtcgccatcgacctggatcccgtggtgtacgacgccaagttcgaaaaacagctgggccagatcatgctccttattctgtgtacctctcaaatcctgctcatgagaacaacctgggcgctgtgcgagagcattacccttgctacagggcctctgacgaccctctgggagggatccccgggcaagttttggaatacaaccatcgccgtttctatggctaacattttccggggcagctatctggccggggccggactggctttctccctcatgaaaagccttggcgggggacgcagaggcacaggggcccagggagaaaccctgggcgagaagtggaaacggcagctgaatcagctctccaagtctgaatttaacacgtacaagagaagcggcatcatggaggtcgaccgctccgaagcgaaagaggggctgaagcggggagagacaaccaaacacgccgtgtctagaggcaccgctaaacttcgctggttcgtggaacggaatctggtcaaacccgaggggaaggttatcgatctcggatgtggcagagggggatggagctattactgcgccggcctgaagaaagtgacagaagtgaagggctataccaaagggggacctggccatgaggaacccattcctatggctacatacgggtggaacctggtcaagctccactccggaaaagacgtgtttttcattccccctgagaagtgtgatacgcttctgtgcgacatcggcgagtctagcccgaatcccaccatcgaagaggggcgcacactgcgggttctcaaaatggtggaaccttggctgagaggaaaccaattttgtattaagatccttaatccctacatgccttccgtcgtggagaccctggagcagatgcagcgcaagcatggcggcatgctcgttcggaaccccctgagcagaaattctacacacgaaatgtattgggtgtcctgcgggaccggaaacattgtcagcgccgtgaatatgacgtctcgcatgctgctcaaccggttcaccatggcgcacagaaaaccgacatacgagcgcgatgtggacctgggcgccgggaccagacatgtcgctgttgaacctgaggtggccaaccttgatatcatcggacagcggattgaaaatatcaagcacgagcataaatccacatggcactatgacgaggataacccctacaagacctgggcttatcatggcagctacgaagtgaaaccctctgggtccgccagctccatggtcaatggagtggttaagctgctcacaaagccttgggacgtgattcccatggtcacccaaatcgctatgacggatacaaccccttttggccagcagcgcgtgttcaaagagaaggttgacaccagaacaccgaaagccaagcggggcacggcgcaaattatggaagtgaccgccaaatggctgtgggggtttcttagcagaaacaagaagccccggatctgtacacgcgaggagttcaccagaaaagtccggtctaatgctgccatcggagctgtgtttgttgacgagaaccagtggaatagcgccaaggaggccgtggaagatgagcgcttctgggacctggtccacagagaacgggagctccacaaacagggcaagtgcgcgacatgcgtgtataacatgatggggaaacgcgaaaagaagctgggagagtttggcaaagctaaggggtccagagccatttggtacatgtggctgggcgcccggttcctcgagttcgaagctctgggatttatgaatgaggatcattggttctctcgcgaaaacagcctttccggcgtcgagggggagggactgcacaaactcggctacatcctgagagacatttctaagatccctgggggaaatatgtatgccgatgacaccgctggctgggatacacggattaccgaagacgatcttcagaacgaggcccgcatcacggacatcatggaacccgagcatgcgctgctcgccaaaagcatttttaagctgacctaccaaaataaagtggttagagtgcagcggcctgctaagaacgggacagtcatggatgtgatctcccgcagagaccagcggggctctggacaggtgggcacctatgggctgaatacattcaccaacatggaagcccaactcattagacagatggagagcgagggaatcttttcccccagcgaactggagacgccgaaccttgctgaacgcgttctggattggctcgagaagtacggcgtggaacggctgaaaagaatggccatttctggggacgactgtgtcgtgaagcctatcgatgaccgcttcgcgacagcccttaccgctctgaatgatatgggaaaagttcggaaggacatcccccagtgggagccttccaaaggctggaacgattggcagcaagtgcccttttgcagccaccacttccatcagctcattatgaaggacgggagagagatcgtcgtgccttgtcgcaatcaggatgaactggtcggccgggccagagtgtctcagggagctggctggtccctgcgcgagacagcctgcctcggaaagagctatgctcaaatgtggcagctgatgtactttcaccggagagaccttcgcctggccgcgaacgccatttgttccgctgttcccgtggattggatcccgacctctcggacgacctggagcattcatgcccaccatcagtggatgacaaccgaagacatgctctccgtctggaatagagtgtggatcgaggaaaacccttggatggaggataaaacacacattagctcttggggagacgttccctatctgggcaagcgggaggaccaatggtgcgggtcccttatcggactgaccgccagagctacatgggccaccaatatccaggtggcgattaaccaggtccgccggctcatcggcaatgaaaactacctggattacatgacgagcatgaaaagattcaagaatgagtctgaccccgaaggggctctgtggtga

SEQ ID NO: 18852 - RNA, 9879 nt, synthetic construct
  misc_feature 1..9879: note = derived and/or modified CDS sequence (opt5) from DENV-1__FJ024429__SS-prME
  source 1..9879: mol_type = other RNA
agcgtgaccatgctgctcatgctgatgcccaccgcccttgctttccacctgacgacccggggcggggagcctcatatgatcgtgtccaagcaggaacgggggaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttatgacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagttcaccgtggttgtgggagatgtcgccggcattctcgctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaagctgcgcgattcctacacccaggtctgcgaccaccggcttatgagcgcggccattaaagattctaaggctgttcatgccgacatgggctattggatcgaatccgagaaaaatgaaacatggaagctcgccagagctagcttcatcgaggtgaagacctgtatttggcccaaatctcacacactgtggtccaacggggtgctggaaagcgagatgatcattccgaagatctacggaggccctatttctcaacataattatcgccccgggtacttcacccagatcgccggaccttggcacctcggcaaactggagcttgattttgacctgtgcgaagggacgaccgtcgtggttgatgagcactgcggaaaccggggccccagcctcagaacaaccacagtgaccggcaagatcattcatgaatggtgttgccggtcctgtacgctgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgacagggaccctggctgtgttctttcttctgatcgttggacagctcacatggaacgatctgattagactgtgcatcatggtgggcgccaatgcctctgaccgcatgggcatggggaccacctatcttgctctgatggccacattcaagatgagacctatgtttgcggtcggactcctgttccggcgcctcacgagcagagaggtgctgcttctgaccatcggcctctccctggtggcttctgtcgaactgcccaacagccttgaggaactgggggatggactcgccatgggcattatgatcctgaaactcctgacagactttcaatcccaccagctttgggccaccctgctcagcctgacattcattaagaccacgttttctctgcattacgcttggaaaacaatggccatggttctttccgtggtgagcctgttccccctctgtctgtctaccacctcccagaagacaacctggctccctgtcctgcttgggagcctgggatgcaagccgctgacaatgtttctcatcgctgagaataaaatttggggccggcgctcttggcccctgaacgaaggcatcatggccgtggggatcgtttccattcttctgagctccctcctgaagaacgatgtgcctctcgcgggacccctgatcgccggcgggatgcttattgcttgttatgtcatcagcggatctagcgccgacctgtccctggagaaagctgccgaggtgtcttgggaagaggaagccgagcacagcggcgcttcccataatattctcgttgaagtgcaggatgacgggacgatgaagatcaaagatgaggagagagacgataccctgacaatccttctgaaggcgaccctcctggccgtctctggagtgtaccctctcagcattcccgctacactgttcgtctggtatttctggcagaagaagaagcagcggtccggcgtgctttgggacaccccttctcccccggaagttgagcgcgccgtgctggatgacggcatctacagaattatgcagcgggggctgctcggacgcagccaggtcggcgtgggggtttttcaagaaaacgtgttccacacgatgtggcacgtcaccagaggagccgtgctgatgtatcagggcaaacggcttgagccttcctgggctagcgtgaagaaagacctgatctcttacgggggaggctggagactccagggctcctggaatacaggggaggaagttcaggtcattgccgtggagcccggaaagaaccctaaaaatgtgcaaaccgcgcccggcacatttaagaccccggaaggggaggtcggagctatcgccctggatttcaagcctggcacaagcgggtctcccattgtgaaccgcgaacggaaaatcgttggactctacggcaatggcgtggtcacgacctccgggacatatgtgagcgccatcgctcaggccaaggcgtcccaggagggacctctgcccgagattgaagacgaggtttttagaaaacgcaaccttaccatcatggatctgcatcccggctctgggaagacccggagatacctgcctgctattgtgcgcgaagccatcaaacggaagctcagaacactgattcttgccccgacgcgcgtcgtggctagcgagatggccgaagctctgaagggaatgcccatccggtatcaaaccacagccgttaaatccgagcacaccggcaaggagatcgtggacctcatgtgccatgcgacattcaccatgagactgctgagccctgtccgggtgcccaattacaacatgattatcatggatgaagcccactttacggacccttcttccattgctgcccgcgggtatatcagcacaagagtgggcatgggagaggctgccgccattttcatgaccgctacaccccctggctctgtcgaagcgtttccgcagagcaatgccgttatccaggatgaggaacgggacatccccgagcgctcctggaactctgggtacgagtggattacagatttccctggaaaaaccgtgtggtttgtgcccagcatcaagtccggcaatgacattgctaactgtctccgcaaaaatgggaagcgggtcatccagctttctagaaagacattcgataccgaatatcagaaaacgaagaacaacgactgggactacgtggttacaaccgatattagcgagatgggagccaatttccgcgccgaccgggtgatcgatcctagacgctgcctgaaacccgtcattctgaaggacggcccggaacgggtgatcctcgctgggcctatgcccgttacagtggcctccgcggctcagagacgcggccggatcggaagaaaccataataaagagggcgatcagtacatttatatggggcagcccctgaacaatgacgaggatcacgcccactggaccgaagccaagatgcttctggacaacatcaatacgcctgagggaattatccccgctctctttgaacctgagcgcgaaaagagcgccgcgattgatggcgagtacagactgagaggggaagcccgcaaaaccttcgtcgaactgatgagacggggagacctcccggtgtggctttcttataaggtcgcttccgagggctttcaatacagcgatcgcagatggtgcttcgacggggaacggaacaatcaggtgctggaggaaaacatggatgttgagatctggacaaaagagggcgaaagaaagaaactgcgcccccggtggctcgacgccagaacctattccgaccctctggctcttagagagtttaaggagttcgccgctggacggagatctgtgagcggcgatctgatcctcgagattgggaaactgccccagcatctgacacagcgggcccaaaatgcgctcgacaaccttgtgatgctgcacaattccgaacagggaggccgcgcctacagacatgctatggaggagctgcctgataccatcgaaacactcatgctgcttgccctgattgctgtcctcaccgggggagttacgctgtttttcctgtctggccggggcctcgggaagacaagcatcggacttctgtgtgtgatggcctccagcgtgctgctctggatggcctctgtcgagccccactggattgctgcgtccatcatcctggaatttttccttatggtgctgctcattccggagcctgaccgccagagaacaccccaggataaccaactggcctatgttgtgatcggcctgctctttatgattcttaccgtcgctgccaatgagatggggctgctggaaacaaccaagaaagacctcggaatcggccacgtggccgtcgagaaccatcaccatgctgccatgctggatgtggaccttcaccctgcgagcgcctggacactgtacgctgttgccacgaccattatcacacccatgatgcggcataccattgaaaacacaaccgctaatatctctctcacggccatcgcgaaccaggccgctattctgatggggctggataagggatggcctatctccaaaatggacattggcgtgcccctccttgccctgggctgctacagccaggtcaatccgctgaccctcacagctgccgtgctgatgcttgttgctcactatgccatcattgggcctggactgcaagcgaaggccacccgcgaggctcagaaaagaacagccgctggcatcatgaagaaccccaccgtggatgggatcgtcgccattgacctcgatcccgtggtgtacgacgccaagttcgaaaaacagctgggacagatcatgctgctcattctttgtacgtctcaaatcctgctgatgcggacaacctgggcgctctgcgagagcattacactggctaccggccctcttaccacactgtgggaggggtccccgggaaagttttggaatacgaccatcgccgtttctatggctaacatcttccgcggcagctatctcgccggcgccgggctggctttctccctgatgaaaagcctcggaggcgggagacggggaacaggcgcccagggggaaacccttggagagaagtggaaaagacagctgaatcagctgtccaagtctgaatttaacacatacaagcgcagcggcattatggaggtcgaccggtccgaagcgaaagagggcctcaagagaggggagaccacgaaacacgccgtgtctcgcggaacagctaagctgcggtggttcgtggaaagaaatcttgtcaaacccgagggcaaggttatcgatctggggtgtggacgcggcgggtggagctattactgcgccggactcaagaaagtgaccgaagtgaagggctataccaaaggcgggcctggacatgaggaacccattcctatggctacatacggctggaacctggtcaagctgcactccgggaaagacgtgtttttcattccccctgagaagtgtgataccctcctttgcgacattggagagtctagcccgaatcccacaatcgaagagggccggacgctgagagttctgaaaatggtggaaccttggctccgcgggaaccaattttgtattaagatcctgaatccctacatgccttccgtcgtggagacccttgagcagatgcagcggaagcatggaggcatgctggttagaaaccccctcagccgcaattctacacacgaaatgtattgggtgtcctgcggcaccgggaacatcgtcagcgccgtgaatatgacatctcggatgctgctgaacagattcaccatggcgcaccgcaaaccgacgtacgagagagatgtggacctcggagccggcacccggcatgtcgctgttgaacctgaggtggccaacctggatattatcgggcagcgcattgaaaatatcaagcacgagcataaatccacatggcactatgacgaggataacccctacaagacctgggcttatcatggaagctacgaagtgaaaccctctggctccgccagctccatggtcaatggggtggttaaacttctgacaaagccttgggacgtgattcccatggtcacccaaatcgctatgacagataccacgccttttggacagcagagagtgttcaaagagaaggttgacacacggaccccgaaagccaagagaggcaccgcgcaaatcatggaagtgacagccaaatggctctggggctttctgagccggaacaagaagccccgcatttgtacgagagaggagttcacccggaaagtccgctctaatgctgccatcggggctgtgtttgttgacgagaaccagtggaatagcgccaaggaggccgtggaagatgagagattctgggaccttgtccaccgggaacgcgagctgcacaaacagggaaagtgcgcgacatgcgtgtataacatgatgggcaaaagagaaaagaagctcggggagtttggaaaagctaagggctcccgggccatttggtacatgtggctgggggcccgcttcctggagttcgaagctctcggctttatgaatgaggatcattggttctctagagaaaacagcctgtccggagtcgagggcgaggggcttcacaaactgggatacatcctccgggacatttctaagatccctggcgggaatatgtatgccgatgacaccgctggatgggatacacgcatcaccgaagacgatctgcagaacgaggccagaattacagacatcatggaacccgagcatgcgcttctggccaaaagcatttttaagctcacctaccaaaataaagtggttcgggtgcagcgccctgctaagaacggcacggtcatggatgtgatctccagacgggaccagagagggtctggccaggtgggaacctatggcctgaatacattcaccaacatggaagcccaactgattcgccagatggagagcgaggggatcttttcccccagcgaactcgagacaccgaacctggctgaacgggttcttgattggctggagaagtacggagtggaaagactcaaacgcatggccatctctggcgacgactgtgtcgtgaagcctattgatgaccggttcgcgaccgccctgacggctcttaatgatatggggaaagttagaaaggacatcccccagtgggagccttccaaaggatggaacgattggcagcaagtgcccttttgcagccaccacttccatcagctgattatgaaggacggccgcgagatcgtcgtgccttgtcggaatcaggatgaactcgtcgggagagcccgcgtgtctcagggcgctggatggtccctgcgggagacagcctgcctgggcaagagctatgctcaaatgtggcagctcatgtactttcacagacgcgacctgcggcttgccgcgaacgccatttgttccgctgttcccgtggattggatcccgacctctagaacaacctggagcattcatgcccaccatcagtggatgacgaccgaagacatgctgtccgtctggaatcgggtgtggatcgaggaaaacccttggatggaggataaaacacacatcagctcttggggagacgttccctatctcggaaagagagaggaccaatggtgcggctccctgattgggcttaccgcccgcgctacatgggccaccaatatccaggtggcgattaaccaggtccggagactgatcggaaatgaaaactacctcgattacatgacaagcatgaaacgcttcaagaatgagtctgaccccgaaggcgctctgtggtga

SEQ ID NO: 18853 - RNA, 9879 nt, synthetic construct
  misc_feature 1..9879: note = derived and/or modified CDS sequence (opt5) from DENV-1__FJ024430__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgctcctgatcgctgagaataaaatttggggccggcgctcttggccccttaacgaaggcatcatggccgtcgggatcgtgtccattctgctcagctccctgctcaagaacgatgttcctctggcgggaccccttatcgccggcgggatgctgattgcttgttacgtgatcagcggatctagcgccgctctgtccctcgagaaagccgccgaggtctcttgggaagaggaagctgagcatagcggcgcgtcccacaatattctggtggaagttcaggacgatgggaccatgaagatcaaagacgaggagagagatgacacacttaccatcctgctcaaggccacactgctcgctgtgtctggagtctatcctctgagcattcccgccaccctttttgtgtggtacttctggcagaagaagaagcagcggtccggcgtcctgtgggatacgccttctcccccggaagtgggccgcgccgttctggacgatgggatctatagaattatgcagcggggactcctgggccgcagccaggtgggggtcggagtgttccaagagaacgtttttcataccatgtggcacgtgacaagaggcgctgtccttatgtaccaggggaaacggctggaaccttcctgggccagcgtgaagaaagacctcatctcttacggaggcggctggagactgcaggggtcctggaataccggagaggaggtgcaggttattgcggtcgaacccggcaagaaccctaaaaatgtgcaaacagctcccgggaccttcaagacaccggagggagaagtgggcgccatcgccctcgactttaagcctgggacgagcggatctcccattgtcaaccgcgagggcaaaatcgtgggcctgtatgggaatggagttgtgaccacatccggcacctacgtcagcgctatcgcccaggcgaaggcttcccaggaagggcctcttcccgagattgaggatgaagtgttccggaaaagaaacctgaccatcatggacctgcaccccggatctggcaagacacgccggtatctccctgccattgttagagaggccatcaaacgcaagctgcggacgcttattctggctccgaccagagtggtcgccagcgaaatggctgaggccctcaaggggatgcccatccgctaccaaacaaccgcggtgaaatccgaacatacaggcaaggagatcgttgatctgatgtgccacgccacctttacgatgcggctgctcagccctgtgagagtccccaattataacatgattatcatggacgaggctcatttcacagatccttcttccattgccgctcggggatacatcagcacccgcgtgggcatgggggaagccgccgctatttttatgaccgcgacaccccctggatctgtggaggccttcccgcagagcaatgctgtcatccaggacgaagagagagatatccccgaacggtcctggaactctggctatgagtggattaccgactttcctgggaaaacagtttggttcgtgcccagcatcaagtccggaaatgatattgccaactgtcttcgcaaaaatggcaagagagtgatccagctgtctcggaagacctttgacacggagtaccagaaaaccaagaacaacgattgggactacgtcgtgaccacagacattagcgaaatgggggccaatttcagagctgatcgcgttatcgaccctcggagatgcctgaaacccgtgattctcaaggatggcccggagcgcgtcatcctggccggacctatgcccgtgaccgttgcgtccgctgcccagcggagaggccgcatcgggcggaaccacaataaagaaggagaccagtatatttacatgggccagccccttaacaatgatgaggaccatgcccactggacggaggctaagatgctgctcgataacatcaatacccctgaagggattatccccgccctgttcgagcctgaaagagaaaagagcgcggccattgacggagaatatcgcctgagaggcgaggctcggaaaacatttgtggagctcatgcgcagaggggatcttccggtctggctgtcttacaaggtggcctccgaaggcttccaatatagcgaccggcgctggtgctttgatggagagagaaacaatcaggtcctggaagagaacatggacgtggaaatctggaccaaagagggcgagcggaagaaactcagaccccgctggctggatgctcggacatactccgaccctcttgccctgagagagttcaaggagtttgctgccgggcgccggtctgttagcggagacctcatcctggaaattggcaaactgccccagcacctcacccagagagcgcaaaatgcccttgataacctggtgatgctgcataattccgagcaagggggacgggcttatcgccacgccatggaggaactccctgacacaatcgagaccctgatgcttctggctctcattgccgtgctgacgggcggcgtcacactgttctttctctctgggagaggacttggcaagaccagcatcgggctgctgtgtgttatggcctccagcgtgctcctgtggatggcttctgtggaaccccattggattgcggcctccatcatccttgagttctttctgatggtcctcctgattccggaacctgatcggcagcgcacaccccaggacaaccaactggcttacgtggttatcggactccttttcatgattctgacagtggccgccaatgagatgggcctgctcgagaccacaaagaaagatctggggatcggacacgtcgctgtggaaaaccaccatcacgccgcgatgcttgacgtcgatctgcatcctgccagcgcttggacgctctacgccgtggctaccacaattatcacccccatgatgagacacacaattgagaacaccacggccaatatctctctgaccgcgatcgccaaccaggctgccattctgatgggcctcgacaagggctggcctatctccaaaatggatattggggttccccttctggctctgggatgctatagccaggtgaatccgctcacactgaccgccgctgtccttatgctggtggcccattacgcgatcattggccctgggctccaagccaaggctacacgggaagcccagaaacgcaccgctgccggaatcatgaagaaccccacggttgacggcatcgtggccattgatctggaccccgtcgtgtatgatgcgaagtttgagaaacagctggggcagatcatgctccttattctgtgtacatctcaaatcctgctcatgagaaccacatgggctctgtgcgaaagcattacccttgccaccggacctctgacaacgctctgggagggctccccgggcaagttctggaataccacaatcgctgtgtctatggccaacatctttcgggggagctacctggccggagctggcctggccttctccctcatgaaaagccttgggggaggccgcagagggaccggagcgcagggcgagacactgggcgaaaagtggaaacggcagctgaatcagctctccaagtctgagttcaacacctataagagaagcgggattatggaagttgaccgctccgaggccaaagaaggactgaagcggggcgagacgacaaaacacgctgtctctagagggaccgccaaacttcgctggtttgtggagcggaatctggtgaaacccgaaggaaaggtcatcgacctcggctgtgggagaggaggctggagctactattgcgctggcctgaagaaagttaccgaggtgaaggggtacacaaaaggaggccctgggcacgaggaacccattcctatggccacctacggatggaacctggtgaagctccattccggcaaagatgtcttctttattccccctgaaaagtgtgacacacttctgtgcgatattggggagtctagcccgaatcccacgatcgaggaaggacgcaccctgcgggtgctcaaaatggttgagccttggctgagaggcaaccaattctgtattaagatccttaatccctatatgccttccgtggtcgaaacactggagcagatgcagcgcaagcacggcgggatgctcgtgcggaaccccctgagcagaaattctacccatgagatgtactgggtttcctgcggaacaggcaacatcgtgagcgcggtcaatatgacctctcgcatgctgctcaaccggtttacgatggcccacagaaaaccgacctatgaacgcgacgtggatctgggggctggaacaagacacgtggccgtcgagcctgaagttgctaaccttgacattatcggccagcggattgagaatatcaagcatgaacacaaatccacctggcattacgatgaggacaacccctataagacatgggcctaccacgggagctatgaggtgaaaccctctggatccgctagctccatggtgaatggcgtcgtgaagctgctcaccaagccttgggatgttattcccatggtgacacaaatcgccatgaccgacacgacacctttcggccagcagcgcgtctttaaagaaaaggtggataccagaaccccgaaagcgaagcgggggacagcccaaatcatggaggttacggctaaatggctgtggggattccttagcagaaacaagaagccccggatttgtacccgcgaagagtttacaagaaaagtgcggtctaatgccgctatcggcgccgtcttcgtggacgaaaaccagtggaatagcgccaaggaggcggttgaggacgaacgcttttgggatctggtgcatagagagcgggaactccacaaacaggggaagtgcgctacctgcgtctacaacatgatgggaaaacgcgagaagaagctgggcgagttcgggaaagccaagggctccagagccatttggtacatgtggctgggagctcggtttctcgagttcgaggccctgggcttcatgaatgaagaccactggttttctcgcgagaacagcctttccggggtggaaggagagggcctgcataaactcgggtatatcctgagagatatttctaatatccctggaggcaacatgtacgctgacgatacagccgggtgggacacccggatcacagaggatgaccttcagaatgaagcgcgcattaccgatatcatggagcccgaacacgccctgctcgctaagagcattttcaaactgacgtatcaaaacaaggtcgtgagagttcagcggcctaccaaaaatggcacagtgatggacgtcatctcccgcagagatcagcggggatctggccaggtggggacctacggactgaacacatttaccaacatggaggcccaactcattagacagatggaaagcgagggcatcttctcccccagcgagctggaaacgccgaatcttgctgagcgcgtgctggactggctcgaaaagtatggggttgagcggctgaagagaatggccatctctggagatgactgtgtggtcaaacctgtggacgatcgctttgcgacagcccttaccgctctgaacgacatgggcaaggttcggaaagatattccccagtgggaaccttccaaggggtggaatgactggcagcaagtgcccttctgcagccatcactttcaccagctcatcatgaaagatggcagagagattgtcgtgccttgtcgcaaccaggacgagctggtcggacgggccagagtgtctcagggcgctgggtggtccctgcgcgaaacagcctgcctcggaaagagctacgctcaaatgtggcagctgatgtatttccatcggagagatcttcgcctggccgcgaatgccatctgttccgctgttcccgtggactggattccgacctctcggacgacctggagcatccacgcccatcaccagtggatgacaaccgaggatatgctctccgtctggaacagagtgtggattgaagagaatccttggatggaagacaagacacatatcagctcttggggcgatgttccctacctggggaaacgggaggaccaatggtgcggatcccttatcggcctgaccgccagagctacatgggccaccaacattcaggtggcgatcaatcaggtccgccggctcattgggaacgagaattacctggactatatgacgagcatgaagagatttaaaaacgaatctgatcccgagggcgctctgtggtga

SEQ ID NO: 18854 - RNA, 9879 nt, synthetic construct
  misc_feature 1..9879: note = derived and/or modified CDS sequence (opt5) from DENV-1__FJ024433__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggagctctgtgaagataccatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccatttctcaagagacatggaatcgccaggacctgctcgtgaccttcaaaaccgctcacgcgaagaagcaggaagtcgtggttctgggaagccaagagggcgccatgcacacagctctgacgggggccaccgaaatccagacatccggaaccacaaccatttttgccggccatctcaaatgcagactgaagatggataaacttacgctgcgggggatgagctatgtgatgtgtacaggctctttcaagctcgagaaagaagtcgctgagacccagcacggaaccgtgctggttcagatcaagtacgagggcacagacgccccgtgcaagatccctttctccacccaagatgaaaaaggggtgacacagaacggaagactgattacggcgaatcccatcgtcaccgacaaggagaaacctgtgaacattgaagctgagccgccctttggcgagagctatatcgtgattggggccggagaaaaggcccttaaactctcttggttcaagaagggcagctccatcgggaaaatgtttgaggctacagcccgcggcgctcggagaatggccatcctgggagataccgcgtgggacttcggctctattgggggagtttttacaagcgtcggcaagctggtgcatcagatcttcgggaccgcctacggagtgctcttttccggcgtcagctggacgatgaaaattgggatcggcgtgctgcttacctggctgggactcaattctcgctccacaagcctgtctatgacctgtattgctgttggcctggtgacactttacctcggggtcatggtgcaggccgattccggatgcgttatcaactggaagggccgggaactgaaatgtgggagcggaattttcgtgaccaatgaggtccacacatggaccgaacaatataagtttcaggctgactcccctaagagactgtctgccgcgatcggcaaagcctgggaggagggggtgtgcggcatccgcagcgctacgcggctcgaaaacattatgtggaagcagatctccaacgagctgaatcatattcttctggaaaacgacatgaaattcacagttgtggtcggagatgtggccggcatcctcgctcaggggaagaaaatgattagaccgcaacccatggagcacaagtactcttggaaaagctggggaaaggccaagatcatcggcgccgacgtgcagaataccacctttattatcgatgggcctaacacacccgaatgtcctgacgatcagcgcgcttggaatatttgggaggtcgaggactatggattcggcatctttaccacgaacatttggctgaaactgcgggattcctacacacaggtttgcgaccacagacttatgagcgcggccatcaaggattctaaagctgtgcatgccgacatgggctattggatcgaatccgagaagaatgaaacctggaaactcgcccgcgctagcttcattgaggtgaagacatgtatctggcccaagtctcacaccctgtggtccaacggggtcctggaaagcgagatgattatcccgaaaatttacggaggccctatctctcaacataattatcggcccgggtacttcacacagaccgccggaccttggcacctcggcaagctggagcttgattttgacctgtgcgaagggacgaccgtggttgtggatgagcactgcggaaacagaggccccagcctccggacaaccacagtcaccggcaaaatcattcatgaatggtgttgccgctcctgtacgctgcctcccctgagattcagaggggaagacggatgctggtacggcatggagatccggccggtgaaggaaaaagaggaaaatcttgttaagagcatggtgtctgcggggtccggagaggtcgacagcttttccctcggcctgctgtgtatttctatcatgattgaagaggtgatgcgcagccggtggtccagaaagatgctcatgacagggaccctggctgttttctttcttctgatcatgggacagctcacatggaacgatctgattcgcctgtgcatcatggtgggcgccaatgcctctgacagaatgggcatggggaccacctatcttgctctgatggccacattcaaaatgcggcctatgtttgcggtcggactcctgttccgcagactcacgagccgggaggtgctgcttctgaccatcggcctctccctggtggcttctgtcgaactgcccaacagccttgaggaactgggggatggactcgccatgggcattatgatcctgaagctcctgacagactttcaatcccaccagctttgggccaccctgctcagcctgacattcattaaaaccacgttttctctgcattacgcttggaagacaatggccatggttctttccatcgtgagcctgttccccctctgtctgtctaccacctcccagaaaacaacctggctccctgtgctgcttgggagcctgggatgcaagccgctgacaatgtttctcattgctgagaataagatctggggccgcagatcttggcccctgaacgaaggcatcatggccgtcgggattgtgtccatccttctgagctccctcctgaaaaacgatgttcctctcgcgggacccctgattgccggcgggatgcttatcgcttgttatgtgattagcggatctagcgccgacctgtccctggagaaggctgccgaggtctcttgggaagaggaagccgagcacagcggcgcttcccataatatcctcgtggaagttcaggatgacgggacgatgaaaatcaaggatgaggagcgggacgataccctgacaattcttctgaaagcgaccctcctggccgtgtctggagtctaccctctcagcatccccgctacactgttcgtgtggtatttctggcaaaagaaaaagcagcgctccggcgtcctttgggacaccccttctcccccggaagtggagagagccgttctggatgacggcatttaccggatcatgcagcgcgggctgctcggaagaagccaggtgggcgtcggggtgtttcaagaaaacgttttccacacgatgtggcacgtgacccggggagccgtcctgatgtatcagggcaagagacttgagccttcctgggctagcgtgaaaaaggacctgatttcttacgggggaggctggcgcctccagggctcctggaatacaggggaggaagtgcaggttatcgccgtcgagcccggcaagaaccctaagaatgtgcaaaccgcgcccggcacatttaaaaccccggaaggggaggtgggagctattgccctggatttcaagcctggcacaagcgggtctcccatcgtcaaccgggaaggaaagatcgtgggcctctacggcaatggggttgtgacgacctccggaacatatgtcagcgccattgctcaggccaaagcgtcccaggagggccctctgcccgagatcgaagacgaggtgtttagaaagcgcaaccttaccattatggatctgcatcccgggtctggaaaaacccggagatacctgcctgctatcgttcgcgaagccattaagcggaaactcagaacactgatccttgccccgacgcgcgtggtcgctagcgagatggccgaagctctgaagggcatgcccatccggtatcaaaccacagccgtgaagtccgagcacaccgggaaagagattgttgacctcatgtgccatgcgacattcaccatgagactgctgagccctgtgcgggtccccaattacaacatgatcattatggatgaagcccactttacggacccttcttccatcgctgcccgcggctatattagcacaagagtgggaatgggcgaggctgccgccatcttcatgaccgctacaccccctgggtctgtggaagcgtttccgcagagcaatgccgtcatccaggatgaggaacgggacattcccgagcgctcctggaactctggatacgagtggatcacagatttccctggcaagaccgtttggtttgtgcccagcattaaatccgggaatgacatcgctaactgtctcagaaagaatggaaaacgggtgattcagctttctagaaagacattcgataccgaatatcaaaagacgaaaaacaacgactgggactacgtcgtgacaaccgatatcagcgagatgggcgccaatttccgcgccgaccgggttattgatcctagacgctgcctgaagcccgtgatcctgaaagacgggccggaacgggtcatcctcgctggccctatgcccgtgacagttgcctccgcggctcagagacgcggacggattggcagaaaccataataaggagggggatcagtacatctatatgggacagcccctgaacaatgacgaggatcacgcccactggaccgaagccaaaatgcttctggacaacattaatacgcctgagggcatcattcccgctctctttgaacctgagcgcgaaaagagcgccgcgatcgatggggagtacagactgcggggagaggcccgcaagaccttcgtggaactgatgagacggggcgacctcccggtctggctttcttataaagtggcttccgaggggtttcaatacagcgatcgcagatggtgcttcgacggcgaacggaacaatcaggtcctggaggaaaacatggatgtggagatctggacaaaggagggagaacgcaagaagctgcgcccccggtggctcgacgccagaacctattccgaccctctggctcttagagagtttaaagagttcgccgctggccggagatctgttagcggggatctgattctcgagatcggaaagctgccccagcatctgacacagcgggcccaaaatgcgctcgacaaccttgtgatgctgcacaattccgaacagggcgggcgcgcctacagacatgctatggaggagctgcctgataccattgaaacactcatgctgcttgccctgatcgctgtgctcaccggaggcgtcacgctgtttttcctgtctggccgggggctcggaaaaacaagcattggccttctgtgtgttatggcctccagcgtgctgctctggatggcctctgtggagccccactggatcgctgcgtccatcattctggaatttttccttatggtcctgctcatcccggagcctgaccgccagagaacaccccaggataaccaactggcctatgtggttattgggctgctctttatgatccttaccgtggctgccaatgagatgggactgctggaaacaaccaagaaggacctcggcattgggcacgtcgccgtggagaaccatcaccatgctgccatgctggatgtcgaccttcaccctgcgagcgcctggacactgtacgctgtggccacgaccatcattacacccatgatgcggcataccatcgaaaacacaaccgctaatatctctctcacggccattgcgaaccaggccgctatcctgatgggactggataaaggctggcctatttccaagatggacatcggcgttcccctccttgccctggggtgctacagccaggtgaatccgctgaccctcacagctgccgtcctgatgcttgtggctcactatgccattatcggacctggcctgcaagcgaaagccacccgcgaggctcagaagagaacagccgctgggatcatgaaaaaccccaccgttgatggaattgtggccatcgacctcgatcccgtcgtgtacgacgccaagttcgaaaagcagctgggccagattatgctgctcatcctttgtacgtctcaaattctgctgatgcggacaacctgggcgctctgcgagagcatcacactggctaccgggcctcttaccacactgtgggagggatccccgggcaaattttggaatacgaccatcgccgtgtctatggctaacattttccgcggcagctatctcgccggggccggactggctttctccctgatgaaaagcctcggcgggggaagacggggcacaggggcccagggagaaacccttggcgagaaatggaagagacagctgaatcagctgtccaaatctgaatttaacacatacaagcgcagcggcatcatggaggttgaccggtccgaagcgaaggaggggctcaaaagaggagagaccacgaagcacgccgtctctcgcggcacagctaaactgcggtggttcgtggaaagaaatcttgtgaagcccgaggggaaagtcattgatctgggatgtggccgcgggggatggagctattactgcgccggcctcaagaaggttaccgaagtgaaaggctataccaaagggggacctggccatgaggaacccatccctatggctacatacgggtggaacctggtgaaactgcactccggaaaggacgtctttttcattccccctgagaaatgtgataccctcctttgcgacatcggcgagtctagcccgaatcccacaattgaagaggggcggacgctgagagtgctgaagatggttgaaccttggctccgcggaaaccaattttgtatcaaaatcctgaatccctacatgccttccgtggtcgagacccttgagcagatgcagcggaagcatggcggcatgctggtgagaaaccccctcagccgcaattctacacacgaaatgtattgggtttcctgcgggaccggaaacattgtgagcgccgtcaatatgacatctcggatgctgctgaacagattcaccatggcgcaccgcaagccgacgtacgagagagatgtggacctcggcgccgggacccggcatgtggctgtcgaacctgaggttgccaacctggatatcattggacagcgcatcgaaaatattaaacacgagcataagtccacatggcactatgacgaggataacccctacaaaacctgggcttatcatggcagctacgaagtgaagccctctgggtccgccagctccatggtgaatggagtcgtgaaacttctgacaaagccttgggacgttatccccatggtgacccaaatcgctatgacagataccacgccttttggccagcagagagtcttcaaggagaaagtggacacacggaccccgaaggccaaaagaggcaccgcgcaaattatggaagttacagccaagtggctctgggggtttctgagccggaacaaaaagccccgcatctgtacgagagaggagttcacccggaaggtgcgctctaatgctgccattggagctgtctttgtggacgagaaccagtggaatagcgccaaagaggccgttgaagatgagagattctgggaccttgtgcaccgggaacgcgagctgcacaagcagggcaaatgcgcgacatgcgtctataacatgatggggaagagagagaaaaagctcggagagtttggcaaggctaaagggtcccgggccatctggtacatgtggctgggcgcccgcttcctggagttcgaagctctcggatttatgaatgaggatcattggttctctagagaaaacagcctgtccggcgtggagggggagggacttcacaagctgggctacattctccgggacatctctaaaatccctgggggaaatatgtatgccgatgacaccgctggctgggatacacgcattaccgaagacgatctgcagaacgaggccagaatcacagacattatggaacccgagcatgcgcttctggccaagagcatctttaaactcacctaccaaaataaggtcgtgcgggttcagcgccctgctaaaaacgggacggtgatggatgtcatttccagacgggaccagagaggctctggacaggtgggcacctatgggctgaatacattcaccaacatggaagcccaactgatccgccagatggagagcgagggaatcttttcccccagcgaactcgagacaccgaacctggctgaacgggtgcttgattggctggagaagtacggcgttgaaagactcaagcgcatggccatttctggggacgactgtgtggtcaaacctatcgatgaccggttcgcgaccgccctgacggctcttaatgatatgggaaaggtgagaaaagacattccccagtgggagccttccaagggctggaacgattggcagcaagttcccttttgcagccaccacttccatcagctgatcatgaaagacgggcgcgagattgtggtcccttgtcggaatcaggatgaactcgtgggcagagcccgcgtctctcagggagctggctggaacctgcgggagacagcctgcctggggaagtcctatgctcaaatgtggcagctcatgtactttcacagacgcgacctgcggcttgccgcgaatgccatctgtagcgctgtgcccgttgattggattccgacctccagaacaacctggtctatccatgcccaccatcagtggatgacgaccgaagacatgctgagcgtgtggaaccgggtctggatcgaggaaaatccttggatggaggataagacacacatttccagctgggaggacgtgccctatctcggaaaaagagaagaccaatggtgcggctctctgatcgggcttaccgcccgcgctacatgggccaccaacattcaggttgcgatcaatcaggtgcggagactgattggaaacgagaattacctcgattacatgacatccatgaagcgcttcaaaaacgaaagcgaccccgagggcgctctgtggtga

SEQ ID NO: 18855 - RNA, 9879 nt, synthetic construct
  misc_feature 1..9879: note = derived and/or modified CDS sequence (opt5) from DENV-1__FJ024434__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgccatggacctgggggaactctgtgaagatacaatgacctacaaatgcccccgcatcacagaagctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagtataaagagttcgctgccgggcgccggtctgttagcggagatctcatcctggagatcggcaagctgccccagcacctcacacagagagcgcagaatgcccttgacaacctggtgatgctgcataattccgaacaagggggacgggcttaccgccacgccatggaggagctccctgataccattgaaacactgatgcttctggctctcatcgccgtgctgaccggcggcgtcacgctgtttttcctctctgggagaggacttggcaagacaagcattgggctgctgtgtgttatggcctccagcgtgctcctgtggatggcttctgtggagccccattggatcgcggcctccattatccttgaatttttcctgatggtcctcctgatcccggagcctgaccggcagcgcacaccccaggataaccagctggcttacgtggttattggactcctttttatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctatgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctacagccaggtgaatccgctcaccctgacagccgctgtccttatgctggtggcccattatgcgattatcggccctgggctccaggccaaagctacccgggaggcccaaaagcgcacagctgccggaattatgaagaaccccaccgttgatggcatcgtggccatcgacctggatcccgtcgtgtacgacgcgaaattcgaaaagcagctggggcagattatgctccttatcctgtgtacgtctcagattctgctcatgagaacaacctgggctctgtgcgagagcatcacacttgccgctggacctctgaccaccctctgggagggctccccgggcaaattttggaatacaacgattgccgtgtctatggccaacatcttccgggggagctatctggctggagccggcctggcgttttccctcatgaaaagccttgggggaggccgcagagggaccggagcccaaggcgaaacactgggcgagaaatggaagcggcagctgaatcagctctccaagtctgagttcaacacctacaaaagaagcgggatcatggaggttgaccgctccgaagctaaggagggactgaaacggggcgagacaaccaagcacgccgtctctagagggacggctaaacttcgctggttcgtggaacggaatctggtgaagcccgagggaaaggtcattgatctcggctgtgggagaggaggctggagctattactgcgccggcctgaaaaaggttacagaagtgaaagggtacaccaagggaggccctgggcacgaggaacccatccctatggcgacctatggatggaacctggtgaaactccattccggcaaggacgtctttttcattccccctgagaaatgtgatacacttctgtgcgacatcggggagtctagcccgaatcccaccattgaagagggacgcacactgcgggtgctcaagatggttgaaccttggctgagaggcaaccagttttgtatcaagattcttaatccctacatgccttccgtggtcgaggccctggagcaaatgcagcgcaaacacggcgggatgctcgtgcggaaccccctgagcagaaattctacgcatgaaatgtattgggtttcctgcggaaccggcaacatcgtgagcgctgtcaatatgacatctcgcatgctgctcaaccggttcaccatggcccacagaaagccgacatacgagcgcgatgtggacctggggaccggaacgagacacgtggctgtcgaacctgaggttgccaaccttgatatcattggccagcggatcgaaaatattaaacatgagcacaagtccacctggcattatgacgaggataacccctacaaaacatgggcttatcacgggagctacgaagtgaagccctctggatccgccagctccatggtgaatggcgtcgtgaagctgctcaccaaaccttgggacgttatccccatggtgacacagattgcgatgaccgatacaaccccttttggccaacagcgcgtcttcaaggagaaagtggacacgagaacaccgaaggccaaacgggggaccgctcagatcatggaagttaccgccagatggctgtggggatttcttagccggaacaagaagccccgcatctgtacaagagaggagttcacgcggaaagtgcgctctaatgctgccattggcgccgtctttgtggacgagaaccaatggaatagcgcgaaggaggctgttgaagatgagagattctgggacctggtgcatcgggaacgcgagctccacaaacaggggaagtgcgcgacctgcgtctacaacatgatgggaaaaagagaaaagaagctgggcgagtttgggaaagccaagggctcccgggctatctggtatatgtggctgggagcccgcttcctcgagtttgaagctctgggcttcatgaatgaggatcactggttctctagagaaaacagcctttccggggtggagggagagggcctgcataaactcgggtacattctgcgggacatctctaagattcctggaggcaatatgtatgccgatgacacagcggggtgggatacccgcatcacagaagacgatcttcagaacgaggccaaaatcaccgacattatggaacccgagcacgctctgctcgccaaggctatctttaaactgacataccagaataaggtcgtgagagttcaacggcctgccaagaacggcaccgtgatggatgtcattagccgcagagaccagcggggatccggccaggtggggacgtatggactgaataccttcacaaacatggaagcgcagctcatcagacaaatggagtctgagggcatttttagcccctccgaactggagaccccgaaccttgccgaacgcgctctggattggctcgagaaatacggggtggaacggctgaagagaatggccatcagcggagacgactgtgttgtgaaacctatcgatgaccgcttcgctacagcccttaccgctctgaatgatatgggcaaggtccggaaagacattccccagtgggagccttctaaggggtggaacgattggcaacaggtgcccttttgctcccatcacttccaccaactcatcatgaaggacggcagagagattgttgtgccttgtcgcaatcaggatgaactggtcggacgggccagagtgagccagggcgcggggtggtctctgcgcgagacggcctgcctcggaaaatcctatgctcagatgtggcaactgatgtactttcatcggagagaccttcgcctggccgccaacgctatctgtagcgccgtccccgtggattgggttccgacatcccggaccacatggtctattcacgcgcatcaccagtggatgaccacggaagacatgctcagcgtgtggaatagagtctggatcgaggaaaacccttggatggaggataagacccatatttccagctgggaggacgtgccctacctgggcaaacgggaagaccagtggtgcgggtctcttatcggactgacagctagagccacctgggccacaaatatccaagttgctattaaccaggtgcgccggctcatcggcaatgagaactatctggattacatgatttccatgaagagattcaaaaatgaaagcgaccccgagggggccctgtggtga

SEQ ID NO: 18856 - RNA, 9879 nt, synthetic construct
  misc_feature 1..9879: note = derived and/or modified CDS sequence (opt5) from DENV-1__FJ024435__SS-prME
  source 1..9879: mol_type = other RNA
agcgtgaccatgctgctcatgctgatgcccacagcccttgctttccacctgacgaccagaggcggggaacctcatatgatcgtgtccaagcaagaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgaccgctctttttctggcccatgcgatcgggacctctattacacagaagggaatcatcttcattctcctgatgcttgtcacgcctagcatggccatgagatgcgtgggcatcgggtcccgggattttgttgagggactgagcggcgctacctgggtggacgtcgtgctcgagcacgggtcttgtgtgacaaccatggccaaggataaacccacactggacattgaactgctcaagaccgaggtcacgaaccctgctgttctgcgcaaactttgcatcgaagccaagatttccaatacaaccaccgatagcagatgtccgacacaaggagaggcgaccctggtggaagaacaagacgccaacttcgtgtgccggcgcacatttgtcgatagaggctggggcaatgggtgtggactcttcggcaaagggtctctgatcacgtgcgctaagtttaagtgcgtgaccaaacttgagggaaagattgttcagtacgaaaacctgaaatattccgtgatcgtcacagtgcacaccggcgaccagcatcaagttgggaatgagagcacagaacacggaaccacggccaccatcacaccccaggctcctaccacagagattcagctcaccgactacggcgccctgacgctggattgttctccccggacaggcctcgacttcaacgaaatggtgctgcttaccatgaaggagaaatcctggctggtccataagcagtggtttctcgatctgcctcttccctggacaagcggggcctccacctctcaagagacctggaatcgccaggacctgctcgtgacattcaaaacggctcacgcgaagaagcaggaagtcgtggttctgggaagccaagagggcgccatgcacaccgctctgacaggggccaccgaaatccagacatccggaaccacgacaatttttgccggccatctcaaatgcagactgaagatggataaacttaccctgaaggggatgagctatgtgatgtgtaccggctctttcaaactcgagaaggaactggctgagacacagcacggaaccgtcctggtgcagatcaagtacgagggcacagacgccccgtgcaaaattcctttctccacgcaagatgaaaagggggttacccagaacggacggcttatcacagcgaatcccatcgtgaccgacaaagagaagcctgtcaacattgaagctgagccgccctttggcgagagctatatcgtgattggggccggagaaaaagccctcaagctgtcttggttcaagaaaggcagctccatcgggaagatgtttgaggctacagccagaggcgctcgccggatggccattctgggagataccgcgtgggacttcggctctatcgggggagtgtttacgagcgttggcaaactcgtccatcagatcttcgggaccgcctacggagtgctgttttccggcgtgagctggacaatgaagattgggatcggcgtccttctgacctggctcggactcaattctagatccacaagcctgtctatgacctgtattgctgtgggccttgttacactctacctgggggtgatggtccaggccgattccggatgcgtgatcaactggaaaggccgcgaactgaagtgtgggagcggaattttcgttaccaatgaggtgcacacgtggacagaacaatataagtttcaggctgactcccctaaacggctctctgccgcgatcggcaaggcctgggaggagggggtctgcggcattagaagcgctacccgcctggaaaacatcatgtggaaacagatctccaacgagcttaatcatattctgctcgaaaacgacatgaagttcaccgtggttgtgggagatgtcgccggcatcctggctcaggggaaaaagatgattcggccgcaacccatggagcacaaatactcttggaaaagctggggaaaggccaagatcattggcgccgacgtgcagaatacaacctttatcatcgatgggcctaacacgcccgaatgtcctgacgatcagagagcttggaatatttgggaggtggaggactatggattcggcatctttacaaccaacatttggctgaaacttcgcgattcctacacacaggtctgcgaccaccggctcatgagcgcggccatcaaagattctaaggctgttcatgccgacatgggctattggattgaatccgagaaaaatgaaacctggaagctggccagagctagcttcatcgaggtgaagacatgtatctggcccaaatctcacaccctgtggtccaacggggtgctcgaaagcgagatgattatcccgaagatttacggaggccctatctctcaacataattatcgccccgggtacttcacgcagaccgccggaccttggcacctgggcaaacttgagctggattttgacctctgcgaagggacaaccgtcgtggttgatgagcactgcggaaaccggggccccagcctgagaacaaccacggtgacaggcaagattatctacgaatggtgttgccggtcctgtaccctgcctccccttcgcttcagaggggaggacggatgctggtatggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgacagggacccttgctgtgttctttctgctcatcgttggacagctgacctggaacgatctgattagactttgcatcatggtgggcgccaatgcctctgaccgcatgggcatggggacaacgtacctggctctcatggccaccttcaagatgagacctatgtttgcggtcggactgctgttccggcgcctgacaagcagagaggtgcttctgctcaccattggcctgtccctggtggcttctgtcgaacttcccaacagcctggaggaactcggggatggactggccatgggcatcatgatcctcaaactgcttacagactttcaatcccatcagctgtgggccaccctcctgagcctgacgttcattaagacaaccttttctcttcactatgcttggaaaaccatggccatggttctgtccgtggtgagcctcttccccctgtgtctctctacaacctcccagaagacaacgtggctgcctgtccttctggggagcctgggatgcaagccgctcaccatgtttctgatcgctgagaataaaatttggggccggcgctcttggccccttaacgaaggcatcatggccgtggggattgtttccatcctgctcagctccctgctcaagaacgatgtgcctctggcgggaccccttatcgccggcgggatgctgattgcttgttacgtcatcagcggatctagcgccgacctgtccctcgagaaagctgccgaggtgtcttgggaagaggaagccgagcatagcggcgcttcccacaatattctggttgaagtgcaggatgacgggacaatgaagatcaaagatgaggagagagacgatacccttacaattctgctcaaggcgaccctgctcgccgtctctggagtgtatcctctgagcatccccgctacgcttttcgtctggtacttctggcagaagaagaagcagcggtccggcgtgctgtgggacaccccttctcccccggaagttgagcgcgccgtgctggatgacggcatctatagaattatgcagcgggggctcctgggacgcagccaggtcggcgtgggggtttttcaagaaaacgtgttccatacaatgtggcacgtcaccagaggagccgtgcttatgtaccagggcaaacggctggagccttcctgggctagcgtgaagaaagacctcatctcttacgggggaggctggagactgcagggctcctggaatacaggggaggaagttcaggtcattgccgtggagcccggaaagaaccctaaaaatgtgcaaaccgcgcccggcacatttaagacgccggaaggggaggtcggagctatcgccctcgatttcaagcctggcaccagcgggtctcccattgtgaaccgcgaaggaaaaatcgttggcctgtatggcaatggggtggtcacaacctccggaacctacgtgagcgccattgctcaggccaaggcgtcccaggagggccctcttcccgagatcgaagacgaggtttttcggaaaagaaacctgacaatcatggatctgcaccccgggtctggaaagacgcgccggtatctccctgctattgtgagagaagccatcaaacgcaagctgcggacccttattctggccccgacaagagtcgtggctagcgagatggccgaagctctcaagggcatgcccatccgctaccaaaccacagccgttaaatccgagcataccgggaaggagattgtggacctgatgtgccacgcgacgttcacaatgcggctgctcagccctgtcagagtgcccaattataacatgatcatcatggatgaagcccattttaccgacccttcttccattgctgcccggggctacatcagcacccgcgtgggaatgggcgaggctgccgccattttcatgacagctacaccccctgggtctgtcgaagcgtttccgcagagcaatgccgttatccaggatgaggaaagagacattcccgagcggtcctggaactctggatatgagtggatcacagatttccctggcaaaaccgtgtggtttgtgcccagcatcaagtccgggaatgacattgctaactgtcttcgcaaaaatggaaagagagtcatccagctgtctcggaagacgttcgatacagaataccagaagaccaagaacaacgactgggactacgtggttacaaccgatattagcgagatgggcgccaatttcagagccgaccgcgtgatcgatcctcggagatgcctgaaacccgtcattctcaaggacgggccggaacgcgtgatcctggctggccctatgcccgttacggtggcctccgcggctcagcggagaggacgcattggccggaaccacaataaagagggggatcagtatatctacatgggacagccccttaacaatgacgaggatcatgcccactggaccgaagccaagatgctgctcgacaacatcaatacacctgagggcattatccccgctctgtttgaacctgagagagaaaagagcgccgcgattgatggggagtatcgcctgagaggagaggcccggaaaaccttcgtcgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgttgagatctggacaaaagagggagaacggaagaaactcagaccccgctggctggacgcccggacctactccgaccctcttgctctgagagagtttaaggagttcgccgctggccgccggtctgtgagcggggatctcattctggagatcggaaaactgccccagcacctcacacagagagcccaaaatgcgcttgacaacctggtgatgctgcataattccgaacagggcgggcgggcctatcgccacgctatggaggagctccctgataccatcgaaacgctgatgcttctggccctcattgctgtcctgacaggaggcgttaccctgtttttcctctctggcagagggcttggaaagaccagcatcggcctgctgtgtgtgatggcctccagcgtgctcctgtggatggcctctgtcgagccccattggattgctgcgtccatcattcttgaatttttcctgatggtgctcctgatcccggagcctgaccggcagcgcacaccccaggataaccaactggcctacgttgtgatcgggctcctttttatgattctgaccgtcgctgccaatgagatgggactgctcgaaacaacgaagaaagacctgggcatcgggcacgtggccgtcgagaaccaccatcacgctgccatgcttgatgtggacctgcatcctgcgagcgcctggaccctctacgctgttgccacaaccattatcacacccatgatgagacacaccattgaaaacacgaccgctaatatctctctgacagccattgcgaaccaggccgctatcctgatgggactcgataagggctggcctatctccaaaatggacattggcgtgccccttctggccctggggtgctatagccaggtcaatccgctcaccctgacagctgccgtgcttatgctggttgctcattacgccatcattggacctggcctccaagcgaaggccacccgggaggctcagaaacgcacggccgctgggatcatgaagaaccccacagtggatggaattgtcgccatcgacctggatcccgtggtgtatgacgccaagttcgaaaaacagctgggccagatcatgctccttattctgtgtacctctcaaatcctgctcatgagaacaacctgggcgctgtgcgagagcattacccttgctacagggcctctgacgaccctctgggagggatccccgggcaagttttggaatacaaccatcgccgtttctatggctaacattttccggggcagctacctggccggggccggactggctttctccctcatgaaaagccttggcgggggacgcagaggcacaggggcccagggagaaaccctgggcgagaagtggaaacggcagctgaatcagctctccaagtctgaatttaacacgtataagagaagcggcatcatggaggtcgaccgctccgaagcgaaagaggggctgaagcggggagagacaaccaaacacgccgtgtctagaggcaccgctaaacttcgctggttcgtggaacggaatctggtcaaacccgaggggaaggttatcgatctcggatgtggcagagggggatggagctactattgcgccggcctgaagaaagtgacagaagtgaagggctacaccaaagggggacctggccacgaggaacccattcctatggctacatacgggtggaacctggtcaagctccattccggaaaagacgtgtttttcattccccctgagaagtgtgatacgcttctgtgcgacatcggcgagtctagcccgaatcccaccatcgaagaggggcgcacactgcgggttctcaaaatggtggaaccttggctgagaggaaaccaattttgtattaagatccttaatccctatatgccttccgtcgtggagaccctggagcagatgcagcgcaagcacggcggcatgctcgttcggaaccccctgagcagaaattctacacatgaaatgtactgggtgtcctgcgggaccggaaacattgtcagcgccgtgaatatgacgtctcgcatgctgctcaaccggttcaccatggcgcacagaaaaccgacatatgagcgcgatgtggacctgggcgccgggaccagacacgtcgctgttgaacctgaggtggccaaccttgatatcatcggacagcggattgaaaatatcaagcatgagcacaaatccacatggcattacgacgaggataacccctataagacctgggcttaccacggcagctatgaagtgaaaccctctgggtccgccagctccatggtcaatggagtggttaagctgctcacaaagccttgggacgtgattcccatggtcacccaaatcgctatgacggatacaaccccttttggccagcagcgcgtgttcaaagagaaggttgacaccagaacaccgaaagccaagcggggcacggcgcaaattatggaagtgaccgccaaatggctgtgggggtttcttagcagaaacaagaagccccggatctgtacacgcgaggagttcaccagaaaagtccggtctaatgctgccatcggagctgtgtttgttgacgagaaccagtggaatagcgccaaggaggccgtggaagatgagcgcttctgggacctggtccatagagaacgggagctccacaaacagggcaagtgcgcgacatgcgtgtacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtcgagggggagggactgcataaactcggctatatcctgagagacatttctaagatccctgggggaaatatgtacgccgatgacaccgctggctgggatacacggattaccgaagacgatcttcagaacgaggcccgcatcacggacatcatggaacccgagcacgcgctgctcgccaaaagcatttttaagctgacctatcaaaataaagtggttagagtgcagcggcctgctaagaacgggacagtcatggatgtgatctcccgcagagaccagcggggctctggacaggtgggcacctacgggctgaatacattcaccaacatggaagcccaactcattagacagatggagagcgagggaatcttttcccccagcgaactggagacgccgaaccttgctgaacgcgttctggattggctcgagaagtatggcgtggaacggctgaaaagaatggccatttctggggacgactgtgtcgtgaagcctatcgatgaccgcttcgcgacagcccttaccgctctgaatgatatgggaaaagttcggaaggacatcccccagtgggagccttccaaaggctggaacgattggcagcaagtgcccttttgcagccatcacttccaccagctcattatgaaggacgggagagagatcgtcgtgccttgtcgcaatcaggatgaactggtcggccgggccagagtgtctcagggagctggctggtccctgcgcgagacagcctgcctcggaaagagctacgctcaaatgtggcagctgatgtattttcatcggagagaccttcgcctggccgcgaacgccatttgttccgctgttcccgtggattggatcccgacctctcggacgacctggagcattcacgcccatcaccagtggatgacaaccgaagacatgctctccgtctggaatagagtgtggatcgaggaaaacccttggatggaggataaaacacatattagctcttggggagacgttccctacctgggcaagcgggaggaccaatggtgcgggtcccttatcggactgaccgccagagctacatgggccaccaatatccaggtggcgattaaccaggtccgccggctcatcggcaatgaaaactacctggattatatgacgagcatgaaaagattcaagaatgagtctgaccccgaaggggctctgtggtga

SEQ ID NO: 18857 - RNA, 9879 nt, synthetic construct
  misc_feature 1..9879: note = derived and/or modified CDS sequence (opt5) from DENV-1__FJ024436__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaatacggaaccacagctaccattacgccccaggccccttctaccgagatccagctcacagactatggcgccctgaccctggattgtagcccccggacaggcctcgacttcaacgaaatggtgctgcttaccatgaaggagaaaagctggctggtccacaagcagtggtttctcgatctgcctcttccctggacgtccggggcttctacaagccaagagacctggaatcgccaggacctgctcgtgacattcaaaaccgcgcatgccaagaagcaggaagtcgtggttctgggatcccaagagggcgctatgcacaccgccctgacaggggccacggaaattcagaccagcggaacaaccacaatctttgctggccacctcaaatgcagactgaagatggataaacttaccctgaaggggatgtcttacgtgatgtgtacgggctccttcaaactcgagaaggaagtcgccgagacacagcatggaaccgtgctggttcagattaagtatgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttacattgtgatcggggccggagaaaaagctcttaagctcagctggttcaagaaaggctcctctattgggaagatgtttgaggccaccgctagaggcgcccgccggatggcgatcctgggagatacagcctgggacttcggcagcatcgggggagtttttacctccgtcggcaaactggtgcaccagattttcgggacagcttacggagtgctctttagcggcgtctcttggaccatgaagatcgggattggcgtgctgcttacgtggctgggactcaattccagaagcacctctctgtccatgacatgtatcgccgttggcctggtgaccctttatctcggggtcatggtgcaggctgatagcggatgcgttattaactggaaaggccgcgaactgaagtgtgggtccggaatcttcgtgacaaatgaggtccatacctggacagaacaatacaagtttcaggccgactctcctaaacggctgagcgcggccattggcaaggcttgggacgagggggtgtgcggcatcagatccgccacccgcctcgagaacatcatgtggaaacagatttctaacgaactgaatcacatccttctggagaacgatatgaagttcacggttgtggtcggagacgtggctggcattctcgcccaggggaaaaagatgatccggccgcaacccatggaatataaatacagctggaagtcctggggaaaggccaaaattatcggcgctgatgtgcagaatacaacctttatcattgacgggcctaacacccccgagtgtcctgatgaccagagagcgtggaatatctgggaagtcgaggattatggattcggcatttttacaaccaacatctggctgaagctgcgcgacagctacacgcaggtttgcgatcatcggcttatgtctgccgctattaaagactccaaggccgtgcacgccgatatgggctattggatcgagagcgagaagaatgagacatggaagctcgctagagcctctttcatcgaagtgaagacctgtatttggcccaaatcccacacactgtggagcaacggggtcctggagtctgaaatgatcattccgaagatctacggaggccctattagccaacataattaccgccccgggtatttcacccagacagcgggaccttggcacctcggcaaactggagcttgactttaacctgtgcgaggggaccacggtggttgtggatgaacattgcggaaatcggggcccctccctcagaaccacaaccgtcacaggcaagatcatccacgagtggtgttgccggagctgtaccctgcctcccctgcgcttcaaaggggaagacggatgctggtacggcatggagattagaccggtgaaggagaaggaagagaaccttgttaaatctatggtgtccgctgggagcggagaagtcgactccttttctctcggcctgctgtgtatcagcattatgatcgaggaagtgatgcggtccagatggtctcgcaagatgctcatgacggggacactggccgttttctttcttctgattatgggacagctcacctggaatgatctgatccggctgtgcattatggtgggcgccaacgctagcgacagaatgggcatggggacaacctatcttgccctgatggcgaccttcaaaatgcgccctatgctcgctgtcggactgctctttagacggctgacatcccgcgaggtgcttctgctcacgatcggcctgtctctggtggccagcgtcgagcttcccaattccctggaagaactcggggatggactggccatgggcatcatgattctcaagctgcttaccgacttccaaagccaccagctgtgggctacactcctgtctctgacctttatcaaaacaacctactcccttcattatgcctggaagacgatggctatggttctgagcattgtgtctctcttccccctgtgtctctccacaaccagccagaagaccacatggctgcctgtgcttctggggtctctgggatgcaaaccgctcaccatgtttctgatcgccgaaaacaagatttggggcagaaaatcctggccccttaacgagggcatcatggcggtcgggatcgtgagcattctgctctccagcctgctcaagaatgatgttcctctggccggaccccttatcgctggcgggatgctgattgcctgttacgtgatctctggaagctccgctgacctgtctctcgaaaaagccgccgaggtcagctgggaggaagaggctgaacactccggcgcgtctcataacattctggtggaggttcaggatgacgggacaatgaagatcaaagatgaggaacgggacgatacgcttaccatcctgctcaaggccacactgctcgctgtgagcggagtctatcctctgtccattcccgccacccttttcgtgtggtacttttggcaaaagaaaaagcagcgctctggcgtcctgtgggacacaccttcccctcccgaggtggaaagagccgttctggatgacggcatctaccggattatgcagcgcgggctcctgggaagatcccaggtgggcgtcggggtgttccaagagaatgttttccacaccatgtggcatgtgacgcggggagctgtccttatgtatcagggcaaacgcctggaacccagctgggcctctgtgaagaaagacctcatctcctacgggggaggctggagactgcagggcagctggaacaccggggaggaggtgcaggttattgcggtcgaacccggaaagaatcctaagaacgtgcaaacagctcccggcacctttaaaacatctgagggggaagtgggagccatcgccctcgatttcaagccgggcacctccgggagccctattgtcaatcgggagggaaaaatcgtgggcctgtatggcaacggggttgtgacaacgtccggaacctacgtctctgctatcgcccaggcgaaggctagccaggaaggcccccttcctgagattgagaatgaagtgtttagaaaacgcaacctgacaatcatggacctgcaccccgggtccggaaagacccggagatatctccccgccattgttcgcgaggccatcaagcggaaactgagaacccttattctggctcctacacgcgtggtcgccagcgaaatggctgaggccctcaagggcatgccgatccggtaccaaacgaccgcggtgaaatctgaacacacagggaaggagatcgttgatctgatgtgccatgccaccttcacaatgagactgctctcccccgtgcgcgtccctaattataacatgattatcatggacgaggctcactttaccgatcccagctctattgccgctcggggctacatcagcacgagagtgggaatgggcgaagccgccgctattttcatgacagcgacccctcccgggtccgtggaggcctttcctcagtctaatgctgtcatccaggacgaggaacgggatatcccggaacgcagctggaactccggatacgagtggattaccgacttccccggcaaaacagtttggtttgtgccttctatcaagagcgggaatgatattgccaactgtcttagaaagaacggaaaacgggtgatccagctgtcccgcaagaccttcgacacagagtatcagaagacaaagaataacgattgggactacgtcgtgacgacagacattagcgaaatgggcgccaattttagagctgatcgggttatcgaccccagacgctgcctgaaacctgtgattctcaaggatgggcccgagcgggtcatcctggccggcccgatgcctgtgaccgttgcgtctgctgcccagagacgcggacggatcggcagaaaccataataaggaaggggaccagtatatttacatgggacagccccttaacaatgatgaggaccacgcccattggacagaggctaaaatgctgctcgataacatcaatacccccgaaggcattatccctgccctgttcgagcccgaacgcgagaagtccgcggccattgacggggaatatcggctgagaggagaggctcgcaaaacgttcgtggagctcatgagacggggcgatcttcctgtctggctgagctacaaggtggcctccgaagggtttcaatattctgaccgcagatggtgcttcgatggcgagcggaacaatcaggtcctggaagagaacatggacgtggaaatctggaccaaagagggagagcgcaagaaactcagaccgcggtggctggatgctagaacatacagcgacccccttgccctgcgcgaatttaaggagttcgctgccggccggaagtccgtttctggggacctcatcctggaaattggaaaactgcctcagcacctcacccagagagcgcaaaatgcccttgataacctggtgatgctgcacaatagcgagcagggcgggcgcgcttaccggcatgccatggaggaactccccgacacaatcgagaccctgatgcttctggctctcattgccgtgctgacaggaggcgtcaccctgtttttcctctccggcagagggcttggaaagacgagcatcggcctgctgtgtgttatggcctcttccgtgctcctgtggatggctagcgtggaacctcactggattgcggcctctatcatccttgagtttttcctgatggtcctcctgattcccgaaccggatcggcagcgcacacctcaggacaaccaactggcttatgtggttatcgggctcctttttatgattctgaccgtggccgccaacgagatgggactgctcgagaccaccaaaaaggatctgggcatcgggcatgtcgctgtggaaaatcaccaccatgccgcgatgcttgacgtcgatctgcaccccgcctccgcttggaccctctacgccgtggctacaacgattatcacccctatgatgagacatacaattgagaacaccacagccaatatcagcctgaccgcgatcgccaaccaggctgccattctgatgggactcgacaaaggctggcccatctctaagatggatattggcgttcctcttctggctctggggtgctatagccaggtgaatcccctcacgctgaccgccgctgtccttatgctggtggcccactacgcgatcattggaccgggcctccaagccaaggctacacgggaagcccagaaacgcaccgctgccgggatcatgaagaaccctacagttgacggaatcgtggccattgatctggaccccgtcgtgtatgatgcgaaattcgagaagcagctgggccagatcatgctccttattctgtgtacctcccaaatcctgctcatgagaacgacatgggctctgtgcgaatctattacccttgccacagggcccctgaccaccctctgggagggaagccctggcaaattttggaatacaacgatcgctgtgtccatggccaacatcttccggggcagctacctggccggggctggactggccttttccctcatgaagtctcttggcgggggacgcagaggcaccggggcgcagggagagacactgggcgaaaagtggaaacggcagctgaatcagctcagcaagtccgagttcaacacctataaacgctctggcattatggaagttgacagaagcgaggccaaggaagggctgaaacggggagagacaaccaagcatgctgtctccagaggcacggccaaacttcgctggttcgtggagcggaatctggtgaaaccggaagggaaggtcatcgacctcggatgtggcagagggggatggtcttactactgcgctggcctgaaaaaggttacagaggtgaaaggctataccaaagggggacccggccacgaggagcctattcccatggccacctacgggtggaacctggtgaaactccacagcggaaaggatgtctttttcatccctcccgaaaagtgtgacacacttctgtgcgatattggcgagtccagccctaatccgaccatcgaggaagggcgcacactgcgggtgctcaaaatggttgagccctggctgagaggaaaccaattttgtattaagatccttaatccttatatgccctctgtggtcgaaacgctggagcagatgcagcgcaaacatggcggcatgctcgtgcggaaccctctgtccagaaatagcacccacgagatgtactgggtttcttgcgggacaggaaacatcgtgtccgcggtcaacatgaccagccgcatgctgctcaatcggttcacaatggcccatagaaagcccacctatgaacgcgacgtggatctgggcgctgggacgcggcacgtggccgtcgagccggaagttgctaaccttgacattatcggacagagaattgagaatatcaaacacgaacataagtctacctggcactacgatgaggacaacccttataagacatgggcctaccatggctcctacgaggtgaaacccagcgggtccgctagctctatggtgaatggagtcgtgaagctgctcaccaaaccctgggatgttattcctatggtgacacaaatcgccatgaccgacacaaccccctttggccagcagcgcgtcttcaaggaaaaagtggatacgagaacacctaaggcgaagcggggcaccgcccaaatcatggaggttaccgctaaatggctgtgggggtttcttagccgcaacaagaaaccgagaatttgtacacgggaagagttcacgagaaaggtgcggtccaatgccgctatcggagccgtctttgtggacgaaaaccagtggaactctgccaaagaggcggttgaggacgaacgcttctgggatctggtgcacagagagcgggaactccataagcagggcaagtgcgctacctgcgtctataacatgatggggaaacgcgagaagaaactgggagaatttggcaaggccaaagggagcagagccatttggtacatgtggctgggcgctcggttcctcgagtttgaggccctgggattcatgaatgaagaccactggttctcccgcgagaactctcttagcggcgtggaaggggagggactgcacaagctcggctatatcctgagagatatttccaaaatccccgggggaaatatgtacgctgacgatacagccggctgggacacccggatcacagaggatgaccttcagaacgaagcgaagattaccgatatcatggagcctgaacatgccctgctcgctaagtctatttttaaactgacatatcaaaataaggtcgtgcgcgttcagagacccgccaaaaacgggaccgtgatggacgtcatcagccggcgcgatcagagaggctccggacaggtgggcacgtacgggctgaacaccttcacaaatatggaggctcaactcattcggcagatggaaagcgagggaatcttttctccttccgagctggaaacccccaaccttgccggccgcgtgctggactggctcgagaagcacggggttgaaagactgaaacggatggcgatcagcggagatgactgtgtggtcaagccgattgacgatagattcgccacagctcttaccgccctgaatgacatgggcaaggtgcgcaaagatatccctcagtgggagccctctaaggggtggaacgactggcagcaagttcctttttgctcccatcacttccaccagctcattatgaaagatggccgggaaatcgtggtcccctgtagaaatcaggacgagctggtgggacgcgctcgggtcagccagggcgccgggtggtccctgagagagacggcttgcctcggaaagtcttatgcccaaatgtggcagctgatgtactttcatcgccgggatcttagactggcggccaacgctatttgtagcgccgtgcctgttgactgggtgcccacatcccgcaccacatggagcatccacgcccatcaccagtggatgaccacggaagatatgctctctgtctggaatcgggtgtggattgaggaaaacccgtggatggaggacaaaacccatatctccagctggggcgatgttccttacctggggaagagagaagaccaatggtgcggatctcttatcggcctgacagctcgcgccacctgggcgacaaatattcaggtggctatcaaccaggtccggagactcattgggaatgagaactatctggactacatgaccagcatgaagcggttcaaaaatgagtccgatcccgaaggcgccctgtggtga

SEQ ID NO: 18858 - RNA, 9879 nt, synthetic construct
  misc_feature 1..9879: note = derived and/or modified CDS sequence (opt5) from DENV-1__FJ024472__SS-prME
  source 1..9879: mol_type = other RNA
agcgtgaccatgctgctgatgctgatgcccacagcccttgctttccacctgacgaccagaggcggggaacctcatatgatcgtctccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcggtcggcaaggcctgggaggagggggtgtgcggcattagaagcgctacacgcctggaaaacatcatgtggaaacagatctccaacgagcttaatcatattctgctcgaaaacgacatgaagttcaccgttgtggtcggagatgtggccggcatcctggctcaggggaaaaagatgattcggccgcaacccatggagtacaaatattcttggaaaagctggggaaaggccaagatcattggcgccgacgtgcagaataccacatttatcatcgatgggcctaacacccccgaatgtcctgacgatcagagagcttggaatatttgggaggtcgaggactacggattcggcatctttacgacaaacatttggctgaaacttcgcgattcctatacccaggtttgcgaccaccggctcatgagcgcggccatcaaagattctaaggctgtgcacgccgacatgggctactggattgaatccgagaaaaatgaaacatggaagctggccagagctagcttcatcgaggtgaagacctgtatctggcccaaatctcatacactgtggtccaacggggtcctcgaaagcgagatgattatcccgaagatttatggaggccctatctctcaacacaattaccgccccgggtacttcacccagacggccggaccttggcatctgggcaaacttgagctggattttgacctctgcgaagggaccacagtggttgtggatgagcactgcggaaaccggggccccagcctgagaaccacaaccgtcacgggcaagattatccacgaatggtgttgccggtcctgtacactgcctccccttcgcttcagaggggaggacggatgctggtatggcatggagatccggccggtgaaagaaaaggaggaaaatctcgttaagagcatggtgtctgcggggtccggagaggtcgacagcttttccctgggcctgctctgtatttctatcatgattgaagaggtgatgagaagccgctggtcccggaaaatgctgatgaccgggacacttgctgttatcttcctgctcattatgggacagctgacctggaacgatctgatcagactttgcattatggtgggcgccaatgcctctgaccgcatgggcatggggaccacatacctggctctcatggccacgtttaagatgagacctatgttcgcggtcggactgctctttcggcgcctgaccagcagagaggtgcttctgctcacaatcggcctgtccctggtggcttctgtcgaacttcccaacagcctggaggaactcggggatggactggccatgggcatcatgattctcaaactgcttaccgacttccaatcccatcagctgtgggccacactcctgagcctgacctttatcaagacgacattctctcttcactatgcttggaaaaccatggccatggttctgtccattgtgagcctctttcccctgtgtctctctaccacatcccagaagaccacatggctgcctgtgcttctggggagcctgggatgcaagccgctcacgatgttcctgatcgctgagaataaaatttggggccggcgctcttggccccttaacgaaggcatcatggccgtcgggatcgtgtccattctgctcagctccctgctcaagaacgatgttcctctggcgggaccccttatcgccggcgggatgctgattgcttgttacgtgatcagcggatctagcgccgacctgtccctcgagaaagctgccgaggtctcttgggaagaggaagccgagcatagcggcgcttcccacaatattctggtggaagttcaggatgacgggaccatgaagatcaaagatgaggagagagacgatacacttaccatcctgctcaaggcgacactgctcgccgtgtctggagtctatcctctgagcattcccgctaccctttttgtgtggtacttctggcagaagaagaagcagcggtccggcgtcctgtgggacacgccttctcccccggaagtggagcgcgccgttctggatgacggcatctatagaattatgcagcgggggctcctgggacgcagccaggtgggcgtcggggtgttccaagaaaacgtttttcataccatgtggcacgtgacaagaggagccgtccttatgtaccagggcaaacggctggagccttcctgggctagcgtgaagaaagacctcatctcttacgggggaggctggagactgcagggctcctggaataccggggaggaagtgcaggttattgccgtcgagcccggaaagaaccctaaaaatgtgcaaacagcgcccggcaccttcaagacaccggaaggggaggtgggagctatcgccctcgattttaagcctggcacgagcgggtctcccattgtcaaccgcgaaggaaaaatcgtgggcctgtatggcaatggggttgtgaccacatccggaacctacgtcagcgccatcgctcaggccaaggcgtcccaggagggccctcttcccgagattgaagacgaggtgttccggaaaagaaacctgaccatcatggatctgcaccccgggtctggaaagacacgccggtatctccctgctattgttagagaagccatcaaacgcaagctgcggacgcttattctggccccgaccagagtggtcgctagcgagatggccgaagctctcaagggcatgcccatccgctaccaaacaaccgccgtgaaatccgagcatacagggaaggagatcgttgacctgatgtgccacgcgacctttacgatgcggctgctcagccctgtgagagtccccaattataacatgattatcatggatgaagcccatttcacagacccttcttccattgctgcccggggctacatcagcacccgcgtgggaatgggcgaggctgccgccatttttatgaccgctacaccccctgggtctgtggaagcgttcccgcagagcaatgccgtcatccaggatgaggaaagagacatccccgagcggtcctggaactctggatatgagtggattaccgattttcctggcaaaacagtttggttcgtgcccagcatcaagtccgggaatgacattgctaactgtcttcgcaaaaatggaaagagagtgatccagctgtctcggaagacctttgatacggaataccagaagaccaagaacaacgactgggactacgtcgtgaccacagatattagcgagatgggcgccaatttcagagccgaccgcgttatcgatcctcggagatgcctgaaacccgtgattctcaaggacgggccggaacgcgtcatcctggctggccctatgcccgtgaccgttgcctccgcggctcagcggagaggacgcatcggccggaaccacaataaagagggggatcagtatatttacatgggacagccccttaacaatgacgaggatcatgcccactggacggaagccaagatgctgctcgacaacatcaatacccctgagggcattatccccgctctgttcgaacctgagagagaaaagagcgccgcgattgatggggagtatcgcctgagaggagaggcccggaaaacatttgtggaactcatgcgcagaggcgaccttccggtctggctgtcttacaaggtggcttccgaggggttccaatatagcgatcggcgctggtgctttgacggcgaaagaaacaatcaggtcctggaggaaaacatggatgtggagatctggaccaaagagggagaacggaagaaactcagaccccgctggctggacgcccggacatactccgaccctcttgctctgagagagttcaaggaatttgccgctggccgccggtctgttagcggggatctcatcctggagattggaaaactgccccagcacctcacccagagagcccaaaatgcgcttgacaacctggtgatgctgcataattccgaacagggcgggcgggcctatcgccacgctatggaggagctccctgatacaatcgaaaccctgatgcttctggccctcattgctgtgctgacgggaggcgtcacactgttctttctctctggcagagggcttggaaagaccagcatcggcctgctgtgtgttatggcctccagcgtgctcctgtggatggcctctgtggagccccattggattgctgcgtccatcatccttgagttctttctgatggtcctcctgattccggagcctgaccggcagcgcacaccccaggataaccaactggcctacgtggttatcgggctccttttcatgattctgacagtggctgccaatgagatgggactgctcgaaaccacaaagaaagacctgggcatcgggcacgtcgccgtggagaaccaccatcacgctgccatgcttgatgtcgacctgcatcctgcgagcgcctggacgctctacgctgtggccaccacaattatcacccccatgatgagacacacaattgaaaacaccacggctaatatctctctgaccgccatcgcgaaccaggccgctattctgatgggactcgataagggctggcctatctccaaaatggacattggcgttccccttctggccctggggtgctatagccaggtgaatccgctcacactgaccgctgccgtccttatgctggtggctcattacgccatcattggacctggcctccaagcgaaggccacacgggaggctcagaaacgcaccgccgctgggatcatgaagaaccccacggttgatggaatcgtggccattgacctggatcccgtcgtgtatgacgccaagtttgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttctggaataccacaatcgccgtgtctatggctaacatctttcggggcagctacctggccggggccggactggctttctccctcatgaaaagccttggcgggggacgcagaggcaccggggcccagggagaaacactgggcgagaagtggaaacggcagctgaatcagctctccaagtctgagttcaacacctataagagaagcggcattatggaggttgaccgctccgaagcgaaagaggggctgaagcggggagagacgacaaaacacgccgtctctagaggcaccgctaaacttcgctggtttgtggaacggaatctggtgaaacccgaggggaaggtcatcgatctcggatgtggcagagggggatggagctactattgcgccggcctgaagaaagttaccgaagtgaagggctacacaaaagggggacctggccacgaggaacccattcctatggctacctacgggtggaacctggtgaagctccattccggaaaagacgtcttctttattccccctgagaagtgtgatacacttctgtgcgacatcggcgagtctagcccgaatcccacgatcgaagaggggcgcaccctgcgggtgctcaaaatggttgaaccttggctgagaggaaaccaattctgtattaagatccttaatccctatatgccttccgtggtcgagacactggagcagatgcagcgcaagcacggcggcatgctcgtgcggaaccccctgagcagaaattctacccatgaaatgtactgggtttcctgcgggacaggaaacatcgtgagcgccgtcaatatgacctctcgcatgctgctcaaccggtttacgatggcgcacagaaaaccgacctatgagcgcgatgtggacctgggcgccgggacaagacacgtggctgtcgaacctgaggttgccaaccttgatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaagctgctcaccaagccttgggacgttattcccatggtgacacaaatcgctatgaccgatacgacacctttcggccagcagcgcgtctttaaagagaaggtggacaccagaaccccgaaagccaagcggggcacagcgcaaatcatggaagttacggccaaatggctgtgggggttccttagcagaaacaagaagccccggatttgtacccgcgaggaatttacaagaaaagtgcggtctaatgctgccatcggagctgtcttcgtggacgagaaccagtggaatagcgccaaggaggccgttgaagatgagcgcttttgggacctggtgcatagagaacgggagctccacaaacagggcaagtgcgcgacctgcgtctacaacatgatggggaaacgcgaaaagaagctgggagagttcggcaaagctaaggggtccagagccatttggtacatgtggctgggcgcccggtttctcgagttcgaagctctgggattcatgaatgaggatcactggttttctcgcgaaaacagcctttccggcgtggagggggagggactgcataaactcggctatatcctgagagacatttctaagatccctgggggaaatatgtacgccgatgacacagctggctgggatacccggatcacagaagacgatcttcagaacgaggcccgcattaccgacatcatggaacccgagcacgcgctgctcgccaaaagcattttcaagctgacgtatcaaaataaagtcgtgagagttcagcggcctgctaagaacgggaccgtgatggatgtcatctcccgcagagaccagcggggctctggacaggtgggcacatacgggctgaatacctttacaaacatggaagcccaactcattagacagatggagagcgagggaatcttctcccccagcgaactggagaccccgaaccttgctgaacgcgtgctggattggctcgagaagtatggcgttgaacggctgaaaagaatggccatctctggggacgactgtgtggtcaagcctattgatgaccgctttgcgacggcccttacagctctgaatgatatgggaaaagtgcggaaggacatcccccagtgggagccttccaaaggctggaacgattggcagcaagttcccttctgcagccatcactttcaccagctcattatgaaggacgggagagagatcgtggtcccttgtcgcaatcaggatgaactggtgggccgggccagagtctctcagggagctggctggtccctgcgcgagaccgcctgcctcggaaagagctacgctcaaatgtggcagctgatgtatttccatcggagagaccttcgcctggccgcgaacgccatttgttccgctgtgcccgttgattggatcccgacatctcggaccacgtggagcattcacgcccatcaccagtggatgaccacagaagacatgctctccgtgtggaatagagtctggatcgaggaaaacccttggatggaggataaaacccatatcagctcttggggagacgtgccctacctgggcaagcgggaggaccaatggtgcgggtcccttattggactgacagccagagctacctgggccacaaatatccaggttgcgattaaccaggtgcgccggctcatcggcaatgaaaactacctggattatatgaccagcatgaaaagatttaagaatgagtctgaccccgaaggggctctgtggtga

SEQ ID NO: 18859 - RNA, 9879 nt, synthetic construct
  misc_feature 1..9879: note = derived and/or modified CDS sequence (opt5) from DENV-1__FJ024439__SS-prME
  source 1..9879: mol_type = other RNA
agcgtgaccatgctgctgatgctgatgcccacagcccttgctttccacctgacgaccagaggcggggagcctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcttctctatgacatgtattgctgtgggcctggttaccctgtaccttggggtgatggtccaggccgattccggatgcgtgatcaactggaaaggccgcgaactcaagtgtgggagcggaatttttgttacaaatgaggtgcacacctggacggaacaatataagttccaggctgactcccctaaacggctgtctgccgcgatcggcaaggcctgggaggagggggtctgcggcatcagaagcgctacacgcctggaaaacattatgtggaaacagatctccaacgagctcaatcatattctgcttgaaaacgacatgaagtttaccgtggttgtgggagatgtcgccggcatcctggctcaggggaaaaagatgattcggccgcaacccatggagtacaaatattcttggaaaagctggggaaaggccaagatcatcggcgccgacgtgcagaataccacattcattatcgatgggcctaacacccccgaatgtcctgacgatcagagagcttggaatatttgggaggtggaggactacggatttggcatcttcacgacaaacatttggctcaagctgcgcgattcctatacccaggtctgcgaccaccggctgatgagcgcggccatcaaagattctaaggctgttcacgccgacatgggctactggatcgaatccgagaaaaatgaaacatggaaacttgccagagctagcttcattgaggtgaagacctgtatctggcccaaatctcatacactctggtccaacggggtgctggaaagcgagatgattatcccgaagatttatggaggccctatctctcaacacaattaccgccccgggtactttacccagacggccggaccttggcatctgggcaaactcgagctggatttcgacctttgcgaagggaccacagtcgtggttgatgagcactgcggaaaccggggccccagcctgagaaccacaaccgtgacgggcaagatcattcacgaatggtgttgccggtcctgtacactccctcccctgcgctttagaggggaggacggatgctggtatggcatggagatccggccggtcaaagaaaaggaggaaaatctggtcaagagcatggtttctgcggggtccggagaggtggacagcttctcccttggcctcctgtgtatttctatcatgattgaagaggtcatgagaagccgctggtcccggaaaatgctgatgaccgggacactcgctgtgtttttcctgcttatcatgggacagctgacctggaacgatctcattagactgtgcatcatggttggcgccaatgcctctgaccgcatgggcatggggaccacatacctggctcttatggccacgtttaagatgagacctatgttcgcggtgggactgctctttcggcgcctgaccagcagagaggtcctcctgcttacaatcggcctgtccctcgtggcttctgtggaactgcccaacagcctggaggaacttggggatggactggccatgggcattatgatcctcaaactgctcaccgacttccaatcccatcagctgtgggccacacttctgagcctcacctttattaagacgacattctctctgcactatgcttggaaaaccatggccatggtcctgtccatcgttagcctttttcccctgtgtctctctaccacatcccagaagaccacatggctgcctgtgctcctggggagccttggatgcaagccgctgacgatgttcctgattgctgagaataaaatctggggccggcgctcttggcccctcaacgaaggcatcatggccgtggggattgtctccatcctgcttagctccctgctcaagaacgatgtgcctctggcgggacccctcattgccggcgggatgctgatcgcttgttacgttattagcggatctagcgccgacctttccctggagaaagctgccgaggtgtcttgggaagaggaagccgagcatagcggcgcttcccacaatatcctggtcgaagtgcaggatgacgggaccatgaagatcaaagatgaggagagagacgatacactcaccattctgcttaaggcgacactgctcgccgtttctggagtgtatcctctgagcatccccgctaccctcttcgtctggtacttttggcagaagaagaagcagcggtccggcgtgctgtgggacacgccttctcccccggaagtcggccgcgccgtgcttgatgacgggatttatagaatcatgcagcggggactgctgggccgcagccaggttggggtgggagtcttccaagagaacgtgtttcataccatgtggcacgttacaagaggcgccgtgctcatgtaccaggggaaacggctggaaccttcctgggctagcgtcaagaaagaccttatttcttacggaggcggctggagactgcaggggtcctggaataccggagaggaggtccaggtgatcgccgttgaacccggcaagaaccctaaaaatgtccaaacagcgcccgggaccttcaagacaccggagggagaagtgggcgctattgccctcgattttaagcctgggacgagcggatctcccatcgtgaaccgcgagggcaaaatcgtcggcctgtatgggaatggagtggttaccacatccggcacctacgtgagcgccattgctcaggccaaggcgtcccaggaagggcctctccccgagatcgaggacgaagtcttccggaaaagaaacctgaccattatggatcttcaccccggatctggcaagacacgccggtatctgcctgctatcgtgagagaggccattaaacgcaagctgcggacgctcatcctggccccgaccagagttgtggctagcgaaatggccgaggctcttaaggggatgcccatccgctaccaaacaaccgccgtcaaatccgaacatacaggcaaggagattgtggacctgatgtgccacgcgacctttacgatgcggctcctgagccctgttagagtgcccaattataacatgatcattatggatgaggcccatttcacagacccttcttccatcgctgcccggggatacattagcacccgcgtcggcatgggggaagctgccgccatctttatgaccgctacaccccctggatctgtggaggcgttcccgcagagcaatgccgtgatccaggatgaagagagagacattcccgaacggtcctggaactctggctatgagtggatcaccgattttcctgggaaaacagtctggttcgttcccagcattaagtccggaaatgacatcgctaactgtctgcgcaaaaatggcaagagagtgattcagctctctcggaagaccttcgatacggagtaccagaaaaccaagaacaacgactgggactacgtggtcaccacagatatcagcgaaatgggggccaattttagagccgaccgcgtgattgatcctcggagatgccttaaacccgttatcctgaaggacggcccggagcgcgtgatcctggctggacctatgcccgtcaccgtggcctccgcggctcagcggagaggccgcattgggcggaaccacaataaagaaggagatcagtatatctacatgggccagcccctcaacaatgacgaggatcatgcccactggacggaggccaagatgctgcttgacaacattaatacccctgaagggatcattcccgctctgttcgagcctgaaagagaaaagagcgccgcgatcgatggagaatatcgcctcagaggcgaggcccggaaaacatttgttgagctgatgcgcagaggggacctgccggtgtggctctcttacaaggtcgcttccgaaggcttccaatatagcgatcggcgctggtgctttgacggagagagaaacaatcaggtgcttgaagagaacatggatgtcgaaatctggaccaaagagggcgagcggaagaaactgagaccccgctggctggacgcccggacatactccgaccctctcgctctgagagagttcaaggagtttgccgctgggcgccggtctgtgagcggagatcttattctggaaatcggcaaactcccccagcacctgacccagagagcccaaaatgcgctggacaacctcgttatgcttcataattccgagcaagggggacgggcctatcgccaggctatggaggaactgcctgatacaattgagaccctgatgctcctggcccttatcgctgtgctgacgggcggcgtgacactcttctttctgtctgggagaggactgggcaagaccagcattgggctcctttgtgtcatggcctccagcgttctgctgtggatggcctctgtggaaccccactggatcgctgcgtccatcattctcgagttctttctgatggtgcttctgatcccggaacctgaccggcagcgcacaccccaggataaccagctcgcctacgtcgtgattggactgctgttcatgatcctcacagttgctgccaatgagatgggccttctggagaccacaaagaaagacctggggattggacatgtggccgtcgaaaaccaccaccatgctgccatgctcgatgtggacctgcaccctgcgagcgcctggacgctttacgctgtcgccaccacaatcattacccccatgatgagacatacaatcgagaacaccacggctaatatctctctgaccgccattgcgaaccaggccgctatcctcatgggcctggataagggctggcctatttccaaaatggacatcggggtgcccctgctcgcccttggatgctatagccaagttaatccgctgacactgaccgctgccgtgctcatgctggtcgctcactacgccattatcggccctgggcttcaggcgaaggccacacgggaagctcagaaacgcaccgccgctggaatcatgaagaaccccacggtggatggcattgttgccatcgacctggatcccgtggtctatgacgccaagtttgagaaacagctcgggcaaattatgctgctgatcctctgtacatctcagattcttctgatgagaaccacatgggcgctgtgcgaaagcatcaccctcgctaccggacctctgacaacgctttgggagggctccccgggcaagttctggaataccacaatcgccgtgtctatggctaacattttccgggggagctacctggccggagccggcctcgctttttccctgatgaaaagcctcgggggaggccgcagagggaccggagcccagggcgagacactcggcgaaaagtggaaacggcagcttaatcaactgtccaagtctgagttcaacacctataagagaagcgggatcatggaagtggaccgctccgaggcgaaagaaggactgaagcggggcgagacgacaaaacatgccgtttctagagggaccgctaagctccgctggtttgtcgagcggaatctggtgaaacccgaaggaaaggtgattgatcttggctgtgggagaggaggctggagctactattgcgccggcctgaagaaagtcaccgaggttaaggggtacacaaaaggaggccctgggcacgaggaacccatccctatggctacctacggatggaacctcgtgaagctgcactccggcaaagacgtgttctttattccccctgaaaagtgtgatacactgctctgcgacatcggggagtctagcccgaatcccacgattgaggaaggacgcacccttcgggtcctgaaaatggtggagccttggctgagaggcaaccagttctgtatcaagatcctcaatccctatatgccttccgttgtggaaacactggagcagatgcagcgcaagcatggcgggatgcttgtccggaaccccctgagcagaaattctacccacgagatgtactgggtgtcctgcggaacaggcaacattgttagcgccgtgaatatgacctctcgcatgctcctgaaccggtttacgatggcgcatagaaaaccgacctatgaacgcgatgtcgacctgggggccggaacaagacacgtggctgtggagcctgaagtcgccaacctcgatatcattggccaacggatcgagaatattaagcacgaacataaatccacctggcactacgacgaggataacccctataagacatgggcttaccatgggagctatgaggttaaaccctctggatccgccagctccatggtgaatggcgtggtcaagctgcttaccaagccttgggacgtgatccccatggttacacagatcgctatgaccgatacgacacctttcggccagcaacgcgtgtttaaagaaaaggtcgacaccagaaccccgaaagccaagcgggggacagcgcagattatggaggtgacggccaaatggctgtggggattcctcagcagaaacaagaagccccggatctgtacccgcgaagagtttacaagaaaagttcggtctaatgctgccattggcgctgtgttcgtcgacgaaaaccagtggaatagcgccaaggaggccgtggaggatgaacgcttttgggacctggttcacagagagcgggaacttcataaacaggggaagtgcgcgacctgcgtgtacaacatgatgggaaaacgcgagaagaagctgggcgagttcgggaaagctaagggctccagagccatctggtacatgtggctcggagcccggttcctggagtttgaggctctgggcttcatgaatgaagatcactggttttctcgcgagaacagcctctccggggtcgaaggagagggcctgcacaaacttgggtatattctgagagacatctctaatatccctggaggcaacatgtacgccgatgacacagctgggtgggatacccggattacagaggacgatctccaaaatgaagcccgcatcaccgacattatggagcccgaacatgcgctgcttgccaagagcatcttcaaactgacgtatcagaacaaggtggtcagagtgcagcggcctgctaaaaatggcaccgttatggatgtgatttcccgcagagaccagcggggatctggccaagtcgggacatacggactcaacacctttacaaacatggaggcccagctgatcagacagatggaaagcgagggcatcttctcccccagcgagctggaaaccccgaatctcgctgagcgcgtgctggattggcttgaaaagtatggggtggagcggctgaagagaatggccatttctggagacgactgtgttgtgaaacctatcgatgaccgctttgcgacggccctcacagctctgaacgatatgggcaaggtccggaaagacattccccagtgggaaccttccaaggggtggaatgattggcaacaggtgcccttctgcagccaccattttcaccagcttatcatgaaagacggcagagagattgttgtgccttgtcgcaaccaggatgagctggtcggacgggccagagtgtctcaaggcgctgggtggtccctccgcgaaaccgcctgcctgggaaagagctacgctcagatgtggcagctgatgtatttccaccggagagacctccgcctggccgcgaatgccatctgttccgctgtccccgtggattggattccgacatctcggaccacgtggagcatccatgcccaccatcaatggatgaccacagaggacatgctttccgtttggaacagagtgtggatcgaagagaatccttggatggaagataagacccacattagctcttggggcgacgtcccctacctggggaaacgggaggaccagtggtgcggatccctcatcggcctgacagccagagctacctgggccacaaacattcaggtggcgatcaatcaggttcgccggcttattgggaacgagaattacctggattatatgaccagcatgaagagatttaaaaacgaatctgaccccgagggcgctctctggtga

SEQ ID NO: 18860 - RNA, 9879 nt, synthetic construct
  misc_feature 1..9879: note = derived and/or modified CDS sequence (opt5) from DENV-1__FJ024441__SS-prME
  source 1..9879: mol_type = other RNA
agcgtgaccatgctgctcatgctgatgcccaccgcccttgctttccacctgacgaccagaggaggggaacctcatatgattgtctccaagcaggaacggggaaagtctctcctgtttaagacaagcgccggcgttaacatgtgcacccttattgcgatggacctgggggagctctgtgaagataccatgacctacaagtgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggcggcagattcagcgcgttgaaacctgggccctgagacaccccggcttcacagtgatcgctctttttctggcccatgcgattgggacctctatcacccagaaaggaatcattttcatcctcctgatgcttgtcacacctagcatggccatgcggtgcgtgggcattgggtcccgcgattttgttgagggactgagcggcgctacgtgggtggacgtcgtgctcgagcacgggtcttgtgtgaccacaatggccaaggataagcccaccctggacatcgaactgctcaaaacagaggtcaccaaccctgctgttctgagaaaactttgcattgaagccaaaatctccaatacgacaaccgatagccggtgtccgacccaaggagaggcgacactggtggaagaacaggacgccaacttcgtgtgccgcagaacctttgtcgatcggggctggggcaatgggtgtggactcttcggcaaggggtctctgattacatgcgctaaatttaagtgcgtgacgaaacttgagggaaaaatcgttcagtacgaaaacctgaagtattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccgcacgggcctcgacttcaacgaaatggtgctgcttacaatgaaagagaagtcctggctggtccataaacagtggtttctcgatctgcctcttccctggaccagcggggcctccacatctcaagagacctggaatagacaggacctgctcgtgaccttcaagacagctcacgcgaaaaagcaggaagtcgtggttctgggaagccaagagggcgccatgcacacggctctgaccggggccacagaaattcagacctccggaacaaccacgatctttgccggccatctcaagtgccggctgaaaatggataaacttacactgaaagggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagccgccctttggcgagagctatattaccatcggggccggagaaaaggcccttaaactctcttggttcaagaagggcagctccattgggaaaatgtttgaggctacagcccgcggcgctcggagaatggccatcctgggagataccgcgtgggacttcggctctatcgggggagtgtttacgagcgttggcaagctggtccatcagattttcgggaccgcctacggagtgctcttttccggcgtgagctggacaatgaaaatcgggattggcgtcctgcttacctggctgggactcaattctcgctccacaagcctgtctatgacctgtatcgctgtgggcctggttacactttacctcggggtgatggtccaggccgattccggatgcgtgattaactggaagggccgggaactgaaatgtgggagcggaatcttcgttaccaatgaggtgcacacgtggacagaacaatataagtttcaggctgactcccctaagagactgtctgccgcgattggcaaagcctgggaggagggggtctgcggcatccgcagcgctacccggctcgaaaacatcatgtggaagcagatttccaacgagctgaatcatatccttctggaaaacgacatgaaattcaccgtggttgtgggagatgtcgccggcattctcgctcaggggaagaaaatgatcagaccgcaacccatggagtacaagtattcttggaaaagctggggaaaggccaagattatcggcgccgacgtgcagaatacaacctttatcattgatgggcctaacacgcccgaatgtcctgacgatcagcgcgcttggaatatctgggaggtggaggactacggattcggcatttttacaaccaacatctggctgaaactgcgggattcctatacacaggtctgcgaccacagacttatgagcgcggccattaaggattctaaagctgttcacgccgacatgggctactggatcgaatccgagaagaatgaaacctggaaactcgcccgcgctagcttcatcgaggtgaagacatgtgtgtggcccaagtctcataccctgtggtccaacggggtcctggaaagcgagatgattatcccgaaaatttatggaggccctatctctcaacacaattaccggcccgggtacttcacgcagaccgccggaccttggcatctcggcaagctggagcttgattttgacctgtgcgaagggacaaccgtggttgtggatgagcactgcggaaacagaggccccagcctccggacaaccacggtcacaggcaaaattatccacgaatggtgttgccgctcctgtaccctgcctcccctgagattcagaggggaagacggatgctggtatggcatggagatccggccggtgaaggaaaaagaggaaaatcttgttaagagcatggtgtctgcggggtccggagaggtcgacagcttttccctcggcctgctgtgtatttctatcatgattgaagaggtgatgcgcagccggtggtccagaaagatgctcatgacagggaccctggctgttttctttcttctgatcatgggacagctcacctggaacgatctgattcgcctgtgcatcatggtgggcgccaatgcctctgacagaatgggcatggggacaacgtaccttgctctgatggccaccttcaaaatgcggcctatgtttgcggtcggactcctgttccgcagactcacaagccgggaggtgctgcttctgaccattggcctctccctggtggcttctgtcgaactgcccaacagccttgaggaactgggggatggactcgccatgggcatcatgatcctgaagctcctgacagactttcaatcccatcagctttgggccaccctgctcagcctgacgttcattaaaacaaccttttctctgcactatgcttggaagaccatggccatggttctttccatcgtgagcctgttccccctctgtctgtctacaacctcccagaaaacaacgtggctccctgtgctgcttgggagcctgggatgcaagccgctgaccatgtttctcattgctgagaataagatctggggccgcagatcttggcccctgaacgaaggcattatggccgtcgggatcgtgtccatccttctgagctccctcctgaaaaacgatgttcctctcgcgggacccctgattgccggcgggatgcttatcgcttgttacgtgattagcggatctagcgccgacctgtccctggagaaggctgccgaggtctcttgggaagaggaagccgagcatagcggcgcttcccacaatatcctcgtggaagttcaggatgacgggacaatgaaaattaaggatgaggagcgggacgataccctgacaatccttctgaaagcgaccctcctggccgtgtctggagtctatcctctcagcatccccgctacgctgttcgtgtggtacttctggcaaaagaaaaagcagcgctccggcgtcctttgggacaccccttctcccccggaagtggagagagccgttctggatgacggcatttatcggatcatgcagcgcgggctgctcggaagaagccaggtgggcgtcggggtgtttcaagaaaacgttttccatacaatgtggcacgtgacccggggagccgtcctgatgtaccagggcaagagacttgagccttcctgggctagcgtgaaaaaggacctgatttcttacgggggaggctggcgcctccagggctcctggaatacaggggaggaagtgcaggttatcgccgtcgagcccggcaagaaccctaagaatgtgcaaaccgcgcccggcacatttaaaacgccggaaggggaggtgggagctattgccctggatttcaagcctggcaccagcgggtctcccatcgtcaaccgggaaggaaagattgtgggcctctatggcaatggggttgtgacaacctccggaacctacgtcagcgccatcgctcaggccaaagcgtcccaggagggccctctgcccgagatcgaagacgaggtgtttagaaagcgcaaccttacaattatggatctgcaccccgggtctggaaaaacgcggagatatctgcctgctatcgttcgcgaagccattaagcggaaactcagaaccctgatccttgccccgacacgcgtggtcgctagcgagatggccgaagctctgaagggcatgcccattcggtaccaaaccacagccgtgaagtccgagcataccgggaaagagatcgttgacctcatgtgccacgcgacgttcacaatgagactgctgagccctgtgcgggtccccaattataacatgatcattatggatgaagcccattttaccgacccttcttccatcgctgcccgcggctacattagcaccagagtgggaatgggcgaggctgccgccatcttcatgacagctacaccccctgggtctgtggaagcgtttccgcagagcaatgccgtcattcaggatgaggaacgggacatccccgagcgctcctggaactctggatatgagtggatcacagatttccctggcaagaccgtttggtttgtgcccagcattaaatccgggaatgacatcgctaactgtctcagaaagaatggaaaacgggtgattcagctttctagaaagacgttcgatacagaataccaaaagaccaaaaacaacgactgggactacgtcgtgacaaccgatatcagcgagatgggcgccaatttccgcgccgaccgggttattgatcctagacgctgcctgaagcccgtgatcctgaaagacgggccggaacgggtcattctcgctggccctatgcccgtgacggttgcctccgcggctcagagacgcggacggatcggcagaaaccacaataaggagggggatcagtatatctacatgggacagcccctgaacaatgacgaggatcatgcccactggaccgaagccaaaatgcttctggacaacattaatacacctgagggcatcattcccgctctctttgaacctgagcgcgaaaagagcgccgcgatcgatggggagtatagactgcggggagaggcccgcaagaccttcgtggaactgatgagacggggcgacctcccggtctggctttcttacaaagtggcttccgaggggtttcaatatagcgatcgcagatggtgcttcgacggcgaacggaacaatcaggtcctggaggaaaacatggatgtggagatttggacaaaggagggagaacgcaagaagctgcgcccccggtggctcgacgccagaacctactccgaccctctggctcttagagagtttaaagagttcgccgctggccggagatctgttagcggggatctgatcctcgagatcggaaagctgccccagcacctgacacagcgggcccaaaatgcgctcgacaaccttgtgatgctgcataattccgaacagggcgggcgcgcctatagacacgctatggaggagctgcctgataccattgaaacgctcatgctgcttgccctgatcgctgtgctcacaggaggcgtcaccctgtttttcctgtctggccgggggctcggaaaaaccagcattggccttctgtgtgttatggcctccagcgtgctgctctggatggcctctgtggagccccattggatcgctgcgtccattatcctggaatttttccttatggtcctgctcatcccggagcctgaccgccagagaacaccccaggataaccaactggcctacgtggttattgggctgctctttatgatccttaccgtggctgccaatgagatgggactgctggaaacaacgaagaaggacctcggcattgggcacgtcgccgtggagaaccaccatcacgctgccatgctggatgtcgaccttcatcctgcgagcgcctggaccctgtacgctgtggccacaaccatcattacacccatgatgcggcacaccatcgaaaacacgaccgctaatatttctctcacagccatcgcgaaccaggccgctatcctgatgggactggataaaggctggcctatttccaagatggacatcggcgttcccctccttgccctggggtgctatagccaggtgaatccgctgaccctcacagctgccgtcctgatgcttgtggctcattacgccattatcggacctggcctgcaagcgaaagccacccgcgaggctcagaagagaacggccgctgggattatgaaaaaccccacagttgatggaatcgtggccatcgacctcgatcccgtcgtgtatgacgccaagttcgaaaagcagctgggccagattatgctgctcatcctttgtacctctcaaattctgctgatgcggacaacctgggcgctctgcgagagcatcaccctggctacagggcctcttacgaccctgtgggagggatccccgggcaaattttggaatacaaccattgccgtgtctatggctaacatcttccgcggcagctacctcgccggggccggactggctttctccctgatgaaaagcctcggcgggggaagacggggcacaggggcccagggagaaacccttggcgagaaatggaagagacagctgaatcagctgtccaaatctgaatttaacacgtataagcgcagcggcatcatggaggttgaccggtccgaagcgaaggaggggctcaaaagaggagagacaaccaagcacgccgtctctcgcggcaccgctaaactgcggtggttcgtggaaagaaatcttgtgaagcccgaggggaaagtcattgatctgggatgtggccgcgggggatggagctactattgcgccggcctcaagaaggttacagaagtgaaaggctacaccaaaggcgggcctgggcacgaggaacccatccctatggctacatacgggtggaacctggtgaaactgcattccggaaaggacgtctttttcattccccctgagaaatgtgatacgctcctttgcgacatcggcgagtctagcccgaatcccaccattgaagaggggcggacactgagagtgctgaagatggttgaaccttggctccgcggaaaccaattttgtatcaaaattctgaatccctatatgccttccgtggtcgagacccttgagcagatgcagcggaagcacggcggcatgctggtgagaaaccccctcagccgcaattctacacatgaaatgtactgggtttcctgcgggaccggaaacatcgtgagcgccgtcaatatgacgtctcggatgctgctgaacagattcaccatggcgcaccgcaagccgacatatgagagagatgtggacctcggcgccgggacccggcacgtggctgtcgaacctgaggttgccaacctggatatcattggacagcgcatcgaaaatattaaacatgagcacaagtccacatggcattacgacgaggataacccctataaaacctgggcttaccacggcagctatgaagtgaagccctctgggtccgccagctccatggtgaatggagtcgtgaaacttctgacaaagccttgggacgttatccccatggtgacccaaattgctatgacggatacaaccccttttggccagcagagagtcttcaaggagaaagtggacacccggacaccgaaggccaaaagaggcacggcgcaaatcatggaagttaccgccaagtggctctgggggtttctgagccggaacaaaaagccccgcatctgtacaagagaggagttcacccggaaggtgcgctctaatgctgccattggagctgtctttgtggacgagaaccagtggaatagcgccaaagaggccgttgaagatgagagattctgggaccttgtgcatcgggaacgcgagctgcacaagcagggcaaatgcgcgacatgcgtctacaacatgatggggaagagagagaagaagctcggagagtttggcaaggctaaagggtcccgggccatctggtacatgtggctgggcgcccgcttcctggagttcgaagctctcggatttatgaatgaggatcactggttctctagagaaaacagcctgtccggcgtggagggggagggacttcataagctgggctatattctccgggacatctctaaaattcctgggggaaatatgtacgccgatgacaccgctggctgggatacacgcatcaccgaagacgatctgcagaacgaggccagaatcacggacattatggaacccgagcacgcgcttctggccaagagcatctttaaactcacctatcaaaataaggtcgtgcgggttcagcgccctgctaaaaacgggacagtgatggatgtcatttccagacgggaccagagaggctctggacaggtgggcacctacgggctgaatacattcaccaacatggaagcccaactgatccgccagatggagagcgagggaatcttttcccccagcgaactcgagacgccgaacctggctgaacgggtgcttgattggctggagaagtatggcgttgaaagactcaagcgcatggccatctctggggacgactgtgtggtcaaacctatcgatgaccggttcgcgacagccctgaccgctcttaatgatatgggaaaggtgagaaaagacattccccagtgggagccttccaagggctggaacgattggcagcaagttcccttttgcagccatcacttccaccagctgatcatgaaagacgggcgcgagattgtggtcccttgtcggaatcaggatgaactcgtgggcagagcccgcgtctctcagggagctggctggtccctgcgggagacagcctgcctgggaaagagctacgctcaaatgtggcagctcatgtattttcatagacgcgacctgcggcttgccgcgaacgccatctgttccgctgtgcccgttgattggattccgacctctagaacgacctggagcatccacgcccatcaccagtggatgacaaccgaagacatgctgtccgtgtggaatcgggtctggattgaggaaaacccttggatggaggataagacacatatcagctcttggggagacgtgccctacctcggcaaaagagaggaccaatggtgcgggtccctgatcggacttaccgcccgcgctacatgggccaccaatattcaggttgcgatcaaccaggtgcggagactgattggcaatgaaaactacctcgattatatgacgagcatgaagcgcttcaaaaatgagtctgaccccgaaggggctctgtggtga

SEQ ID NO: 18861 - RNA, 9879 nt, synthetic construct
  misc_feature 1..9879: note = derived and/or modified CDS sequence (opt5) from DENV-1__FJ024442__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaaatctctcctgtttaagacaagcgccggcgttaacatgtgcacccttattgcgatggacctgggggaactctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttaacctgtgcgaagggaccacagtcgtggttgacgagcactgcggaaatcggggccccagcctcagaaccacaaccgtgacgggcaagatcattcacgaatggtgttgccggtcctgtacactgcctcccctgcgcttcagaggggaggatggatgctggtatggcatggagatccggccggtcaaagaaaaggaggaaaaccttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaatgacctgattagactgtgcatcatggttggcgccaacgcctctgatcgcatgggcatggggaccacataccttgctctgatggccacgttcaagatgagacctatgtttgcggtgggactcctgttccggcgcctcaccagcagagaggtcctgcttctgacaatcggcctctccctggtggcttctgtggaactgcccaatagccttgaggaactgggggacggactcgccatgggcattatgatcctgaaactcctgaccgattttcaatcccatcagctttgggccacactgctcagcctgaccttcattaagacgacattttctctgcactatgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaacaaaatctggggccggcgctcttggcccctgaacgaaggcatcatggccgtggggattgtctccatccttctgagctccctcctgaagaatgacgtgcctctcgcgggacccctgattgccggcgggatgcttatcgcttgttacgttattagcggatctagcgccgatctgtccctggagaaagctgccgaggtgtcttgggaagaggaagccgagcatagcggcgcttcccacaacatcctcgtcgaagtgcaggacgatgggaccatgaagatcaaagacgaggagagagatgacacactgaccattcttctgaaggcgacactcctggccgtttctggagtgtatcctctcagcatccccgctaccctgttcgtctggtacttctggcagaagaagaagcagcggtccggcgtgctttgggatacgccttctcccccggaagtcgagcgcgccgtgctggacgatggcatttatagaatcatgcagcgggggctgctcggacgcagccaggttggcgtgggggtctttcaagaaaatgtgttccataccatgtggcacgttacaagaggagccgtgctgatgtaccagggcaaacggcttgagccttcctgggctagcgtcaagaaagacctgatttcttacgggggaggctggagactccagggctcctggaacaccggggaggaagtccaggtgatcgccgttgagcccggaaagaatcctaaaaacgtccaaacagcgcccggcacctttaagacaccggaaggggaggtgggagctattgccctggacttcaagcctggcacgagcgggtctcccatcgtgaatcgcgaaggacggatcgtcggcctctatggcaacggggtggttaccacatccggaacctacgtgagcgccattgctcaggccaaagcgtcccaggagggccctctgcccgagatcgaagatgaggtctttagaaagcgcaatcttaccattatggacctgcaccccgggtctggaaaaacacggagatatctgcctgctatcgtgcgcgaagccattaagcggaaactcagaacgctgatccttgccccgacccgcgttgtggctagcgagatggccgaagctctgaagggcatgcccatccggtaccaaacaaccgccgtcaagtccgagcatacagggaaagagattgtggatctcatgtgccacgcgaccttcacgatgagactgctgagccctgttcgggtgcccaactataatatgatcattatggacgaagcccattttacagatccttcttccatcgctgcccgcggctacattagcaccagagtcggaatgggcgaggctgccgccatcttcatgaccgctacaccccctgggtctgtggaagcgtttccgcagagcaacgccgtgatccaggacgaggaacgggatattcccgagcgctcctggaatctcggatatgagtggatcaccgacttccctggcaagacagtctggtttgttccctctattaaaagcgggaacgatatcgctaattgtcttagaaagaacggaaaacgggtgattcagctgtccagaaagaccttcgacacggaataccaaaagaccaaaaacaatgattgggactacgtggtcaccacagacatctctgagatgggcgccaacttccgcgccgatcgggtgattgaccctagacgctgcctgaagcccgttatcctcaaagatgggccggaacgggtgatcctggctggccctatgcccgtcaccgtggccagcgcggctcagagacgcggacggattggcagaaatcacaacaaggagggggaccagtatatctacatgggacagccccttaataacgatgaggaccatgcccactggacggaagccaaaatgctgctcgataatattaacacccctgagggcatcattcccgctctgtttgaacctgagcgcgaaaagtccgccgcgatcgacggggagtatagactgcggggagaggcccgcaagacattcgttgaactcatgagacggggcgatcttccggtgtggctgagctacaaagtcgcttctgaggggtttcaatattccgaccgcagatggtgcttcgatggcgaacggaataaccaggtgctggaggaaaatatggacgtcgagatctggaccaaggagggagaacgcaaaaagctccgcccccggtggctggatgccagaacatacagcgaccctcttgctctgcgcgagtttaaagagttcgccgctggccggagatccgtgtctggggacctcattctggagatcggaaagctgccccagcacctcacccagcgggcccaaaacgcgcttgataatctggttatgctgcataacagcgaacagggcgggcgcgcctatagacacgctatggaggagctccctgacacaattgaaaccctgatgcttctggccctcatcgctgtgctgacgggaggcgtgacactgtttttcctctccggccgggggcttggaaaaacctctattggcctgctgtgtgtcatggccagctccgttctcctgtggatggccagcgtggagccccattggatcgctgcgtctatcattcttgaatttttcctgatggtgctcctgatcccggagcctgatcgccagagaacaccccaggacaatcaactggcctacgtcgtgattgggctcctttttatgatcctgacagttgctgccaacgagatgggactgctcgaaaccacaaagaaggatctgggcattgggcacgtggccgtcgagaaccaccatcacgctgccatgcttgacgtggatctgcatcctgcgtccgcctggacgctctacgctgtcgccaccacaatcattacccccatgatgcggcacacaatcgaaaataccacggctaacatcagcctgaccgccattgcgaatcaggccgctatcctgatgggactcgacaaaggctggcctatttctaagatggatatcggcgtgccccttctggccctggggtgctattcccaggttaacccgctcacactgaccgctgccgtgcttatgctggtcgctcattacgccattatcggacctggcctccaagcgaaagccacacgcgaggctcagaagagaaccgccgctgggatcatgaaaaatcccacggtggacggaattgttgccatcgatctggaccccgtggtctatgatgccaagttcgaaaagcagctgggccagattatgctccttatcctgtgtacaagccaaattctgctcatgcggaccacatgggcgctgtgcgagtctatcacccttgctaccgggcctctgacaacgctctgggagggaagcccgggcaaattttggaacaccacaatcgccgtgtccatggctaatattttccgcggctcttacctggccggggccggactggctttcagcctcatgaagtcccttggcgggggaagacggggcaccggggcccagggagaaacactgggcgagaaatggaagagacagctgaaccagctcagcaaatccgaatttaatacctataagcgctctggcatcatggaggtggaccggagcgaagcgaaggaggggctgaaaagaggagagacgacaaagcacgccgtttcccgcggcaccgctaaacttcggtggttcgtcgaaagaaacctggtgaagcccgaggggaaagtgattgacctcggatgtggccgcgggggatggtcttactattgcgccggcctgaagaaggtcaccgaagttaaaggctacacaaaagggggacctggccacgaggaacccatccctatggctacctacgggtggaatctggtgaaactccatagcggaaaggatgtgtttttcattccccctgagaaatgtgacacacttctgtgcgatatcggcgagtcctctccgaaccccacgattgaagaggggcggaccctgagagtcctcaagatggtggaaccttggctgcgcggaaatcaattttgtatcaaaatccttaacccctatatgcctagcgttgtggagacactggagcagatgcagcggaagcacggcggcatgctcgtcagaaatcccctgtcccgcaacagcacccatgaaatgtactgggtgtcttgcgggacaggaaatattgtttccgccgtgaacatgaccagccggatgctgctcaacagattcacgatggcgcaccgcaagccgacctatgagagagacgtcgatctgggcgccgggacacggcacgtggctgtggaacctgaggtcgccaatcttgacatcattggacagcgcatcgaaaacattaaacatgagcacaagtctacctggcattacgatgaggacaatccctataaaacatgggcttaccacggctcctatgaagttaagcccagcgggtctgcctccagcatggtgaacggagtggtcaaactgctcaccaagccttgggatgtgatccccatggttacacaaatcgctatgaccgacacgacaccttttggccagcagagagtgttcaaggagaaagtcgatacccggaccccgaaggccaaaagaggcacagcgcaaattatggaagtgacggccaagtggctgtgggggtttctttcccggaataaaaagccccgcatctgtaccagagaggagttcacacggaaggttcgcagcaacgctgccattggagctgtgtttgtcgacgagaatcagtggaactctgccaaagaggccgtggaagacgagagattctgggatctggttcatcgggaacgcgagctccacaagcagggcaaatgcgcgacctgcgtgtacaatatgatggggaagagagagaaaaagctgggagagtttggcaaggctaaagggagccgggccatctggtacatgtggctgggcgcccgcttcctcgagttcgaagctctgggatttatgaacgaggaccactggttctccagagaaaattctcttagcggcgtcgagggggagggactgcataagctcggctatattctgcgggatatctccaaaatccctgggggaaacatgtacgccgacgatacagctggctgggacacccgcattacagaagatgaccttcagaatgaggccagaatcaccgatattatggaacccgagcacgcgctgctcgccaagtctatctttaaactgacgtatcaaaacaaggtggtccgggtgcagcgccctgctaaaaatgggaccgttatggacgtgattagcagacgggatcagagaggctccggacaggtcggcacatacgggctgaacaccttcacaaacatggaagcccaactcatccgccagatggagtctgagggaatctttagcccctccgaactggagaccccgaatcttgctgaacgggtgctggactggctcgagaagtatggcgtggaaagactgaagcgcatggccattagcggggatgactgtgttgtgaaacctatcgacgatcggttcgcgacggcccttacagctctgaacgacatgggaaaggtcagaaaagatattccccagtgggagccttctaagggctggaatgactggcagcaagtgcccttttgctcccatcacttccaccagctcatcatgaaagatgggcgcgagattgttgtgccttgtcggaaccaggacgaactggtcggcagagcccgcgtgagccagggagctggctggtctctgcgggagaccgcctgcctcgggaagtcctacgctcaaatgtggcagctgatgtattttcatagacgcgatcttcggctggccgcgaatgccatctgtagcgctgtccccgtggactggattccgacatccagaaccacgtggtctatccacgcccatcaccagtggatgaccacagaagatatgctcagcgtttggaaccgggtgtggatcgaggaaaatccttggatggaggacaagacccatatttccagctggggagatgtcccctacctgggcaaaagagaggaccaatggtgcgggtctcttatcggactgacagcccgcgctacctgggccacaaacattcaggtggcgatcaatcaggttcggagactcattggcaacgaaaattacctggactatatgacctccatgaagcgcttcaaaaacgagggggatcccgaaggcgctctgtggtga

SEQ ID NO: 18862 - RNA, 9879 nt, synthetic construct
  misc_feature 1..9879: note = derived and/or modified CDS sequence (opt5) from DENV-1__FJ373296__SS-prME
  source 1..9879: mol_type = other RNA
agcgtgaccatgctgctcatgctgatgcccatcgcccttgctttccacctgacgacgagaggaggggaacctcatatgattgtctccaagcaggaacggggaaaatctctcctgtttaagaccagcgccggcgttaacatgtgcacccttatcgcgatggacctgggggaactctgtgaagataccatgacatacaaatgcccccgcattaccgaagctgaacccgacgatgtggactgttggtgcaatgccacagatacctgggtgacgtatggaacctgttcccaaacaggcgagcacagacgggacaagcgctctgtcgccctggctcctcatgtggggctgggactcgagaccagaacagaaacctggatgagctccgagggcgcctggaaacagatccagcgggttgaaacgtgggctctgcgccaccccggcttcacagtgattgccctttttctggcgcatgccatcgggacctctatcacacagaagggaattatcttcattctcctgatgcttgtcacccctagcatggctatgagatgcgtgggcatcgggtcccgggattttgttgagggactgagcggcgccacctgggtggacgtcgtgctcgagcacgggtcttgtgtgacaacgatggctaaggataaacccaccctggacattgaactgctcaagacagaggtcaccaaccctgccgttctgcgcaaactttgcatcgaagcgaagatttccaatacaaccacggatagcagatgtccgacacaaggagaggccaccctggtggaagaacaggacgctaacttcgtgtgccggcgcacctttgtcgatagaggctggggcaatgggtgtggactcttcggcaaagggtctctgatcacatgcgccaagtttaagtgcgtgaccaaacttgagggaaagatcgttcagtacgaaaacctgaaatattccgtgattgtcacagtgcacacgggcgaccagcatcaagttgggaatgagagcaccgaacacggaacaaccgctacaatcacaccccaggcccctacgaccgagattcagctcacagactacggcgccctgaccctggattgttctccccggacaggcctcgacttcaacgaaatggtgctgcttaccatgaaggagaaatcctggctggtccataagcagtggtttctcgatctgcctcttccctggacgagcggggcttccacatctcaagagacctggaatcgccaggacctgctcgtgacattcaaaaccgcgcacgccaagaagcaggaagtcgtggttctgggaagccaagagggcgctatgcacaccgccctgacaggggccacggaaatccagacctccggaacaaccacaatttttgctggccatctcaaatgcagactgaagatggataaacttaccctgaaggggatgagctatgtgatgtgtacgggctctttcaaactcgagaaggaagtcgccgagacacagcacggaaccgtgctggttcagatcaagtacgagggcaccgacgcgccgtgcaaaatccctttctccacacaagatgaaaagggggctacccagaacggacggctgattacagccaatcccatcgtgacggacaaagagaagcctgtcaacattgaagccgagccgccctttggcgagagctatatcgtgattggggctggagaaaaagcccttaagctctcttggttcaagaaaggcagctccatcgggaagatgtttgaggctaccgccagaggcgcgcgccggatggccatcctgggagatacagcttgggacttcggctctattgggggagtgtttaccagcgttggcaaactggtccatcagatcttcgggacagcctacggagtgctcttttccggcgtgagctggaccatgaagattgggatcggcgtcctgcttacgtggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacagaacaatataagtttcaggcggactcccctaaacggctgtctgccgctatcggcaaggcctgggaggagggggtctgcggcatcagaagcgctacccgcctcgaaaacattatgtggaaacagatctccaacgagctgaatcatattcttctggaaaacgacatgaagctcacggtggttgtgggagatgtcgccggcatcctggggcagggcaagaagatgattcggccgcaacccatggagtacaaatattcttggaaaagctggggcaaggccaagatcatcggggctgacgcgcagaatacaaccttcattatcgatggacctaacacccccgaatgtcctgacgatcagagagcctggaatatttgggaggtggaggactacggctttggcatcttcacaaccaacatttggctgaaacttcgcgattcctatacacaggtgtgcgaccaccggctcatgagcgctgccatcaaagattctaaggccgtccacgctgacatggggtactggatcgaatccgagaaaaatgaaacatggaagctggccagagcgagctttattgaggttaagacctgtatctggcccaaatctcatacactgtggtccaacggagtgctcgaaagcgagatgattatcccgaagatttatggcgggcctatctctcaacacaattaccgccccggatacttcacccagacagctggcccttggcatctggggaaacttgagctggatttcgacctctgcgaaggaaccacggtggtcgtggatgagcactgcggcaaccggggccccagcctgagaaccacaaccgttacagggaagatcattcacgaatggtgttgccggtcctgtaccctgcctccccttcgctttagaggagaggacggctgctggtatgggatggagatccggccggtgaaagaaaaggaggaaaatctcgtcaagagcatggtgtctgccggatccggcgaggttgacagcttctccctggggctgctctgtatttctatcatgattgaagaggtgatgagaagccgctggtcccggaaaatgctgatgacgggaacacttgccgtctttttcctgctcatcatgggccagctgacctggaacgatctgattagactttgcatcatggtgggcgctaatgcctctgaccgcatggggatgggaacaacctacctggcgctcatggctacctttaagatgagacctatgttcgccgttggcctgctctttcggcgcctgacaagcagagaggtgcttctgctcacgatcgggctgtccctggtcgcctctgtggaacttcccaacagcctggaggaactcggagatggcctggctatggggattatgatcctcaaactgcttaccgacttccaatcccatcagctgtgggccacactcctgagcctgacctttattaagacaaccttctctcttcactatgcttggaaaacgatggccatggtgctgtccatcgtcagcctctttcccctgtgtctctctacaacctcccagaagaccacatggctgcctgttcttctgggaagcctgggctgcaagccgctcaccatgttcctgattgcggagaataaaatctggggccggaagtcttggccccttaacgaagggatcatggccgtgggaattgtgtccatcctgctcagctccctgctcaaaaacgatgtccctctggctggcccccttattgccgggggaatgctgatcgcttgttacgtgattagcggctctagcgccgacctgtccctcgagaaggccgctgaggtttcttgggaagaggaagcggagcatagcggggcctcccacaatatcctggtggaagtccaggatgacggaacaatgaaaatcaaggatgaggagcgcgacgatacgcttaccattctgctcaaagctacactgctcgccgtgtctggcgtttatcctctgagcatccccgccaccctttttgtgtggtacttctggcaaaagaagaaacagagatccggcgtcctgtgggacacaccttctcccccggaagtggagcgggctgtcctggatgacgggatttatcgcatcatgcagagaggactcctgggccggagccaggtgggggttggagtgttccaagaaaacgtctttcataccatgtggcacgtgacgcgcggcgccgttcttatgtaccaggggaagagactggagccttcctgggcgagcgtgaaaaaggacctcatttcttacggaggcggctggcggctgagagggtcctggaataccggagaggaagtccaggtgatcgctgtggagcccggcaaaaaccctaagaatgttcagacagcccccgggaccttcaagacaccggaaggagaggtcggcgccattgctctcgattttaaacctgggaccagcggatctcccatcgtgaaccgcgaaggcaagatcgtgggcctgtatgggaatggagtcgtgacaacgtccggcacctacgttagcgccattgcgcaagctaaagcctcccaggaggggcctcttcccgagatcgaagacgaggtgttccggaagagaaacctgacaattatggatctgcaccccggatctggcaaaacccgccggtatctccctgccatcgtcagagaagctattaagcgcaagctgcggacccttatcctggccccgacaagagtggttgctagcgagatggccgaagcgctcaaagggatgcccatccgctaccagacgaccgccgtgaagtccgagcatacaggcaaagagattgtcgacctgatgtgccacgctacctttacaatgcggctgctcagccctgtgagagttcccaattataacatgatcattatggatgaagcccatttcaccgacccttcttccatcgctgcccggggatacattagcacgcgcgtgggcatgggggaggccgctgcgatctttatgacagccacaccccctggatctgtcgaggctttcccgcaaagcaatgccgtgatccaggatgaggaaagagacattcccgagcggtcctggaactctggctatgagtggatcaccgattttcctgggaagacagtgtggttcgtccccagcattaaatccggaaatgacatcgccaactgtcttcgcaagaatggcaagagagttattcagctgtctcggaaaacctttgatacagaataccagaagaccaaaaacaacgactgggactacgtggtgacgacagatatcagcgagatgggggctaatttcagagccgaccgcgtcattgatcctcggagatgcctgaagcccgtgatcctcaaagacggcccggaacgcgttatcctggcgggacctatgcccgtgaccgtcgcttccgccgcccaacggagaggccgcattgggcggaaccacaataaggagggagatcagtatatctacatgggccagccccttaacaatgacgaggatcatgctcactggacagaagccaagatgctgctcgacaacattaatacccctgaggggatcattcccgcgctgttcgaacctgagagagaaaagagcgccgctgtggatggagagtatcgcctgagaggcgaggcccggaagacgtttgttgagctcatgcgcagaggggaccttccggtgtggctgtcttacaaagtcgcttccgagggcttccagtatagcgatcggcgctggtgctttgacggagaaagaaacaatcaagtgctggaggaaaacatggatgtcgagatctggaccaaggagggcgaacggaaaaagctcagaccccgctggctggacgcccggacatactccgaccctcttgctctgagagagttcaaagaatttgccgcggggcgccggtctgtgagcggagatctcatcctggagattggcaagctgccccagcacctcacccagagagcccagaatgctcttgacaacctggttatgctgcataattccgaacaagggggacgggcctatcgccacgctatggaggagctccctgatacaatcgaaaccctgatgcttctggccctcattgccgtgctgacaggcggcgtgaccctgttctttctctctgggagaggacttggcaagacgagcatcgggctgctgtgtgtcatggcttccagcgttctcctgtggatggcgtctgtggagccccattggattgccgcttccatcatccttgagttctttctgatggtgctcctgattccggagcctgaccggcagcgcacaccccaggataaccagctggcctacgtcgtgatcggactccttttcatgattctgaccgttgccgctaatgagatgggcctgctcgaaaccaccaaaaaggacctggggatcggacacgtggccgtcgagaaccaccatcacgcggccatgcttgatgtggacctgcatcctgctagcgcctggaccctctacgctgtcgccacaacgattatcacccccatgatgagacacacaattgaaaacaccacagcgaatatctctctgaccgccatcgctaaccaagccgctattctgatgggcctcgataaaggctggcctatctccaagatggacattggggtgccccttctggccctgggatgctatagccaggttaatccgctcacgctgaccgctgccgtgcttatgctggtcgcgcattacgccatcattggccctgggctccaggctaaagccacacgggaggctcaaaagcgcaccgccgccggaatcatgaagaaccccacagtggatggcatcgttgcgattgacctggatcccgtggtctatgacgctaaatttgaaaagcagctggggcagatcatgctccttattctgtgtacctctcagatcctgctcatgagaacgacatgggccctgtgcgagagcattacccttgctacaggacctctgaccaccctctgggagggctccccgggcaaattctggaatacaacgatcgccgtgtctatggccaacatctttcgggggagctacctggctggagccggcctggcgttctccctcatgaaaagccttgggggaggccgcagagggaccggagcccaaggcgaaacactgggcgagaaatggaagcggcagctgaatcagctctccaagtctgagttcaacacctataaaagaagcgggattatggaggtggaccgctccgaagctaaggagggactgaaacggggcgagacaaccaagcacgccgtttctagagggacggctaaacttcgctggtttgtcgaacggaatctggtgaagcccgagggaaaggtgatcgatctcggctgtgggagaggaggctggagctactattgcgccggcctgaaaaaggtcacagaagttaaagggtacaccaagggaggccctgggcacgaggaacccattcctatggcgacctacggatggaacctggtgaaactccattccggcaaggacgtgttctttattccccctgagaaatgtgatacacttctgtgcgacatcggggagtctagcccgaatcccaccatcgaagagggacgcacactgcgggtcctcaagatggtggaaccttggctgagaggcaaccagttctgtattaagatccttaatccctatatgccttccgttgtggagacgctggagcaaatgcagcgcaaacacggcgggatgctcgtccggaaccccctgagcagaaattctacccatgaaatgtactgggtgtcctgcggaacaggcaacatcgttagcgccgtgaatatgacctctcgcatgctgctcaaccggtttacaatggctcacagaaagccgacctatgagcgcgatgtcgacctggggacgggaaccagacacgtggccgtggaacctgaggtcgctaaccttgatattatcggccagcggattgaaaatatcaaacatgagcacaagtccacatggcattacgacgaggataacccctataaaacctgggcctaccacgggagctatgaagttaagccctctggatccgctagctccatggtgaatggcgtggtcaagctgctcacaaaaccttgggacgtgattcccatggttacccagatcgccatgacagataccacgcctttcggccaacagcgcgtgtttaaggagaaagtcgacacaagaaccccgaaggcgaaacgggggaccgcccagatcatggaagtgacagctagatggctgtggggattccttagccggaacaagaagccccgcatttgtacgagagaggaatttacccggaaagttcgctctaatgccgctatcggcgccgtgttcgtcgacgagaaccaatggaatagcgccaaggaggcggtggaagatgagagattttgggacctggttcatcgggaacgcgagctccacaaacaggggaagtgcgctacatgcgtgtacaacatgatgggaaaaagagaaaagaagctgggcgagttcgggaaagccaagggctcccgggccatttggtacatgtggctgggagctcgctttctcgagttcgaagccctgggcttcatgaatgaggatcactggttttctagagaaaacagcctttccggggtcgagggagagggcctgcataaactcgggtatatcctgcgggacatttctaagatccctggaggcaatatgtacgctgatgacaccgccgggtgggatacacgcatcaccgaagacgatcttcagaacgaggcgaaaattacagacatcatggaacccgagcacgccctgctcgctaaggccattttcaaactgacctatcagaataaggtggtcagagtgcaacggcctgctaagaacggcacggttatggatgtgatcagccgcagagaccagcggggatccggccaggtcgggacctacggactgaatacatttaccaacatggaagcccagctcattagacaaatggagtctgagggcatcttcagcccctccgaactggagacaccgaaccttgcggaacgcgccctggattggctcgagaaatatggggtggaacggctgaagagaatggctatcagcggagacgactgtgtggttaaacctattgatgaccgctttgccaccgctcttacggccctgaatgatatgggcaaggtgcggaaagacatcccccagtgggagccttctaaggggtggaacgattggcagcaggtccccttctgctcccatcactttcaccaactcattatgaaggacggcagagagatcgtggttccttgtcgcaatcaggatgaactggtgggacgggctagagtcagccagggcgccgggtggtctctgcgcgagacagcgtgcctcggaaaatcctacgcccagatgtggcaactgatgtatttccatcggagagaccttcgcctggctgccaacgccatttgtagcgctgtgcccgtcgattgggtgccgacctcccggacaacctggtctatccacgcccatcaccagtggatgacgaccgaagacatgctcagcgtttggaatagagtgtggattgaggaaaacccttggatggaggataagacacatatctccagctgggaggacgtcccctacctgggcaaacgggaagaccagtggtgcgggtctcttatcggactgaccgcgagagctacatgggccaccaatattcaagtggccatcaaccaggttcgccggctcattggcaatgagaactacctggattatatgacatccatgaagagatttaaaaatgaaagcgaccccgagggggctctgtggtga

SEQ ID NO: 18863 - RNA, 9879 nt, synthetic construct
  misc_feature 1..9879: note = derived and/or modified CDS sequence (opt5) from DENV-1__FJ182018__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccatcattcaggatgaggaaagagacatccccgagcggtcctggaactctggatacgagtggattaccgatttccctggcaaaacagtgtggtttgtccccagcatcaagtccgggaatgacattgctaactgtctccgcaaaaatggaaagagagttatccagctttctcggaagaccttcgatacggaatatcagaaaaccaagaacaacgactgggactacgtggtgaccacagatattagcgagatgggcgccaatttcagagccgaccgcgtcatcgatcctcggagatgcctgaaacccgtgatcctgaaggacgggccggaacgcgttattctcgctggccctatgcccgtgaccgtcgcctccgcggctcagcggagaggacgcatcggccggaaccataataaagagggggatcagtacatttatatgggacagcccctgaacaatgacgaggatcacgcccactggacggaagccaagatgcttctggacaacatcaatacccctgagggcattatccccgctctctttgaacctgagagagaaaagagcgccgcgatcgatggggagtaccgcctgagaggagaggcccggaaaacattcgtggaactgatgcgcagaggcgacctcccggtttggctttcttataaggtggcttccgaggggtttcaatacagcgatcggcgctggtgcttcgacggcgaaagaaacaatcaggtcctggaggaaaacatggatgtggagatttggaccaaagagggagaacggaagaaactgagaccccgctggctcgacgcccggacatattccgaccctctggctcttagagagtttaaggagttcgccgctggccgccggtctgtcagcggggatctgatcctcgagattggaaaactgccccagcatctgacccagagagcccaaaatgcgctcgacaaccttgtgatgctgcacaattccgaacagggcgggcgggcctaccgccatgctatggaggagctgcctgatacaatcgaaaccctcatgctgcttgccctgattgctgttctcacgggaggcgtgacactgtttttcctgtctggcagagggctcggaaagaccagcatcggccttctgtgtgtgatggcctccagcgtcctgctctggatggcctctgttgagccccactggatcgctgcgtccattatcctggaatttttccttatggtgctgctcattccggagcctgaccggcagcgcacaccccaggataaccaactggcctatgtggtcatcgggctgctctttatgattcttacagtggctgccaatgagatgggactgctggaaaccacaaagaaagacctcggcatcgggcacgttgccgtggagaaccatcaccatgctgccatgctggatgtcgaccttcaccctgcgagcgcctggacgctgtacgctgtggccaccacaattatcacccccatgatgagacatacaatcgaaaacaccacggctaatatttctctcaccgccatcgcgaaccaggccgctattctgatgggactggataagggctggcctatctccaaaatggacattggcgtccccctccttgccctggggtgctacagccaggtgaatccgctgacactcaccgctgccgttctgatgcttgtggctcactatgccatcatcggacctggcctgcaagcgaaggccacacgggaggctcagaaacgcaccgccgctgggattatgaagaaccccacggtcgatggaatcgtggccattgacctcgatcccgttgtgtacgacgccaagttcgaaaaacagctgggccagatcatgctgctcattctttgtacatctcaaatcctgctgatgagaaccacatgggcgctctgcgagagcatcaccctggctaccgggcctcttacaacgctgtgggagggatccccgggcaagttttggaataccacaattgccgtctctatggctaacatcttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcattatggaggtggaccgctccgaagcgaaagaggggctcaagcggggagagacgacaaaacacgccgtgtctagaggcaccgctaagctgcgctggttcgttgaacggaatcttgtcaaacccgaggggaaggtgatcgatctgggatgtggcagagggggatggagctattactgcgccggcctcaagaaagtgaccgaagtcaagggctatacaaaagggggacctggccatgaggaacccattcctatggctacctacgggtggaacctggttaagctgcactccggaaaagacgtgtttttcattccccctgagaagtgtgatacactcctttgcgacattggcgagtctagcccgaatcccacgatcgaagaggggcgcaccctgcgggtgctgaaaatggtcgaaccttggctcagaggaaaccaattttgtatcaagattctgaatccctacatgccttccgtggttgagacacttgagcagatgcagcgcaagcatggcggcatgctggtgcggaaccccctcagcagaaattctacccacgaaatgtattgggtctcctgcgggacaggaaacatcgtgagcgccgttaatatgacctctcgcatgctgctgaaccggttcacgatggcgcacagaaaaccgacctacgagcgcgatgtggacctcggcgccgggacaagacatgtcgctgtggaacctgaggtggccaacctggatattatcggacagcggattgaaaatatcaagcacgagcataaatccacctggcactatgacgaggataacccctacaagacatgggcttatcatggcagctacgaagtcaaaccctctgggtccgccagctccatggttaatggagtggtgaaacttctgaccaagccttgggacgtcatccccatggtgacacaaattgctatgaccgatacgacaccttttggccagcagcgcgttttcaaagagaaggtggacaccagaaccccgaaagccaagcggggcacagcgcaaatcatggaagtcacggccaaatggctctgggggtttctgagcagaaacaagaagccccggatttgtacccgcgaggagttcacaagaaaagtgcggtctaatgctgccatcggagctgtttttgtggacgagaaccagtggaatagcgccaaggaggccgtcgaagatgagcgcttctgggaccttgtgcacagagaacgggagctgcacaaacagggcaagtgcgcgacctgcgtttataacatgatggggaaacgcgaaaagaagctcggagagtttggcaaagctaaggggtccagagccatttggtacatgtggctgggcgcccggttcctggagttcgaagctctcggatttatgaatgaggatcattggttctctcgcgaaaacagcctgtccggcgtggagggggagggacttcacaaactgggctacatcctcagagacatctctaagattcctgggggaaatatgtatgccgatgacacagctggctgggatacccggatcacagaagacgatctgcagaacgaggcccgcattaccgacatcatggaacccgagcatgcgcttctggccaaaagcatttttaagctcacgtaccaaaataaagtcgtgagagtccagcggcctgctaagaacgggaccgtgatggatgttatctcccgcagagaccagcggggctctggacaggtgggcacatatgggctgaataccttcacaaacatggaagcccaactgatcagacagatggagagcgagggaatcttttcccccagcgaactcgagaccccgaacctggctgaacgcgtccttgattggctggagaagtacggcgtggaacggctcaaaagaatggccatctctggggacgactgtgtggttaagcctattgatgaccgcttcgcgacggccctgacagctcttaatgatatgggaaaagtgcggaaggacatcccccagtgggagccttccaaaggctggaacgattggcagcaagtccccttttgcagccaccacttccatcagctgattatgaaggacgggagagagatcgtggttccttgtcgcaatcaggatgaactcgtgggccgggccagagtctctcagggagctggctggtccctgcgcgagaccgcctgcctgggaaagagctatgctcaaatgtggcagctcatgtactttcaccggagagacctgcgccttgccgcgaacgccatttgttccgctgtgcccgtcgattggatcccgacatctcggaccacgtggagcatccatgcccaccatcagtggatgaccacagaagacatgctgtccgtgtggaatagagtttggattgaggaaaacccttggatggaggataaaacccacatcagctcttggggagacgtgccctatctcggcaagcgggaggaccaatggtgcgggtccctgattggacttacagccagagctacctgggccacaaatatccaggtcgcgattaaccaggtgcgccggctgatcggcaatgaaaactacctcgattacatgaccagcatgaaaagattcaagaatgagggggaccccgaaggcgctctgtggtga

SEQ ID NO: 18864 - RNA, 9879 nt, synthetic construct
  misc_feature 1..9879: note = derived and/or modified CDS sequence (opt5) from DENV-1__FJ410287__SS-prME
  source 1..9879: mol_type = other RNA
agcgtgaccatgctgctcatgctgatgcccacagcccttgctttccacctgacgaccagaggcggggaacctcatatgattgtgtccaagcaggaacgggggaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacctctcaggctcccacaaccgagatccagctcacagactacggcgccctgaccctggattgttcccctcggacgggcctcgacttcaacgaaatggtgctgcttacaatgaaggagaaaagctggctggtccataagcagtggtttctcgatctgccccttccttggacctccggggcctctacaagccaagagacctggaatcgccaggacctgctcgtgaccttcaaaacagctcacgcgaagaagcaggaagtcgtggttctgggatcccaagagggcgccatgcacacggctctgaccggggccacagaaattcagaccagcggaacaaccacgatctttgccggccatctcaaatgcagactgaagatggataaacttacactgaaggggatgtcttatgtgatgtgtaccggctccttcaaactcgagaaggaagtcgctgagacccagcacggaacagtgctggttcagattaagtacgagggcaccgacgccccctgcaaaatcccgttcctgacacaagatgaaaagggggtgacgcagaacggacggcttatcaccgcgaatcctattgtcacagacaaagagaagcccgtgaacatcgaagctgagcctccctttggcgagagctatattatcattggggccggagaaaaagccctcaagctgtcttggttcaagaaaggcagctccatcgggaagatgtttgaggctaccgccagaggcgctcgccggatggccatcctgggagatacagcgtgggacttcggctctattgggggagtgtttaccagcgttggcaaactcgtccatcagatcttcgggacggcctacggagtgctgttttccggcgtgagctggaccatgaagattgggatcggcgtccttctgacatggctcggactcaattctagatccaccagcctgtctatgacatgtattgctgtgggccttgttaccctctacctgggggtgatggtccaggccgattccggatgcgtgatcaactggaaaggccgcgaactgaagtgtgggagcggaattttcgttacaaatgaggtgcacacctggacggaacaatataagtttcaggctgactcccccaaacggctctctgccgcgatcggcaaggcctgggaggagggggtctgcggcatcagaagcgctacacgcctggaaaacattatgtggaaacagatctccaacgagcttaatcatattctgctcgaaaacgacatgaagttcaccgtggttgtgggagatgtcgccggcatcctggctcaggggaaaaagatgattcggcctcaaccgatggagtacaaatattcttggaaaagctggggaaaggccaagatcatcggcgccgacgtgcagaataccacatttattatcgatgggcccaacacccctgaatgtcccgacgatcagagagcttggaatatttgggaggtggaggactacggattcggcatctttacgacaaacatttggctgaaacttcgcgattcctatacccaggtctgcgaccaccggctcatgagcgcggccatcaaagattctaaggctgttcacgccgacatgggctactggatcgaatccgagaaaaatgaaacatggaagctggccagagctagcttcattgaggtgaagacctgtatctggcctaaatctcatacactgtggtccaacggggtgctcgaaagcgagatgattatccccaagatttatggaggcccgatctctcaacacaattaccgccctgggtacttcacccagacggccggaccctggcatctgggcaaacttgagctggattttgacctctgcgaagggaccacagtcgtggttgatgagcactgcggaaaccggggccctagcctgagaaccacaaccgtgacgggcaagatcattcacgaatggtgttgccggtcctgtacactgccccctcttcgcttcagaggggaggacggatgctggtatggcatggagatccggcccgtcaaagaaaaggaggaaaatctcgtcaagagcatggtttctgcggggtccggagaggtggacagcttttccctgggcctgctctgtatttctatcattatcgaagaggtcatgagaagccgctggtcccggaaaatgctgatgaccgggacacttgctgtgttctttctgctcattatgggacagctgacctggaacgatctgatcagactttgcatcatggttggcgccaatgcctctgaccgcatgggcatggggaccacatacctggctctcatggccacgttcaagatgagaccgatgtttgcggtgggactgctgttccggcgcctgaccagcagagaggtccttctgctcacaattggcctgtccctggtggcttctgtggaacttcctaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcccgtgcttctggggagcctgggatgcaagcctctcacgatgtttctgatcgctgagaataaaatctggggccggcgctcttggccgcttaacgaaggcattatggccgtggggatcgtctccattctgctcagctccctgctcaagaacgatgtgcccctggcgggacctcttatcgccggcgggatgctgattgcttgttacgttatcagcggatctagcgccgacctgtccctcgagaaagctgccgaggtgtcttgggaagaggaagccgagcatagcggcgcttcccacaatatcctggtcgaagtgcaggatgacgggaccatgaagattaaagatgaggagagagacgatacacttaccatcctgctcaaggcgacactgctcgccgtttctggagtgtatcccctgagcattcctgctacccttttcgtctggtacttctggcagaagaagaagcagcggtccggcgtgctgtgggacacgccctctcctcccgaagtcgagcgcgccgtgctggatgacggcatctatagaattatgcagcgggggctcctgggacgcagccaggttggcgtgggggtctttcaagaaaacgtgttccataccatgtggcacgttacaagaggagccgtgcttatgtaccagggcaaacggctggagccgtcctgggctagcgtcaagaaagacctcatctcttacgggggaggctggagactgcagggctcctggaataccggggaggaagtgcaagtgattgccgttgagcctggaaagaaccccaaaaatgtccaaacagcgcctggcacctttaagacacccgaaggggaggtgggagctatcgccctcgatttcaagccgggcacgagcgggtctcctatcgtgaaccgcgaaggaaaaattgtcggcctgtatggcaatggggtggttaccacatccggaacctacgtgagcgccatcgctcaggccaaggcgtcccaggagggcccccttcctgagattgaagacgaggtctttcggaaaagaaacctgaccatcatggatctgcaccccgggtctggaaagacacgccggtatctccccgctattgtgagagaagccatcaaacgcaagctgcggacgcttatcctggcccctaccagagttgtggctagcgagatggccgaagctctcaagggcatgccgattcgctaccaaacaaccgccgtcaaatccgagcatacagggaaggagatcgtggacctgatgtgccacgcgaccttcacgatgcggctgctcagccccgttagagtgcctaattataacatgattatcatggatgaagcccattttacagacccctcttccattgctgcccggggctacatcagcacccgcgtcggaatgggcgaggctgccgccatcttcatgaccgctacacctcccgggtctgtggaagcgtttcctcagagcaatgccgtgattcaggatgaggaaagagacatcccggagcggtcctggaactctggatatgagtggattaccgatttccccggcaaaacagtctggtttgttcctagcatcaagtccgggaatgacattgctaactgtcttcgcaaaaatggaaagagagtgatccagctgtctcggaagaccttcgatacggaataccagaagacaaagaacaacgactgggactacgtggtcaccacagatattagcgagatgggcgccaatttcagagccgaccgcgtgatcgatccccggagatgcctgaaacctgttatcctcaaggacgggcccgaacgcgtgattctggctggcccgatgcctgtcaccgtggcctccgcggctcagcggagaggacgcatcggccggaaccacaataaagagggggatcagtatatttacatgggacagccccttaacaatgacgaggatcatgcccactggacggaagccaagatgctgctcgacaacatcaatacccccgagggcattatccctgctctgtttgaacccgagagagaaaagagcgccgcgatcgatggggagtatcgcctgagaggagaggcccggaaaacattcgttgaactcatgcgcagaggcgaccttcctgtgtggctgtcttacaaggtcgcttccgaggggtttcaatatagcgatcggcgctggtgcttcgacggcgaaagaaacaatcaggtgctggaggaaaacatggatgtcgagatttggaccaaagagggagaacggaagaaactcagaccgcgctggctggacgcccggacatactccgacccccttgctctgagagagtttaaggagttcgccgctggccgccggtctgtgagcggggatctcatcctggagattggaaaactgcctcagcacctcacccagagagcccaaaatgcgcttgacaacctggttatgctgcataattccgaacagggcgggcgggcctatcgccacgctatggaggagctccccgatacaatcgaaaccctgatgcttctggccctcattgctgtgctgacgggaggcgtgacactgtttttcctctctggcagagggcttggaaagaccagcatcggcctgctgtgtgtcatggcctccagcgttctcctgtggatggcctctgtggagcctcattggatcgctgcgtccattatccttgaatttttcctgatggtgctcctgattcccgagccggaccggcagcgcacccctcaggataaccaactggcctacgtcgtgatcgggctcctttttatgattctgacagttgctgccaatgagatgggactgctcgaaaccacaaagaaagacctgggcatcgggcacgtggccgtcgagaaccaccatcacgctgccatgcttgatgtggacctgcatcccgcgagcgcctggacgctctacgctgtcgccaccacaattatcacccctatgatgagacacacaatcgaaaacaccacggctaatatttctctgaccgccatcgcgaaccaggccgctattctgatgggactcgataagggctggcccatctccaaaatggacattggcgtgcctcttctggccctggggtgctatagccaggttaatcccctcacactgaccgctgccgtgcttatgctggtcgctcattacgccatcatcggaccgggcctccaagcgaaggccacacgggaggctcagaaacgcaccgccgctgggattatgaagaaccctacggtggatggaatcgttgccattgacctggatcccgtggtctatgacgccaagttcgaaaaacagctgggccagatcatgctccttattctgtgtacatctcaaatcctgctcatgagaaccacatgggcgctgtgcgagagcatcacccttgctaccgggcccctgacaacgctctgggagggatcccctggcaagttttggaataccacaattgccgtgtctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcattatggaggtggaccgctccgaagcgaaagaggggctgaagcggggagagacgacaaaacacgccgtttctagaggcaccgctaaacttcgctggttcgtcgaacggaatctggtgaaaccggaggggaaggtgatcgatctcggatgtggcagagggggatggagctactattgcgccggcctgaagaaagtcaccgaagttaagggctacacaaaagggggacccggccacgaggaacctattcccatggctacctacgggtggaacctggtgaagctccattccggaaaagacgtgtttttcatccctcccgagaagtgtgatacacttctgtgcgacattggcgagtctagccctaatccgacgatcgaagaggggcgcaccctgcgggtcctcaaaatggtggaaccctggctgagaggaaaccaattttgtatcaagattcttaatccttatatgccctccgttgtggagacactggagcagatgcagcgcaagcacggcggcatgctcgtccggaaccctctgagcagaaattctacccatgaaatgtactgggtgtcctgcgggacaggaaacatcgttagcgccgtgaatatgacctctcgcatgctgctcaaccggttcacgatggcgcacagaaaacccacctatgagcgcgatgtcgacctgggcgccgggacaagacacgtggctgtggaaccggaggtcgccaaccttgatattatcggacagcggattgaaaatatcaagcatgagcacaaatccacctggcattacgacgaggataacccttataagacatgggcttaccacggcagctatgaagttaaaccctctgggtccgccagctccatggtgaatggagtggtcaagctgctcaccaagccctgggacgtgatccctatggttacacaaattgctatgaccgatacgacaccctttggccagcagcgcgtgttcaaagagaaggtcgacaccagaacccctaaagccaagcggggcacagcgcaaatcatggaagtgacggccaaatggctgtgggggtttcttagcagaaacaagaagccgcggatttgtacccgcgaggagttcacaagaaaagttcggtctaatgctgccatcggagctgtgtttgtcgacgagaaccagtggaatagcgccaaggaggccgtggaagatgagcgcttctgggacctggttcatagagaacgggagctccacaaacagggcaagtgcgcgacctgcgtgtacaacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtcgagggggagggactgcataaactcggctatatcctgagagacatctctaagattcccgggggaaatatgtacgccgatgacacagctggctgggatacccggatcacagaagacgatcttcagaacgaggcccgcattaccgacatcatggaacctgagcacgcgctgctcgccaaaagcatttttaagctgacgtatcaaaataaagtggtcagagtgcagcggcccgctaagaacgggaccgttatggatgtgatctcccgcagagaccagcggggctctggacaggtcggcacatacgggctgaataccttcacaaacatggaagcccaactcatcagacagatggagagcgagggaatcttttcccctagcgaactggagacccccaaccttgctgaacgcgtgctggattggctcgagaagtatggcgtggaacggctgaaaagaatggccatctctggggacgactgtgttgtgaagccgattgatgaccgcttcgcgacggcccttacagctctgaatgatatgggaaaagtccggaaggacatccctcagtgggagccctccaaaggctggaacgattggcagcaagtgcctttttgcagccatcacttccaccagctcattatgaaggacgggagagagatcgttgtgccctgtcgcaatcaggatgaactggtcggccgggccagagtgtctcagggagctggctggtccctgcgcgagaccgcctgcctcggaaagagctacgctcaaatgtggcagctgatgtattttcatcggagagaccttcgcctggccgcgaacgccatttgttccgctgtccctgtggattggatccccacatctcggaccacgtggagcatccacgcccatcaccagtggatgaccacagaagacatgctctccgtttggaatagagtgtggattgaggaaaacccgtggatggaggataaaacccatatcagctcttggggagacgtcccttacctgggcaagcgggaggaccaatggtgcgggtcccttattggactgacagccagagctacctgggccacaaatatccaggtggcgattaaccaggttcgccggctcatcggcaatgaaaactacctggattatatgaccagcatgaaaagattcaagaatgagggggaccccgaaggcgctctgtggtga

SEQ ID NO: 18865 - RNA, 9879 nt, synthetic construct
  misc_feature 1..9879: note = derived and/or modified CDS sequence (opt5) from DENV-1__FJ432719__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccgccgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggttacacagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgttggcaaactcgtccatcagattttcgggaccgcttacggagtgctgttttccggcgtgagctggacgatgaagatcgggattggcgtccttctgacctggctcggactcaattctagatccacaagcctgtctatgacctgtatcgccgtgggccttgttacactctacctgggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctctctgcggccattggcaaggcttgggaggagggggtctgcggcatcagaagcgccacgcgcctggaaaacatcatgtggaaacagatttccaacgagcttaatcatatcctgctcgaaaacgacatgaagttcacagtggttgtgggagatgtcgctggcattctggcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtggaggactacggattcggcatttttaccacgaacatctggctgaaacttcgcgattcctatacacaggtctgcgaccaccggctcatgagcgccgctattaaagattctaaggccgttcacgccgacatgggctactggatcgaatccgagaaaaatgaaacctggaagctggctagagccagcttcatcgaggtgaagacatgtatttggcccaaatctcataccctgtggtccaacggggtgctcgaaagcgagatgatcattccgaagatctatggaggccctatttctcaacacaattaccgccccgggtacttcacacagaccgcgggaccttggcatctgggcaaacttgagctggattttgacctctgcgaagggacgaccgtcgtggttgatgagcactgcggaaaccggggccccagcctgagaacaaccacagtgaccggcaagatcatccacgaatggtgttgccggtcctgtacgctgcctccccttcgcttcagaggggaggacggatgctggtatggcatggagattcggccggtcaaagaaaaggaggaaaatctcgtcaagagcatggtttctgctgggtccggagaggtggacagcttttccctgggcctgctctgtatctctattatgatcgaagaggtcatgagaagccgctggtcccggaaaatgctgatgacagggacccttgccgtgttctttctgctcattatgggacagctgacatggaacgatctgatcagactttgcattatggttggcgccaatgcttctgaccgcatgggcatggggaccacctacctggccctcatggcgacattcaagatgagacctatgtttgctgtgggactgctgttccggcgcctgacgagcagagaggtccttctgctcaccatcggcctgtccctggtggcctctgtggaacttcccaacagcctggaggaactcggggatggactggccatgggcatcatgattctcaaactgcttacagactttcaatcccatcagctgtgggctaccctcctgagcctgacattcatcaagaccacgttttctcttcactatgcctggaaaacaatggctatggtcctgtccattgttagcctcttccccctgtgtctctctaccacctcccagaagacaacctggctgcctgtgcttctggggagcctgggatgcaagccgctcacaatgtttctgatcgccgagaataaaatttggggccggcgctcttggccccttaacgaaggcatcatggcggtggggatcgtctccattctgctcagctccctgctcaagaacgatgtgcctctggccggaccccttatcgctggcgggatgctgattgcctgttacgttatcagcggatctagcgctgacctgtccctcgagaaagccgccgaggtgtcttgggaagaggaagctgagcatagcggcgcgtcccacaatattctggtcgaagtgcaggatgacgggacgatgaagatcaaagatgaggagagagacgatacccttacaatcctgctcaaggccaccctgctcgctgtttctggagtgtatcctctgagcattcccgccacacttttcgtctggtacttctggcagaagaagaagcagcggtccggcgtgctgtgggacaccccttctcccccggaagtcgagcgcgccgtgctggatgacggcatctatagaattatgcagcgggggctcctgggacgcagccaggttggcgtgggggtctttcaagaaaacgtgttccatacgatgtggcacgttaccagaggagctgtgcttatgtaccagggcaaacggctggagccttcctgggccagcgtcaagaaagacctcatctcttacgggggaggctggagactgcagggctcctggaatacaggggaggaagtccaggtgattgcggttgagcccggaaagaaccctaaaaatgtccaaaccgctcccggcacatttaagaccccggaaggggaggtgggagccatcgccctcgatttcaagcctggcacaagcgggtctcccattgtgaaccgcgaaggaaaaatcgtcggcctgtatggcaatggggtggttacgacctccggaacatacgtgagcgctatcgcccaggcgaaggcttcccaggagggccctcttcccgagattgaagacgaggtctttcggaaaagaaacctgaccatcatggatctgcaccccgggtctggaaagacccgccggtatctccctgccattgtgagagaagccatcaaacgcaagctgcggacacttattctggctccgacgagagttgtggccagcgagatggctgaagccctcaagggcatgcccatccgctaccaaaccacagcggtcaaatccgagcataccgggaaggagatcgtggacctgatgtgccacgccacattcaccatgcggctgctcagccctgttagagtgcccaattataacatgattatcatggatgaagctcattttacggacccttcttccattgccgctcggggctacatcagcacacgcgtcggaatgggcgaggccgccgctattttcatgaccgcgacaccccctgggtctgtggaagcctttccgcagagcaatgctgtgatccaggatgaggaaagagacatccccgagcggtcctggaactctggatatgagtggattacagatttccctggcaaaaccgtctggtttgttcccagcatcaagtccgggaatgacattgccaactgtcttcgcaaaaatggaaagagagtgatccagctgtctcggaagacattcgataccgaataccagaagacgaagaacaacgactgggactacgtggtcacaaccgatattagcgagatgggcgccaatttcagagctgaccgcgtgatcgatcctcggagatgcctgaaacccgttattctcaaggacgggccggaacgcgtgatcctggccggccctatgcccgtcacagtggcgtccgctgcccagcggagaggacgcatcggccggaaccacaataaagagggggatcagtatatttacatgggacagccccttaacaatgacgaggatcatgcccactggaccgaagctaagatgctgctcgacaacatcaatacgcctgagggcattatccccgccctgtttgaacctgagagagaaaagagcgcggccattgatggggagtatcgcctgagaggagaggctcggaaaaccttcgttgaactcatgcgcagaggcgaccttccggtgtggctgtcttacaaggtcgcctccgaggggtttcaatatagcgatcggcgctggtgcttcgacggcgaaagaaacaatcaggtgctggaggaaaacatggatgtcgagatctggacaaaagagggagaacggaagaaactcagaccccgctggctggacgctcggacctactccgaccctcttgccctgagagagtttaaggagttcgctgccggccgccggtctgtgagcggggatctcatcctggagattggaaaactgccccagcacctcacacagagagcgcaaaatgcccttgacaacctggttatgctgcataattccgaacagggcgggcgggcttatcgccacgccatggaggagctccctgataccatcgaaacactgatgcttctggctctcattgccgtgctgaccggaggcgtgacgctgtttttcctctctggcagagggcttggaaagacaagcatcggcctgctgtgtgtcatggcctccagcgttctcctgtggatggcttctgtggagccccattggattgcggcctccatcatccttgaatttttcctgatggtgctcctgattccggagcctgaccggcagcgcacaccccaggataaccaactggcttacgtcgtgatcgggctcctttttatgattctgaccgttgccgccaatgagatgggactgctcgaaacaaccaagaaagacctgggcatcgggcacgtggctgtcgagaaccaccatcacgccgcgatgcttgatgtggacctgcatcctgccagcgcttggacactctacgccgtcgctacgaccattatcacacccatgatgagacacaccattgaaaacacaaccgccaatatctctctgacggcgatcgccaaccaggctgccattctgatgggactcgataagggctggcctatctccaaaatggacattggcgtgccccttctggctctggggtgctatagccaggttaatccgctcaccctgacagccgctgtgcttatgctggtcgcccattacgcgatcattggacctggcctccaagccaaggctacccgggaggcccagaaacgcacagctgccgggatcatgaagaaccccaccgtggatggaatcgttgccattgacctggatcccgtggtctatgacgcgaagttcgaaaaacagctgggccagatcatgctccttattctgtgtacgtctcaaatcctgctcatgagaacaacctgggctctgtgcgagagcattacacttgccaccgggcctctgaccacactctgggagggatccccgggcaagttttggaatacgaccatcgctgtgtctatggccaacatcttccggggcagctacctggccggggctggactggccttctccctcatgaaaagccttggcgggggacgcagaggcacaggggcgcagggagaaaccctgggcgagaagtggaaacggcagctgaatcagctctccaagtctgaatttaacacatataagagaagcggcattatggaggtggaccgctccgaagccaaagaggggctgaagcggggagagaccacgaaacacgctgtttctagaggcacagccaaacttcgctggttcgtcgaacggaatctggtgaaacccgaggggaaggtgatcgatctcggatgtggcagagggggatggagctactattgcgctggcctgaagaaagtcaccgaagttaagggctacaccaaagggggacctggccacgaggaacccattcctatggccacatacgggtggaacctggtgaagctccattccggaaaagacgtgtttttcattccccctgagaagtgtgatacccttctgtgcgacatcggcgagtctagcccgaatcccacaatcgaagaggggcgcacgctgcgggtcctcaaaatggtggaaccttggctgagaggaaaccaattttgtattaagatccttaatccctatatgccttccgttgtggagaccctggagcagatgcagcgcaagcacggcggcatgctcgtccggaaccccctgagcagaaattctacacatgaaatgtactgggtgtcctgcgggaccggaaacatcgttagcgcggtgaatatgacatctcgcatgctgctcaaccggttcaccatggcccacagaaaaccgacgtatgagcgcgatgtcgacctgggcgctgggaccagacacgtggccgtggaacctgaggtcgctaaccttgatattatcggacagcggattgaaaatatcaagcatgagcacaaatccacatggcattacgacgaggataacccctataagacctgggcctaccacggcagctatgaagttaaaccctctgggtccgctagctccatggtgaatggagtggtcaagctgctcacaaagccttgggacgtgattcccatggttacccaaatcgccatgacagataccacgccttttggccagcagcgcgtgttcaaagagaaggtcgacacaagaaccccgaaagcgaagcggggcaccgcccaaatcatggaagtgacagctaaatggctgtgggggtttcttagcagaaacaagaagccccggatttgtacgcgcgaggagttcaccagaaaagttcggtctaatgccgctatcggagccgtgtttgtcgacgagaaccagtggaatagcgccaaggaggcggtggaagatgagcgcttctgggacctggttcatagagaacgggagctccacaaacagggcaagtgcgctacatgcgtgtacaacatgatggggaaacgcgaaaagaagctgggagagtttggcaaagccaaggggtccagagccatttggtacatgtggctgggcgctcggttcctcgagttcgaagccctgggatttatgaatgaggatcactggttctctcgcgaaaacagcctttccggcgtcgagggggagggactgcataaactcggctatatcctgagagacatttctaagatccctgggggaaatatgtacgctgatgacaccgccggctgggatacacggatcaccgaagacgatcttcagaacgaggcgcgcattacagacatcatggaacccgagcacgccctgctcgctaaaagcatttttaagctgacctatcaaaataaagtggtcagagtgcagcggcctgccaagaacgggacggttatggatgtgatctcccgcagagaccagcggggctctggacaggtcggcacctacgggctgaatacattcaccaacatggaagctcaactcattagacagatggagagcgagggaatcttttcccccagcgaactggagacaccgaaccttgccgaacgcgtgctggattggctcgagaagtatggcgtggaacggctgaaaagaatggcgatctctggggacgactgtgttgtgaagcctattgatgaccgcttcgccaccgctcttacggccctgaatgatatgggaaaagtccggaaggacatcccccagtgggagccttccaaaggctggaacgattggcagcaagtgcccttttgcagccatcacttccaccagctcattatgaaggacgggagagagatcgttgtgccttgtcgcaatcaggatgaactggtcggccgggctagagtgtctcagggagccggctggtccctgcgcgagacagcttgcctcggaaagagctacgcccaaatgtggcagctgatgtattttcatcggagagaccttcgcctggcggccaacgctatttgttccgccgtccccgtggattggatcccgacctctcggacaacctggagcattcacgcccatcaccagtggatgacgaccgaagacatgctctccgtttggaatagagtgtggatcgaggaaaacccttggatggaggataaaacacatatcagctcttggggagacgtcccctacctgggcaagcgggaggaccaatggtgcgggtcccttattggactgaccgctagagccacatgggcgaccaatatccaggtggctattaaccaggttcgccggctcatcggcaatgaaaactacctggattatatgacaagcatgaaaagattcaagaatgagtctgaccccgaaggggccctgtggtga

SEQ ID NO: 18866 - RNA, 9879 nt, synthetic construct
  misc_feature 1..9879: note = derived and/or modified CDS sequence (opt5) from DENV-1__FJ182020__SS-prME
  source 1..9879: mol_type = other RNA
agcgtgacaatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggacaatgaaaatcaaggatgaggagcgggacgatacgctcaccatcctgcttaaggccacactgctcgctgtgagcggagtctatcctctgtccattcccgccaccctcttcgtgtggtacttttggcagaaaaagaaacaacgctctggcgtcctgtgggacacaccttcccctcccgaagtggagagagccgttcttgatgacggcatctatcggattatgcagcgcgggctgctgggaagatcccaggtgggcgtcggggtgttccaggaaaacgtttttcataccatgtggcacgtgacgcggggagctgtcctcatgtaccaaggcaagcgcctggagcccagctgggcctctgtgaaaaaggaccttatctcctacgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacctccgggagccctattgtcaaccgggaaggaaagatcgtgggcctgtatggcaatggggttgtgacaacgtccggaacctacgtctctgctatcgcccaagcgaaagctagccaggagggccccctccctgagattgaagacgaggtgttcagaaagcgcaacctgacaatcatggatcttcaccccgggtccggaaagacccggagatatctgcccgccattgttcgcgaagccatcaaacggaagctgagaaccctcattctggctcctacacgcgtggtcgccagcgagatggctgaagcccttaaaggcatgccgatccggtaccagacgaccgcggtgaagtctgagcatacagggaaagagatcgttgacctgatgtgccacgccacctttacaatgagactcctgtcccccgtgcgcgtccctaattataacatgattatcatggatgaagctcatttcaccgaccccagctctattgccgctcggggctacatcagcacgagagtgggaatgggcgaggccgccgctatttttatgacagcgacccctcccgggtccgtggaagccttccctcaatctaatgctgtcatccaggatgaggaacgggacatcccggagcgcagctggaactccggatatgagtggattaccgattttcccggcaagacagtttggttcgtgccttctatcaagagcgggaatgacattgccaactgtctgcgcaagaatggaaagcgggtgatccagctctcccgcaaaaccttcgatacagaataccagaagaccaaaaacaacgactgggactacgtcgtgacgacagatattagcgagatgggcgccaattttagagctgaccgggttatcgatcccagacgctgccttaagcctgtgattctgaaggacgggcccgaacgggtcatcctggccggcccgatgcctgtgaccgttgcgtctgctgcccaaagacgcggacggatcggcagaaaccacaataaagagggggatcagtatatttacatgggacagcccctcaacaatgacgaggatcatgcccactggacagaagctaagatgctgcttgacaacatcaatacccccgagggcattatccctgccctgttcgaacccgagcgcgaaaaatccgcggccattgatggggagtatcggctcagaggagaggctcgcaagacgtttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatctggaccaaggagggagaacgcaaaaagctgagaccgcggtggctggacgctagaacatacagcgaccccctcgccctgcgcgagttcaaggaatttgctgccggccggagatccgtttctggggatcttatcctggagattggaaaactccctcagcacctgacccagcgcgcgcagaatgccctggacaacctcgtgatgcttcataatagcgaacaaggcgggcgggcttatagacacgccatggaggagctgcccgatacaatcgaaaccctgatgctcctggctcttattgccgtgctgacaggaggcgtcaccctcttctttctgtccggccgggggctgggaaagacgagcatcggcctcctttgtgttatggcctcttccgtgctgctgtggatggctagcgtggagcctcattggattgcggcctctatcatcctcgagttctttctgatggtccttctgattcccgagccggaccgccagagaacacctcaggataaccagctcgcttacgtggttatcgggctgctgttcatgattctcaccgtggccgccaatgagatgggacttctggaaaccaccaagaaggacctgggcatcgggcacgtcgctgtggagaaccaccatcacgccgcgatgctcgatgtcgacctgcatcccgcctccgcttggaccctttacgccgtggctacaacgattatcacccctatgatgcggcacacaattgaaaacaccacagccaatatcagcctgaccgcgatcgccaaccaagctgccattctcatgggactggataaaggctggcccatctctaagatggacattggcgttcctctgctcgctcttgggtgctatagccaggtgaatcccctgacgctgaccgccgctgtcctcatgctggtggcccattacgcgatcattggaccgggccttcaggccaaggctacacgcgaggcccagaagagaaccgctgccgggatcatgaagaaccctacagttgatggaatcgtggccattgacctggatcccgtcgtgtatgacgcgaaatttgaaaagcagctcggccagatcatgctgctgattctctgtacctcccagatccttctgatgcggacgacatgggctctgtgcgagtctattaccctcgccacagggcccctgaccaccctttgggagggaagccctggcaaattctggaatacaacgatcgctgtgtccatggccaacatcttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcattatggaggttgaccggagcgaagccaaggaggggctgaaaagaggagagacaaccaagcacgctgtctcccgcggcacggccaagctccggtggtttgtggaaagaaatctggtgaaaccggaggggaaggtcatcgatcttggatgtggccgcgggggatggtcttactattgcgctggcctgaaaaaggttacagaagtgaaaggctacaccaaagggggacccggccacgaggaacctattcccatggccacctacgggtggaacctcgtgaaactgcatagcggaaaggacgtcttctttatccctcccgagaagtgtgatacactgctctgcgacattggcgagtccagccctaatccgaccatcgaagaggggcggacacttagagtgctgaaaatggttgaaccctggctgcgcggaaaccagttctgtattaagatcctcaatccttatatgccctctgtggtcgagacgctggagcaaatgcagcggaaacacggcggcatgcttgtgagaaaccctctgtcccgcaatagcacccatgaaatgtactgggtttcttgcgggacaggaaacatcgtgtccgcggtcaatatgaccagccggatgctcctgaacagatttacaatggcccaccgcaagcccacctatgagcgggatgtggacctgggcgctgggacgagacacgtggccgtcgaaccggaggttgctaacctcgatattatcggacagcgcattgaaaatatcaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttattcctatggtgacacagatcgccatgaccgatacaacccccttcggccaacagagagtctttaaggagaaagtggacacgcggacacctaaggcgaagcgcggcaccgcccagatcatggaagttaccgctaaatggctgtgggggttcctcagcagaaacaagaaaccgcggatttgtacaagagaggaatttacgcggaaggtgcgctccaatgccgctatcggagccgtcttcgtggacgagaaccaatggaactctgccaaagaggcggttgaagatgagagattttgggacctggtgcatcgggaacgcgagcttcacaagcagggcaagtgcgctacctgcgtctacaacatgatggggaaaagagaaaagaaactgggagagttcggcaaggccaaagggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaaaatccccgggggaaatatgtacgctgatgacacagccggctgggatacccgcatcacagaagacgatctccagaacgaggcgaagattaccgacatcatggaacctgagcacgccctgcttgctaagtctattttcaaactgacatatcagaataaggtcgtgagagttcaacggcccgccaaaaacgggaccgtgatggatgtcatcagccgcagagaccagcggggctccggacaggtgggcacgtacgggctcaatacctttacaaacatggaagctcagctgattcgccaaatggagagcgagggaatcttctctccttccgaactggagacccccaacctcgccggcagagtgctggattggcttgaaaagcatggggttgagcggctgaaaagaatggcgatcagcggagacgactgtgtggtcaagccgattgatgaccgctttgccacagctctcaccgccctgaatgatatgggcaaggtgcggaaagacatccctcagtgggaaccctctaaggggtggaacgattggcagcaggttcctttctgctcccaccactttcatcaacttattatgaaagacggcagagagatcgtggtcccctgtcgcaatcaggatgagctggtgggacgggctagagtcagccagggcgccgggtggtccctccgcgaaacggcttgcctgggaaagtcttatgcccagatgtggcaactgatgtacttccaccggagagacctccgcctggcggccaacgctatttgtagcgccgtgcctgttgattgggtgcccacatcccggaccacatggagcatccatgcccaccatcagtggatgaccacggaggacatgctttctgtctggaatagagtgtggattgaagagaacccgtggatggaagataaaacccacatctccagctggggcgacgttccttatctggggaagcgcgaggaccagtggtgcggatctctcatcggcctgacagctcgggccacctgggcgacaaatattcaagtggctatcaaccaggtcagacggcttattgggaatgagaactacctggattacatgaccagcatgaagagatttaaaaatgaatccgaccccgagggcgccctctggtga

SEQ ID NO: 18867 - RNA, 9879 nt, synthetic construct
  misc_feature 1..9879: note = derived and/or modified CDS sequence (opt5) from DENV-1__FJ182022__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagccgccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagcacaagtactcttggaaaagctggggaaaggccaagattatcggcgccgacgtgcagaataccacatttatcattgatgggcctaacacccccgaatgtcctgacgatcagcgcgcttggaatatctgggaggtcgaggactatggattcggcatttttacgacaaacatctggctgaaactgcgggattcctacacccaggtttgcgaccacagacttatgagcgcggccattaaggattctaaagctgtgcatgccgacatgggctattggatcgaatccgagaagaatgaaacatggaaactcgcccgcgctagcttcatcgaggtgaagacctgtatttggcccaagtctcacacactgtggtccaacggggtcctggaaagcgagatgatcattccgaaaatctacggaggccctatttctcaacataattatcggcccgggtacttcacccagacggccggaccttggcacctcggcaagctggagcttgattttgacctgtgcgaagggaccacagtggttgtggatgagcactgcggaaacagaggccccagcctccggaccacaaccgtcacgggcaaaatcatccatgaatggtgttgccgctcctgtacactgcctcccctgagattcagaggggaagacggatgctggtacggcatggagattcggccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacatatcttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcatcatgattctgaagctcctgaccgactttcaatcccaccagctttgggccacactgctcagcctgaccttcatcaaaacgacattttctctgcattacgcttggaagaccatggccatggttctttccattgtgagcctgttccccctctgtctgtctaccacatcccagaaaaccacatggctccctgtgctgcttgggagcctgggatgcaagccgctgacgatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgttatgtgatcagcggatctagcgccgacctgtccctggagaaggctgccgaggtctcttgggaagaggaagccgagcacagcggcgcttcccataatattctcgtggaagttcaggatgacgggaccatgaaaatcaaggatgaggagcgggacgatacactgaccatccttctgaaagcgacactcctggccgtgtctggagtctaccctctcagcattcccgctaccctgttcgtgtggtatttctggcaaaagaaaaagcagcgctccggcgtcctttgggacacgccttctcccccggaagtggagagagccgttctggatgacggcatctaccggattatgcagcgcgggctgctcggaagaagccaggtgggcgtcggggtgtttcaagaaaacgttttccacaccatgtggcacgtgacacggggagccgtcctgatgtatcagggcaagagacttgagccttcctgggctagcgtgaaaaaggacctgatctcttacgggggaggctggcgcctccagggctcctggaataccggggaggaagtgcaggttattgccgtcgagcccggcaagaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctacggcaatggggttgtgaccacatccggaacctatgtcagcgccatcgctcaggccaaagcgtcccaggagggccctctgcccgagattgaagacgaggtgtttagaaagcgcaaccttaccatcatggatctgcatcccgggtctggaaaaacacggagatacctgcctgctattgttcgcgaagccatcaagcggaaactcagaacgctgattcttgccccgacccgcgtggtcgctagcgagatggccgaagctctgaagggcatgcccatccggtatcaaacaaccgccgtgaagtccgagcacacagggaaagagatcgttgacctcatgtgccatgcgaccttcacgatgagactgctgagccctgtgcgggtccccaattacaacatgattatcatggatgaagcccactttacagacccttcttccattgctgcccgcggctatatcagcaccagagtgggaatgggcgaggctgccgccattttcatgaccgctacaccccctgggtctgtggaagcgtttccgcagagcaatgccgtcatccaggatgaggaacgggacatccccgagcgctcctggaactctggatacgagtggattaccgatttccctggcaagacagtttggtttgtgcccagcatcaaatccgggaatgacattgctaactgtctcagaaagaatggaaaacgggtgatccagctttctagaaagaccttcgatacggaatatcaaaagaccaagaacaacgactgggactacgtcgtgaccacagatattagcgagatgggcgccaatttccgcgccgaccgggttatcgatcctagacgctgcctgaagcccgtgattctgaaagacgggccggaacgggtcatcctcgctggccctatgcccgtgaccgttgcctccgcggctcagagacgcggacggatcggcagaaaccataataaggagggggatcagtacatttatatgggacagcccctgaacaatgacgaggatcacgcccactggacggaagccaaaatgcttctggacaacatcaatacccctgagggcattatccccgctctctttgaacctgagcgcgaaaagagcgccgcgattgatggggagtacagactgcggggagaggcccgcaagacattcgtggaactgatgagacggggcgacctcccggtctggctttcttataaagtggcttccgaggggtttcaatacagcgatcgcagatggtgcttcgacggcgaacggaacaatcaggtcctggaggaaaacatggatgtggagatctggaccaaggagggagaacgcaaaaagctgcgcccccggtggctcgacgccagaacatattccgaccctctggctcttagagagtttaaagagttcgccgctggccggagatctgttagcggggatctgatcctcgagattggaaagctgccccagcatctgacccagcgggcccaaaatgcgctcgacaaccttgtgatgctgcacaattccgaacagggcgggcgcgcctacagacatgctatggaggagctgcctgatacaatcgaaaccctcatgctgcttgccctgattgctgtgctcacgggaggcgtcacactgtttttcctgtctggccgggggctcggaaaaaccagcatcggccttctgtgtgttatggcctccagcgtgctgctctggatggcctctgtggagccccactggattgctgcgtccatcatcctggaatttttccttatggtcctgctcattccggagcctgaccgccagagaacaccccaggataaccaactggcctatgtggttatcgggctgctctttatgattcttacagtggctgccaatgagatgggactgctggaaaccacaaagaaggacctcggcatcgggcacgtcgccgtggagaaccatcaccatgctgccatgctggatgtcgaccttcaccctgcgagcgcctggacgctgtacgctgtggccaccacaattatcacccccatgatgcggcatacaattgaaaacaccacggctaatatctctctcaccgccatcgcgaaccaggccgctattctgatgggactggataaaggctggcctatctccaagatggacattggcgttcccctccttgccctggggtgctacagccaggtgaatccgctgacactcaccgctgccgtcctgatgcttgtggctcactatgccatcattggacctggcctgcaagcgaaagccacacgcgaggctcagaagagaaccgccgctgggatcatgaaaaaccccacggttgatggaatcgtggccattgacctcgatcccgtcgtgtacgacgccaagttcgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattttggaataccacaatcgccgtgtctatggctaacatcttccgcggcagctatctcgccggggccggactggctttctccctgatgaaaagcctcggcgggggaagacggggcaccggggcccagggagaaacacttggcgagaaatggaagagacagctgaatcagctgtccaaatctgaatttaacacctacaagcgcagcggcattatggaggttgaccggtccgaagcgaaggaggggctcaaaagaggagagacgacaaagcacgccgtctctcgcggcaccgctaaactgcggtggttcgtggaaagaaatcttgtgaagcccgaggggaaagtcatcgatctgggatgtggccgcgggggatggagctattactgcgccggcctcaagaaggttaccgaagtgaaaggctatacaaaaggcgggcctgggcatgaggaacccattcctatggctacctacgggtggaacctggtgaaactgcactccggaaaggacgtctttttcattccccctgagaaatgtgatacactcctttgcgacattggcgagtctagcccgaatcccacgatcgaagaggggcggaccctgagagtgctgaagatggttgaaccttggctccgcggaaaccaattttgtattaaaatcctgaatccctacatgccttccgtggtcgagacacttgagcagatgcagcggaagcatggcggcatgctggtgagaaaccccctcagccgcaattctacccacgaaatgtattgggtttcctgcgggacaggaaacatcgtgagcgccgtcaatatgacctctcggatgctgctgaacagattcacgatggcgcaccgcaagccgacctacgagagagatgtggacctcggcgccgggacacggcatgtggctgtcgaacctgaggttgccaacctggatattatcggacagcgcattgaaaatatcaaacacgagcataagtccacctggcactatgacgaggataacccctacaaaacatgggcttatcatggcagctacgaagtgaagccctctgggtccgccagctccatggtgaatggagtcgtgaaacttctgaccaagccttgggacgttattcccatggtgacacaaatcgctatgaccgatacgacaccttttggccagcagagagtcttcaaggagaaagtggacacccggaccccgaaggccaaaagaggcacagcgcaaatcatggaagttacggccaagtggctctgggggtttctgagccggaacaaaaagccccgcatttgtaccagagaggagttcacacggaaggtgcgctctaatgctgccatcggagctgtctttgtggacgagaaccagtggaatagcgccaaagaggccgttgaagatgagagattctgggaccttgtgcaccgggaacgcgagctgcacaagcagggcaaatgcgcgacctgcgtctataacatgatggggaagagagagaaaaagctcggagagtttggcaaggctaaagggtcccgggccatttggtacatgtggctgggcgcccgcttcctggagttcgaagctctcggatttatgaatgaggatcattggttctctagagaaaacagcctgtccggcgtggagggggagggacttcacaagctgggctacatcctccgggacatttctaaaatccctgggggaaatatgtatgccgatgacacagctggctgggatacccgcatcacagaagacgatctgcagaacgaggccagaattaccgacatcatggaacccgagcatgcgcttctggccaagagcatttttaaactcacgtaccaaaataaggtcgtgcgggttcagcgccctgctaaaaacgggaccgtgatggatgtcatctccagacgggaccagagaggctctggacaggtgggcacatatgggctgaataccttcacaaacatggaagcccaactgattcgccagatggagagcgagggaatcttttcccccagcgaactcgagaccccgaacctggctgaacgggtgcttgattggctggagaagtacggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccaccacttccatcagctgattatgaaagacgggcgcgagatcgtggtcccttgtcggaatcaggatgaactcgtgggcagagcccgcgtctctcagggagctggctggtccctgcgggagaccgcctgcctgggaaagagctatgctcaaatgtggcagctcatgtactttcacagacgcgacctgcggcttgccgcgaacgccatttgttccgctgtgcccgttgattggatcccgacatctagaaccacgtggagcattcatgcccaccatcagtggatgaccacagaagacatgctgtccgtgtggaatcgggtctggatcgaggaaaacccttggatggaggataagacccacatcagctcttggggagacgtgccctatctcggcaaaagagaggaccaatggtgcgggtccctgattggacttacagcccgcgctacctgggccacaaatatccaggttgcgattaaccaggtgcggagactgatcggcaatgaaaactacctcgattacatgaccagcatgaagcgcttcaaaaatgagtctgaccccgaaggggctctgtggtga

SEQ ID NO: 18868 - RNA, 9879 nt, synthetic construct
  misc_feature 1..9879: note = derived and/or modified CDS sequence (opt5) from DENV-1__FJ024447__SS-prME
  source 1..9879: mol_type = other RNA
agcgtgaccatgctgctgatgctgatgcccacagcccttgctttccacctgacgaccagaggcggggagcctcatatgatcgtgtccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaagtggtgcatcagattttcgggacggcctacggagtcctgttttccggcgtgagctggaccatgaagatcgggattggcgttctcctgacatggcttggactcaattctagatccaccagcctctctatgacatgtatcgctgtgggcctggtcaccctgtaccttggggtgatggttcaggccgattccggatgcgtgattaactggaaaggccgcgaactcaagtgtgggagcggaatcttcgtcacaaatgaggtgcacacctggacggaacaatataagtttcaggctgactcccctaaacggctgtctgccgcgattggcaaggcctgggaggagggggtttgcggcatcagaagcgctacacgcctggaaaacatcatgtggaaacagatttccaacgagctcaatcatatcctgcttgaaaacgacatgaagttcaccgtggtcgtgggagatgtggccggcattctggctcaggggaaaaagatgatccggccgcaacccatggagtacaaatattcttggaaaagctggggaaaggccaagattatcggcgccgacgtccagaataccacatttatcattgatgggcctaacacccccgaatgtcctgacgatcagagagcttggaatatctgggaggttgaggactacggattcggcatttttacgacaaacatctggctcaagctgcgcgattcctatacccaggtgtgcgaccaccggctgatgagcgcggccattaaagattctaaggctgtgcacgccgacatgggctactggatcgaatccgagaaaaatgaaacatggaaacttgccagagctagcttcatcgaggtcaagacctgtatttggcccaaatctcatacactctggtccaacggggtgctggaaagcgagatgatcattccgaagatctatggaggccctatttctcaacacaattaccgccccgggtacttcacccagacggccggaccttggcatctgggcaaactcgagctggattttgacctttgcgaagggaccacagttgtggtcgatgagcactgcggaaaccggggccccagcctgagaaccacaaccgtgacgggcaagatcatccacgaatggtgttgccggtcctgtacactccctcccctgcgcttcagaggggaggacggatgctggtatggcatggagattcggccggttaaagaaaaggaggaaaatctggtcaagagcatggtctctgcggggtccggagaggtggacagcttttcccttggcctcctgtgtatctctattatgatcgaagaggttatgagaagccgctggtcccggaaaatgctgatgaccgggacactcgctgtgttctttctgcttattatgggacagctgacctggaacgatctcatcagactgtgcattatggtcggcgccaatgcctctgaccgcatgggcatggggaccacatacctggctcttatggccacgttcaagatgagacctatgtttgcggtgggactgctgttccggcgcctgaccagcagagaggtgctcctgcttacaatcggcctgtccctcgtcgcttctgttgaactgcccaacagcctggaggaacttggggatggactggccatgggcatcatgattctcaaactgctcaccgactttcaatcccatcagctgtgggccacacttctgagcctcaccttcatcaagacgacattttctctgcactatgcttggaaaaccatggccatggtgctgtccattgtgagccttttccccctgtgtctctctaccacatcccagaagaccacatggctgcctgtcctcctggggagccttggatgcaagccgctgacgatgtttctgatcgctgagaataaaatttggggccggcgctcttggcccctcaacgaaggcatcatggccgtggggatcgtttccattctgcttagctccctgctcaagaacgatgtgcctctggcgggacccctcatcgccggcgggatgctgattgcttgttacgtcatcagcggatctagcgccgacctttccctggagaaagctgccgaggtgtcttgggaagaggaagccgagcatagcggcgcttcccacaatattctggttgaagtgcaggatgacgggaccatgaagatcaaagatgaggagagagacgatacactcaccatcctgcttaaggcgacactgctcgccgtctctggagtgtatcctctgagcattcccgctaccctcttcgtctggtacttctggcagaagaagaagcagcggtccggcgtgctgtgggacacgccttctcccccggaagttggccgcgccgtgcttgatgacgggatctatagaattatgcagcggggactgctgggccgcagccaggtcggggtgggagtttttcaagagaacgtgttccataccatgtggcacgtcacaagaggcgccgtgctcatgtaccaggggaaacggctggaaccttcctgggctagcgtgaagaaagaccttatctcttacggaggcggctggagactgcaggggtcctggaataccggagaggaggttcaggtcattgccgtggaacccggcaagaaccctaaaaatgtgcaaacagcgcccgggacctttaagacaccggagggagaagtcggcgctatcgccctcgatttcaagcctgggacgagcggatctcccattgtgaaccgcgagggcaaaatcgttggcctgtatgggaatggagtggtcaccacatccggcacctacgtgagcgccatcgctcaggccaaggcgtcccaggaagggcctctccccgagattgaggacgaagtttttcggaaaagaaacctgaccatcatggatcttcaccccggatctggcaagacacgccggtatctgcctgctattgtgagagaggccatcaaacgcaagctgcggacgctcattctggccccgaccagagtcgtggctagcgaaatggccgaggctcttaaggggatgcccatccgctaccaaacaaccgccgttaaatccgaacatacaggcaaggagatcgtggacctgatgtgccacgcgaccttcacgatgcggctcctgagccctgtcagagtgcccaattataacatgattatcatggatgaggcccattttacagacccttcttccattgctgcccggggatacatcagcacccgcgtgggcatgggggaagctgccgccattttcatgaccgctacaccccctggatctgtcgaggcgtttccgcagagcaatgccgttatccaggatgaagagagagacatccccgaacggtcctggaactctggctatgagtggattaccgatttccctgggaaaacagtgtggtttgtgcccagcatcaagtccggaaatgacattgctaactgtctgcgcaaaaatggcaagagagtcatccagctctctcggaagaccttcgatacggagtaccagaaaaccaagaacaacgactgggactacgtggttaccacagatattagcgaaatgggggccaatttcagagccgaccgcgtgatcgatcctcggagatgccttaaacccgtcattctgaaggacggcccggagcgcgtgatcctggctggacctatgcccgttaccgtggcctccgcggctcagcggagaggccgcatcgggcggaaccacaataaagaaggagatcagtatatttacatgggccagcccctcaacaatgacgaggatcatgcccactggacggaggccaagatgctgcttgacaacatcaatacccctgaagggattatccccgctctgtttgagcctgaaagagaaaagagcgccgcgattgatggagaatatcgcctcagaggcgaggcccggaaaacattcgtcgagctgatgcgcagaggggacctgccggtgtggctctcttacaaggtcgcttccgaaggctttcaatatagcgatcggcgctggtgcttcgacggagagagaaacaatcaggtgcttgaagagaacatggatgttgaaatctggaccaaagagggcgagcggaagaaactgagaccccgctggctggacgcccggacatactccgaccctctcgctctgagagaatttaaggagttcgccgctgggcgccggtctgtgagcggagatcttatcctggaaattggcaaactcccccagcacctgacccagagagcccaaaatgcgctggacaacctcgtgatgcttcataattccgagcaagggggacgggcctatcgccacgctatggaggaactgcctgatacaatcgagaccctgatgctcctggcccttattgctgtcctgacgggcggcgttacactctttttcctgtctgggagaggactgggcaagaccagcatcgggctcctttgtgtgatggcctccagcgtgctgctgtggatggcctctgtcgaaccccattggattgctgcgtccatcatcctcgagtttttcctgatggtgcttctgattccggaacctgaccggcagcgcacaccccaggataaccaactcgcctacgttgtgatcggactgctgtttatgattctcacagtcgctgccaatgagatgggccttctggagaccacaaagaaagacctggggatcggacacgtggccgtcgaaaaccaccatcacgctgccatgctcgatgtggacctgcatcctgcgagcgcctggacgctttacgctgttgccaccacaattatcacccccatgatgagacacacaattgagaacaccacggctaatatctctctgaccgccatcgcgaaccaggccgctattctcatgggcctggataagggctggcctatctccaaaatggacattggggtgcccctgctcgcccttggatgctatagccaggtcaatccgctgacactgaccgctgccgtgctcatgctggttgctcattacgccatcattggccctgggcttcaagcgaaggccacacgggaagctcagaaacgcaccgccgctggaatcatgaagaaccccacggtggatggcatcgtcgccattgacctggatcccgtggtgtatgacgccaagttcgagaaacagctcgggcagatcatgctgctgattctctgtacatctcaaatccttctgatgagaaccacatgggcgctgtgcgaaagcattaccctcgctaccggacctctgacaacgctttgggagggctccccgggcaagttttggaataccacaatcgccgtttctatggctaacatcttccgggggagctacctggccggagccggcctcgctttctccctgatgaaaagcctcgggggaggccgcagagggaccggagcccagggcgagacactcggcgaaaagtggaaacggcagcttaatcagctgtccaagtctgagtttaacacctataagagaagcgggattatggaagtcgaccgctccgaggcgaaagaaggactgaagcggggcgagacgacaaaacacgccgtgtctagagggaccgctaagctccgctggttcgtggagcggaatctggtcaaacccgaaggaaaggttatcgatcttggctgtgggagaggaggctggagctactattgcgccggcctgaagaaagtgaccgaggtgaaggggtacacaaaaggaggccctgggcacgaggagcccattcctatggctacctacggatggaacctcgtcaagctgcattccggcaaagacgtgtttttcattccccctgaaaagtgtgatacactgctctgcgacattggggagtctagcccgaatcccacgatcgaggaaggacgcacccttcgggttctgaaaatggtggagccttggctgagaggcaaccaattttgtattaagatcctcaatccctatatgccttccgtcgtggaaacactggagcagatgcagcgcaagcacggcgggatgcttgttcggaaccccctgagcagaaattctacccatgagatgtactgggtgtcctgcggaacaggcaacatcgtcagcgccgtgaatatgacctctcgcatgctcctgaaccggttcacgatggcgcacagaaaaccgacctatgaacgcgatgtggacctgggggccggaacaagacacgtcgctgttgagcctgaagtggccaacctcgatattatcggccagcggattgagaatatcaagcatgaacacaaatccacctggcattacgacgaggataacccctataagacatgggcttaccacgggagctatgaggtgaaaccctctggatccgccagctccatggtcaatggcgtggttaagctgcttaccaagccttgggacgtgattcccatggtcacacaaatcgctatgaccgatacgacaccttttggccagcagcgcgtgttcaaagaaaaggttgacaccagaaccccgaaagccaagcgggggacagcgcaaatcatggaggtgacggccaaatggctgtggggatttctcagcagaaacaagaagccccggatttgtacccgcgaagagttcacaagaaaagtccggtctaatgctgccatcggcgctgtgtttgttgacgaaaaccagtggaatagcgccaaggaggccgtggaggatgaacgcttctgggacctggtccatagagagcgggaacttcacaaacaggggaagtgcgcgacctgcgtgtacaacatgatgggaaaacgcgagaagaagctgggcgaatttgggaaagctaagggctccagagccatttggtacatgtggctcggagcccggttcctggagttcgaggctctgggctttatgaatgaagatcactggttctctcgcgagaacagcctctccggggtcgaaggagagggcctgcataaacttgggtatatcctgagagacatttctaatatccctggaggcaacatgtacgccgatgacacagctgggtgggatacccggatcacagaggacgatctccagaatgaagcccgcattaccgacatcatggagcccgaacacgcgctgcttgccaagagcatttttaaactgacgtatcaaaacaaggtggttagagtgcagcggcctgctaaaaatggcaccgtcatggatgtgatctcccgcagagaccagcggggatctggccaggtggggacatacggactcaacaccttcacaaacatggaggcccaactgattagacagatggaaagcgagggcatcttttcccccagcgagctggaaaccccgaatctcgctgagcgcgttctggattggcttgaaaagtatggggtggagcggctgaagagaatggccatctctggagacgactgtgtcgtgaaacctattgatgaccgcttcgcgacggccctcacagctctgaacgatatgggcaaggttcggaaagacatcccccagtgggaaccttccaaggggtggaatgattggcagcaagtgcccttttgcagccatcacttccaccagcttattatgaaagacggcagagagatcgtcgtgccttgtcgcaaccaggatgagctggtcggacgggccagagtgtctcagggcgctgggtggtccctccgcgaaaccgcctgcctgggaaagagctacgctcaaatgtggcagctgatgtattttcatcggagagacctccgcctggccgcgaatgccatttgttccgctgttcccgtggattggatcccgacatctcggaccacgtggagcattcacgcccatcaccagtggatgaccacagaggacatgctttccgtctggaacagagtgtggatcgaagagaatccttggatggaagataagacccatatcagctcttggggcgacgttccctacctggggaaacgggaggaccaatggtgcggatccctcattggcctgacagccagagctacctgggccacaaacatccaggtggcgattaatcaggtccgccggcttatcgggaacgagaattacctggattatatgaccagcatgaagagattcaaaaacgaatctgaccccgagggcgctctctggtga

SEQ ID NO: 18869 - RNA, 9879 nt, synthetic construct
  misc_feature 1..9879: note = derived and/or modified CDS sequence (opt5) from DENV-1__FJ182025__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttattgcctccagcgtgctgctctggatggcctctgtggaaccccattggatcgctgcgtccatcattctggagtttttccttatggtcctgctcatcccggaacctgaccggcagcgcacaccccaggataaccaactggcctacgtggttattggactgctctttatgatccttacagtggctgccaatgagatgggcctgctggagaccacaaagaaagacctcgggattggacacgtcgccgtggaaaaccaccatcacgctgccatgctggatgtcgaccttcatcctgcgagcgcctggacgctgtacgctgtggccaccacaatcattacccccatgatgagacacacaatcgagaacaccacggctaatatctctctcaccgccattgcgaaccaggccgctatcctgatgggcctggataagggctggcctatttccaaaatggacatcggggttcccctccttgccctgggatgctatagccaggtgaatccgctgacactcaccgctgccgtcctgatgcttgtggctcattacgccattatcggccctgggctgcaagcgaaggccacacgggaagctcagaaacgcaccgccgctggaatcatgaagaaccccacggttgatggcattgtggccatcgacctcgatcccgtcgtgtatgacgccaagttcgagaaacagctggggcagattatgctgctcatcctttgtacatctcaaattctgctgatgagaaccacatgggcgctctgcgaaagcatcaccctggctaccggacctcttacaacgctgtgggagggctccccgggcaagttttggaataccacaatcgccgtgtctatggctaacattttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggatcatggaagttgaccgctccgaggcgaaagaaggactcaagcggggcgagacgacaaaacacgccgtctctagagggaccgctaagctgcgctggttcgtggagcggaatcttgtgaaacccgaaggaaaggtcattgatctgggctgtgggagaggaggctggagctactattgcgccggcctcaagaaagttaccgaggtgaaggggtacacaaaaggaggccctgggcacgaggagcccatccctatggctacctacggatggaacctggtgaagctgcattccggcaaagacgtctttttcattccccctgaaaagtgtgatacactcctttgcgacatcggggagtctagcccgaatcccacgattgaggaaggacgcaccctgcgggtgctgaaaatggttgagccttggctcagaggcaaccaattttgtatcaagatcctgaatccctatatgccttccgtggtcgaaacacttgagcagatgcagcgcaagcacggcgggatgctggtgcggaaccccctcagcagaaattctacccatgagatgtactgggtttcctgcggaacaggcaacattgtgagcgccgtcaatatgacctctcgcatgctgctgaaccggttcacgatggcgcacagaaaaccgacctatgaacgcgatgtggacctcggggccggaacaagacacgtggctgtcgagcctgaagttgccaacctggatatcattggccagcggatcgagaatattaagcatgaacacaaatccacctggcattacgacgaggataacccctataagacatgggcttaccacgggagctatgaggtgaaaccctctggatccgccagctccatggtgaatggcgtcgtgaaacttctgaccaagccttgggacgttatccccatggtgacacaaatcgctatgaccgatacgacaccttttggccagcagcgcgtcttcaaagaaaaggtggacaccagaaccccgaaagccaagcgggggacagcgcaaattatggaggttacggccaaatggctctggggatttctgagcagaaacaagaagccccggatctgtacccgcgaagagttcacaagaaaagtgcggtctaatgctgccattggcgctgtctttgtggacgaaaaccagtggaatagcgccaaggaggccgttgaggatgaacgcttctgggaccttgtgcatagagagcgggaactgcacaaacaggggaagtgcgcgacctgcgtctacaacatgatgggaaaacgcgagaagaagctcggcgaatttgggaaagctaagggctccagagccatctggtacatgtggctgggagcccggttcctggagttcgaggctctcggctttatgaatgaagatcactggttctctcgcgagaacagcctgtccggggtggaaggagagggccttcataaactggggtatattctcagagacatctctaatatccctggaggcaacatgtacgccgatgacacagctgggtgggatacccggattacagaggacgatctgcagaatgaagcccgcatcaccgacattatggagcccgaacacgcgcttctggccaagagcatctttaaactcacgtatcaaaacaaggtcgtgagagttcagcggcctaccaaaaatggcacagtgatggatgtcatttcccgcagagaccagcggggatctggccaggtggggacctacggactgaacacattcaccaacatggaggctcaactgatcagacagatggaaagcgagggcatcttttcccccagcgagctcgaaacgccgaatctggccgagcgcgtgcttgattggctggaaaagtatggggttgagcggctcaagagaatggctatttctggagacgactgtgtggtcaaacctgtggatgaccgcttcgccacagcgctgaccgcccttaacgatatgggcaaggttcggaaagacatcccccagtgggaaccttccaaggggtggaatgattggcagcaagtgcccttttgcagccatcacttccaccagctgattatgaaagacggcagagagatcgtcgtgccttgtcgcaaccaggatgagctcgtcggacgggctagagtgtctcagggcgccgggtggtccctgcgcgaaacagcttgcctgggaaagagctacgcccaaatgtggcagctcatgtattttcatcggagagacctgcgccttgctgccaatgcgatttgttccgccgttcccgtggattggatcccgacctctcggacgacctggagcattcacgctcatcaccagtggatgacaaccgaggacatgctgtccgtctggaacagagtgtggatcgaagagaatccttggatggaagataagacacatatcagctcttggggcgacgttccctacctcgggaaacgggaggaccaatggtgcggatccctgattggccttaccgccagagccacatgggctaccaacatccaggtggccattaatcaggtccgccggctgatcgggaacgagaattacctcgattatatgacgagcatgaagagattcaaaaacgaatctgaccccgagggcgcgctgtggtga

SEQ ID NO: 18870 - RNA, 9879 nt, synthetic construct
  misc_feature 1..9879: note = derived and/or modified CDS sequence (opt5) from DENV-1__FJ373297__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacgagcgccggcgttaatatgtgcacccttattgcgatggacctgggggaactctgtgaagatacaatgacctacaagtgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagagctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggcctcttcaagctggagaaggaagtggctgagacacagcacggaaccgttctggtgcagattaaatacgagggcaccgacgccccgtgcaagatccctttctccacacaagatgaaaaaggggtcacccagaacggaagacttatcacagcgaatcccattgtgacggacaaggagaaacctgtgaacatcgaagctgagccgccctttggcgagagctatattgttatcggggccggagaaaaggccctcaagctgtcttggttcaaaaagggcagctccattgggaaaatgtttgaggctaccgcccggggcgctagacgcatggccatcctgggagatacagcgtgggacttcggctctatcgggggagtctttaccagcgtgggcaagctcgtgcatcagattttcgggacagcctacggagtcctgttttccggcgtgagctggaccatgaaaatcgggattggcgttcttctgacgtggctcggactcaattctcggtccaccagcctgtctatgacatgtatcgctgtgggccttgtcaccctctacctgggggtgatggttcaggccgattccggatgcgtgattaactggaagggcagagaactgaagtgtgggagcggaatcttcgtcacaaatgaggtgcacacctggacagaacaatataaatttcaggctgactcccctaagcgcctctctgccgcgattggcaaagcctgggaggagggggtttgcggcatccggagcgctaccagactggaaaacatcatgtggcgccagatttccaacgagcttaatcatatcctgctcgaaaacgacatgaagttcacggtggtcgtgggagatgtggtcggcattctggcccaggggaaaaagatgatccggccgcaacccatggagcacaaatactcttggaaaagctggggaaaggctaagattatcggcgccgacgttcagaatacaacctttatcattgatgggcctaacacccccgaatgtcctgacgatcagagagcctggaatatctgggaggtggaggactatggattcggcatttttacaaccaacatctggctgaaacttcgcgattcctacacacaggtgtgcgaccaccggctcatgagcgctgcgattaaagattctaaggccgtccatgctgacatgggctattggatcgaatccgagaaaaatgaaacatggaagctggccagagccagcttcatcgaggtgaagacctgtatttggcccaaatctcacacactgtggtccaacggggttctcgaaagcgagatgatcattccgaagatctacggaggccctatttctcaacataattatcgccccgggtacttcacccagacagctggaccttggcacctgggcaaacttgagctggattttgacctctgcgaagggaccacggtggtcgtggatgagcactgcggaaaccggggccccagcctgagaaccacaaccgttacaggcaagatcatccatgaatggtgttgccggtcctgtaccctgcctccccttcgcttcaaaggggaggacggatgctggtacggcatggagattagaccggtgaaggaaaaggaggaaaatctcgtcaaaagcatggtgtctgccgggtccggagaggttgacagcttttccctgggcctgctctgtatctctattatgatcgaagaggtgatgcggagcagatggtcccgcaagatgctgatgacggggacacttgcggtcttctttctgctcattatgggacagctgacctggaacgatctgatccggtcttgcattatggtgggcgctaatgccagcgacagaatgggcatggggacaacctatcttgccctgatggctaccttcaaaatgcgccctatgtttgccgtgggactcctgttcagacggctcacatcccgcgaggtcctgcttctgacgatcggcctctctctggttgcgagcgtggaactgcccaactcccttgaggaactgggggatggactcgctatgggcatcatgattctgaagctcctgaccgactttcaaagctaccagctttgggccacactgctctctctgaccttcatcaaaacaaccttttccctgcactatgcctggaagacgatggctatggtgcttagcattgtctctctgctccccctgtgtctctccacaaccagccagaagaccacatggctgcctgtgcttctggggtctctgggatgcaaaccgctcaccatgttcctgatcgccgagaataagatttggggcagaaaatcctggccccttaacgaaggcatcatggctgttgggatcgtgagcattctgctctccagcctgctcaagaacgatgtccctctggccggaccccttatcgcgggcgggatgctgattgcctgttacgtgatctctggaagctccgctgacctgtctctcgagaaagccgctgaggttagctgggaagaggaagccgagcattccggcgcctctcacaatattctggtggaagtccaggatgacgggacaatgaagatcaaagatgaggagcgggacgatacgcttaccatcctgctcaaggctacactgctcgcggtgagcggagtctatcctctgtccattcccgccaccctttttgtgtggtacttctggcaaaagaaaaagcagcgctctggcgttctgtgggacacacctagccctcccgaagtggagagagctgtcctggatgacggcatctatcggattatgcagcgcgggctcctgggaagatcccaggtgggcgttggggtgttccaagaaaacgtctttcataccatgtggcacgtgacgcggggagccgtgcttatgtaccagggcaaacgcctggagcccagctgggcctctgttaagaaagacctcatctcctacgggggaggctggagactgcagggcagctggaataccggggaggaagtccaggtgattgctgtggagcccggaaagaaccctaagaatgtccaaacagcccccggcaccttcaaaacaccggaaggggaggtgggagcgatcgctctcgattttaagcctggcacctctgggtcccccattgttaaccgggaaggaaaaatcgtgggcctgtatggcaatggggtcgtgacaacgagcggaacctacgtttccgccatcgcccaggctaaggcctctcaggagggccctcttcccgagattgaagacgaggtgttcagaaaacgcaacctgacaatcatggatctgcaccccgggagcggaaagacccggagatatctccctgcgattgtccgcgaagctatcaagcggaaactgagaacccttattctggccccgacacgcgtggttgcctccgagatggctgaagccctcaagggcatgcccatccggtaccaaacgaccgctgtgaaaagcgagcatacagggagagagatcgtcgacctgatgtgccacgccacctttacaatgcgcctgctctctcctgtgcgggtgcccaattataacatgattatcatggatgaagcgcatttcaccgacccttccagcattgccgctagaggctacatctctacgcgggtcggaatgggcgaggccgctgccatttttatgacagccacaccccctgggagcgttgaggctttcccgcagtccaatgcggtgatccaggatgaggaacgcgacatccccgagagatcttggaacagcggatatgagtggattaccgattttcctggcaagacagtgtggttcgtcccctccatcaaatctgggaatgacattgccaactgtcttcggaagaatggaaagcgcgtgatccagctgagcagaaaaacctttgatacagaataccaaaagaccaaaaacaacgactgggactacgttgtgacgacagatatttccgagatgggcgctaatttccgggccgacagagtcatcgatcctcgccggtgcctgaagcccgtgattctcaaagacgggccggaaagagttatcctggccggccctatgcccgtgaccgtcgctagcgccgcgcagcgccggggaagaatcggccgcaaccacaataaggagggggatcagtatatttacatgggacagccccttaacaatgacgaggatcatgctcactggacagaagccaagatgctgctcgacaacatcaatacccctgagggcattatccccgccctgttcgaacctgagcgggaaaaatctgctgccattgatggggagtatagactgcgcggagaggcgagaaagacgtttgtggaactcatgcggcgcggcgaccttccggtctggctgtcctacaaagtggccagcgaggggttccaatattccgatagacggtggtgctttgacggcgaacgcaacaatcaggttctggaggaaaacatggatgtggagatctggaccaaggagggagaacgcaagaagctccggcccagatggctggacgctcgcacatactctgaccctcttgccctgcgggagttcaaagaatttgctgccggcagacgcagcgtgtccggggatctcatcctggagattggaaagctgccccagcacctcacccagcgggctcaaaatgcccttgacaacctggtcatgctgcataattctgaacagggcgggagagcgtatcggcacgccatggaggagctccctgatacaatcgaaaccctgatgcttctggctctcattgccgttctgacaggaggcgtgaccctgttctttctcagcggccgcgggcttggaaagacgtccatcggcctgctgtgtgtgatggctagctctgccctcctgtggatggcctccgtcgagccccattggattgctgcgagcatcatccttgagttctttctgatggtgctcctgattccggagcctgacagacagcggacaccccaggataaccaactggcctacgttgtgatcgggctccttttcatgattctgaccgtcgctgccaatgagatgggactgctcgaaaccaccaagaaggacctgggcatcgggcacgtggccgtcgagaaccaccatcacgctaccatgcttgatgtggacctgcatcctgcctctgcgtggacactctacgccgttgctacgaccattatcacacccatgatgcgccacaccattgaaaacacaaccgccaatatctccctgacggctatcgccaaccaggcggccattctgatgggactcgataaaggctggcctatcagcaagatggacattggcgtgccccttctggctctggggtgctattctcaggtcaatccgctcaccctgacagccgctgtgcttatgctggttgcccattacgctatcattggacctggcctccaagccaaagcgaccagagaggcccagaagcggacagctgccgggatcatgaagaaccccaccgtggatggaatcgtcgctattgacctggatcccgtggtgtatgacgccaaatttgaaaagcagctgggccagatcatgctccttattctgtgtacgagccaaatcctgctcatgcgcacaacctgggccctgtgcgagtccattacacttgcgaccgggcctctgaccacactctgggagggatctccgggcaaattctggaatacgaccatcgctgttagcatggccaacatctttagaggctcctacctggctggggccggactggccttcagcctcatgaagtcccttggcgggggacggcgcggcacaggggctcagggagaaaccctgggcgagaaatggaagagacagctgaatcagctctctaagagcgagttcaacacatataaacggtccggcattatggaggtcgacagatctgaagccaaggaggggctgcgccggggagagaccacgaaacacgcggtgagcagaggcacagccaaacttcgctggtttgtggaacggaatctggtcaaacccgaggggaaggttatcgatctcggatgtggcagagggggatggtcctactattgcgctggcctgaagaaagtgaccgaagtgaagggctacaccaaagggggacctggccacgaggaacccattcctatggccacatacgggtggaacctggtcaagctccattctggaaaagacgtgttctttattccccctgagaagtgtgatacccttctgtgcgacatcggcgagagctccccgaatcccacaatcgaagaggggcgcacgctgcgggttctcaaaatggtggaaccttggctgagaggaaaccaattctgtattaagatccttaatccctatatgcctagcgtcgtggagaccctggagcagatgcagcgcaagcacggcggcatgctcgttcggaaccccctgtctagaaattccacacatgaaatgtactgggtgagctgcgggaccggaaacatcgtctctgctgtgaatatgacatcccgcatgctgctcaaccggtttaccatggcccacagaaaaccgacgtatgagcgcgatgtggacctgggcgcggggaccagacacgtcgccgttgaacctgaggtggctaaccttgatattatcggacagcggattgaaaatatcaagcatgagcacaaaagcacatggcattacgacgaggataacccctataagacctgggcctaccacggctcttatgaagtgaaaccctccgggagcgcttccagcatggtcaatggagtggttaagctgctcacaaagccttgggacgtgattcccatggtcacccaaatcgccatgacagataccacgcctttcggccagcagcgcgtgtttaaagagaaggttgacacaagaaccccgaaagctaagcggggcaccgcccaaatcatggaagtgacagcgagatggctgtgggggttcctttctcggaacaaaaagccccgcatttgtacgagagaggaatttacccggaaggtccgcagcaatgccgctatcggagccgtgttcgttgacgagaaccagtggaactccgctaaagaggccgtggaagatgagagattttgggacctggtccatcgggaacgcgagctccacaagcagggcaaatgcgccacatgcgtgtacaacatgatggggaagagagagaagaagctgggagagttcggcaaggcgaaagggtctcgggctatttggtacatgtggctgggcgcccgctttctcgagttcgaagccctgggattcatgaatgaggatcactggtttagcagagaaaactccctttctggcgtcgagggggagggactgcataagctcggctatatcctgcgggacattagcaaaatccctgggggaaatatgtacgctgatgacaccgccggctgggatacacgcatcaccgaagacgatcttcagaacgaggctaagattacagacatcatggaacccgagcacgccctgctcgcgacctccattttcaaactgacgtatcaaaataaggtggttagagtgcagcggcctgcccgcaacgggaccgtcatggatgtgatctctagacgggaccagagaggcagcggacaggtgggcacatacgggctgaatacctttacaaacatggaagctcaactcattcgccagatggagtccgagggaatcttcagcccctctgaactggagaccccgaaccttgccgaacgggttctggattggctcgagaaacatggcgtggaaagactgaagcgcatggctatctccggggacgactgtgtcgtgaagcctattgatgaccggtttgccacggcgcttagcgccctgaatgatatgggaaaagttagaaaggacatcccccagtgggagccttctaaaggctggaacgattggcagcaagtgcccttctgctcccaccactttcatcagctcattatgaaggacgggcgcgagatcgtcgtgccttgtcggaatcaggatgaactggtcggcagagctcgcgtgagccagggagccggctggtccctgcgggagacagcttgcctcgggaaatcttatgcccaaatgtggcagctgatgtacttccacagacgcgaccttcggctggctgccaacgcgatttgtagcgccgttcccgtggattgggtcccgaccaatagaacaacctggtccatccatgctcaccatcagtggatgacgaccgaagacatgctcagcgtgtggaaccgggtttggattgaggaaaatccttggatggaggataagacacacatctcttcctggggagacgtgccctatctgggcaagagagaggaccaatggtgcgggagccttatcggactgaccgcccgcgccacatgggctaccaacattcaggtcgccatcaatcaggtgcggagactcattggcaacgaaaattacctggattacatgacatctatgaaacgctttaagaacgacagcgatcccgagggggcgctgtggtga

SEQ ID NO: 18871 - RNA, 9879 nt, synthetic construct
  misc_feature 1..9879: note = derived and/or modified CDS sequence (opt5) from DENV-1__FJ024448__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagatacaatcacctacaaatgccccagaattacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagatccagcgggttgaaacctgggccctgcgccaccccggcttcacagtgattgctctttttctggcccatgcgatcgggacctctatcacccagaagggaattatcttcattctcctgatgcttgtcacacctagcatggccatgagatgcgtgggcatcgggtcccgggattttgttgagggactgagcggcgctacgtgggtggacgtcgtgctcgagcacgggtcttgtgtgaccacaatggccaaggataaacccaccctggacattgaactgctcaagacagaggtcaccaaccctgctgttctgcgcaaactttgcatcgaagccaagatttccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgatcacatgcgctaagtttaagtgcgtgacgaaacttgagggaaagatcgttcagtacgaaaacctgaaatattccgtgattgtcaccgtgcacacaggcgaccagcatcaagttgggaatgagagcaccgaacacggaacaaccgccacgatcacaccccaggctcctacaaccgagattcagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaatccagacctccggaacaaccacgatttttgccggccatctcaaatgcagactgaagatggataaacttacactgcgggggatgagctatgtgatgtgtaccggctctttcaagctcgagaaagaagtcgctgagacccagcacggaacagtgctggttcagatcaagtacgagggcaccgacgccccgtgcaagatccctttctccacacaagatgaaaaaggggtgacgcagaacggaagactgattaccgcgaatcccatcgtcacagacaaggagaaacctgtgaacattgaagctgagccgccctttggcgagagctatatcgtgattggggccggagaaaaggcccttaaactctcttggttcaagaagggcagctccatcgggaaaatgtttgaggctaccgcccgcggcgctcggagaatggccatcctgggagatacagcgtgggacttcggctctattgggggagtttttaccagcgtcggcaagctggtgcatcagatcttcgggacggcctacggagtgctcttttccggcgtcagctggaccatgaaaattgggatcggcgtgctgcttacatggctgggactcaattctcgctccaccagcctgtctatgacatgtattgctgttggcctggtgaccctttacctcggggtcatggtgcaggccgattccggatgcgttatcaactggaagggccgggaactgaaatgtgggagcggaattttcgtgacaaatgaggtccacacctggacggaacaatataagtttcaggctgactcccctaagagactgtctgccgcgatcggcaaagcctgggaggagggggtgtgcggcatccgcagcgctacacggctcgaaaacattatgtggaagcagatctccaacgagctgaatcatattcttctggaaaacgacatgaaattcaccgttgtggtcggagatgtggccggcatcctcgctcaggggaagaaaatgattagaccgcaacccatggagcacaagtactcttggaaaagctggggaaaggccaagatcatcggcgccgacgtgcagaataccacatttattatcgatgggcctaacacccccgaatgtcctgacgatcagcgcgcttggaatatttgggaggtcgaggactatggattcggcatctttacgacaaacatttggctgaaactgcgggattcctacacccaggtttgcgaccacagacttatgagcgcggccatcaaggattctaaagctgtgcatgccgacatgggctattggatcgaatccgagaagaatgaaacatggaaactcgcccgcgctagcttcattgaggtgaagacctgtatctggcccaagtctcacacactgtggtccaacggggtcctggaaagcgagatgattatcccgaaaatttacggaggccctatctctcaacataattatcggcccgggtacttcacccagacggccggaccttggcacctcggcaagctggagcttgattttgacctgtgcgaagggaccacagtggttgtggatgagcactgcggaaacagaggccccagcctccggaccacaaccgtcacgggcaaaatcattcatgaatggtgttgccgctcctgtacactgcctcccctgagattcagaggggaagacggatgctggtacggcatggagatccggccggtgaaggaaaaagaggaaaatcttgttaagagcatggtgtctgcggggtccggagaggtcgacagcttttccctcggcctgctgtgtatttctatcatgattgaagaggtgatgcgcagccggtggtccagaaagatgctcatgaccgggacactggctgttttctttcttctgatcatgggacagctcacctggaacgatctgattcgcctgtgcatcatggtgggcgccaatgcctctgacagaatgggcatggggaccacatatcttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcattatgatcctgaagctcctgaccgactttcaatcccaccagctttgggccacactgctcagcctgaccttcattaaaacgacattttctctgcattacgcttggaagaccatggccatggttctttccatcgtgagcctgttccccctctgtctgtctaccacatcccagaaaaccacatggctccctgtgctgcttgggagcctgggatgcaagccgctgacgatgtttctcattgctgagaataagatctggggccgcagatcttggcccctgaacgaaggcatcatggccgtcgggattgtgtccatccttctgagctccctcctgaaaaacgatgttcctctcgcgggacccctgattgccggcgggatgcttatcgcttgttatgtgattagcggatctagcgccgacctgtccctggagaaggctgccgaggtctcttgggaagaggaagccgagcacagcggcgcttcccataatatcctcgtggaagttcaggatgacgggaccatgaaaatcaaggatgaggagcgggacgatacactgaccattcttctgaaagcgacactcctggccgcttctggagtgtaccctctcagcatccccgccaccctgttcgtctggtatttctggcaaaagaaaaagcagcgctccggcgtgctttgggacacgccttctcccccggaagtcgagagagccgtgctggatgacggcatttaccggatcatgcagcgcgggctgctcggaagaagccaggttggcgtgggggtctttcaagaaaacgtgttccacaccatgtggcacgttacacggggagctgtgctgatgtatcagggcaagagacttgagccttcctgggccagcgtcaaaaaggacctgatttcttacgggggaggctggcgcctccagggctcctggaataccggggaggaagtccaggtgatcgcggttgagcccggcaagaaccctaagaatgtccaaacagctcccggcacctttaaaacaccggaaggggaggtgggagccattgccctggatttcaagcctggcacgagcgggtctcccatcgtgaaccgggaaggaaagatcgtcggcctctacggcaatggggtggttaccacatccggaacctatgtgagcgctattgcccaggcgaaggcttcccaggagggccctctgcccgagatcgaagacgaggtctttagaaagcgcaaccttaccattatggatctgcatcccgggtctggaaaaacacggagatacctgcctgccatcgtgcgcgaagccattaagcggaaactcagaacgctgatccttgctccgacccgcgttgtggccagcgagatggctgaagccctgaagggcatgcccatccggtatcaaacaaccgcggtcaagtccgagcacacagggaaagagattgtggacctcatgtgccatgccaccttcacgatgagactgctgagccctgttcgggtgcccaattacaacatgatcattatggatgaagctcactttacagacccttcttccatcgccgctcgcggctatattagcaccagagtcggaatgggcgaggccgccgctatcttcatgaccgcgacaccccctgggtctgtggaagcctttccgcagagcaatgctgtgatccaggatgaggaacgggacattcccgagcgctcctggaactctggatacgagtggatcaccgatttccctggcaagacagtctggtttgttcccagcattaaatccgggaatgacatcgccaactgtctcagaaagaatggaaaacgggtgattcagctttctagaaagaccttcgatacggaatatcaaaagaccaagaacaacgactgggactacgtggtcaccacagatatcagcgagatgggcgccaatttccgcgctgaccgggtgattgatcctagacgctgcctgaagcccgttatcctgaaagacgggccggaacgggtgatcctcgccggccctatgcccgtcaccgtggcgtccgctgcccagagacgcggacggattggcagaaaccataataaggagggggatcagtacatctatatgggacagcccctgaacaatgacgaggatcacgcccactggacggaagctaaaatgcttctggacaacattaatacccctgagggcatcattcccgccctctttgaacctgagcgcgaaaagagcgcggccatcgatggggagtacagactgcggggagaggctcgcaagacattcgttgaactgatgagacggggcgacctcccggtgtggctttcttataaagtcgcctccgaggggtttcaatacagcgatcgcagatggtgcttcgacggcgaacggaacaatcaggtgctggaggaaaacatggatgtcgagatctggaccaaggagggagaacgcaagaaactgcgcccccggtggctcgacgctagaacatattccgaccctctggcccttcgcgagtttaaagagttcgctgccggccggagatctgtgagcggggatctgattctcgagatcggaaaactgccccagcatctgacccagcgggcgcaaaatgccctcgacaaccttgttatgctgcacaattccgaacagggcgggcgcgcttacagacatgccatggaggagctgcctgatacaattgaaaccctcatgctgcttgctctgatcgccgtgctcacgggaggcgtgacactgtttttcctgtctggccgggggctcggaaaaaccagcattggccttctgtgtgtcatggcctccagcgttctgctctggatggcttctgtggagccccactggatcgcggcctccatcattctggaatttttccttatggtgctgctcatcccggagcctgaccgccagagaacaccccaggataaccaactggcttatgtcgtgattgggctgctctttatgatccttacagttgccgccaatgagatgggactgctggaaaccacaaagaaggacctcggcattgggcacgtggctgtcgagaaccatcaccatgccgcgatgctggatgtggaccttcaccctgccagcgcttggacgctgtacgccgtcgctaccacaatcattacccccatgatgcggcatacaatcgaaaacaccacggccaatatctctctcaccgcgattgccaaccaggctgccatcctgatgggactggataaaggctggcctatttccaagatggacatcggcgtgcccctccttgctctggggtgctacagccaggttaatccgctgacactcaccgccgctgtgctgatgcttgtcgcccactatgcgattatcggacctggcctgcaagccaaagctacacgcgaggcccagaagagaaccgctgccgggatcatgaaaaaccccacggtggatggaattgttgccatcgacctcgatcccgtggtctacgacgcgaagttcgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattttggaataccacaatcgctgtgtctatggccaacattttccgcggcagctatctcgccggggctggactggccttctccctgatgaaaagcctcggcgggggaagacggggcaccggggcgcagggagaaacacttggcgagaaatggaagagacagctgaatcagctgtccaaatctgaatttaacacctacaagcgcagcggcatcatggaggtggaccggtccgaagccaaggaggggctcaaaagaggagagacgacaaagcacgctgtttctcgcggcaccgccaaactgcggtggttcgtcgaaagaaatcttgtgaagcccgaggggaaagtgattgatctgggatgtggccgcgggggatggagctattactgcgctggcctcaagaaggtcaccgaagttaaaggctatacaaaaggcgggcctgggcatgaggaacccatccctatggccacctacgggtggaacctggtgaaactgcactccggaaaggacgtgtttttcattccccctgagaaatgtgatacactcctttgcgacatcggcgagtctagcccgaatcccacgattgaagaggggcggaccctgagagtcctgaagatggtggaaccttggctccgcggaaaccaattttgtatcaaaatcctgaatccctacatgccttccgttgtggagacacttgagcagatgcagcggaagcatggcggcatgctggtcagaaaccccctcagccgcaattctacccacgaaatgtattgggtgtcctgcgggacaggaaacattgttagcgcggtgaatatgacctctcggatgctgctgaacagattcacgatggcccaccgcaagccgacctacgagagagatgtcgacctcggcgctgggacacggcatgtggccgtggaacctgaggtcgctaacctggatatcattggacagcgcatcgaaaatattaaacacgagcataagtccacctggcactatgacgaggataacccctacaaaacatgggcctatcatggcagctacgaagttaagccctctgggtccgctagctccatggtgaatggagtggtcaaacttctgaccaagccttgggacgtgatccccatggttacacaaatcgccatgaccgatacgacaccttttggccagcagagagtgttcaaggagaaagtcgacacccggaccccgaaggcgaaaagaggcacagcccaaattatggaagtgacggctaagtggctctgggggtttctgagccggaacaaaaagccccgcatctgtaccagagaggagttcacacggaaggttcgctctaatgccgctattggagccgtgtttgtcgacgagaaccagtggaatagcgccaaagaggcggtggaagatgagagattctgggaccttgttcaccgggaacgcgagctgcacaagcagggcaaatgcgctacctgcgtgtataacatgatggggaagagagagaaaaagctcggagagtttggcaaggccaaagggtcccgggccatctggtacatgtggctgggcgctcgcttcctggagttcgaagccctcggatttatgaatgaggatcattggttctctagagaaaacagcctgtccggcgtcgagggggagggacttcacaagctgggctacattctccgggacatctctaaaatccctgggggaaatatgtatgctgatgacacagccggctgggatacccgcattacagaagacgatctgcagaacgaggcgagaatcaccgacattatggaacccgagcatgcccttctggctaagagcatctttaaactcacgtaccaaaataaggtggtccgggtgcagcgccctgccaaaaacgggaccgttatggatgtgatttccagacgggaccagagaggctctggacaggtcggcacatatgggctgaataccttcacaaacatggaagctcaactgatccgccagatggagagcgagggaatcttttcccccagcgaactcgagaccccgaacctggccgaacgggtgcttgattggctggagaagtacggcgtggaaagactcaagcgcatggcgatttctggggacgactgtgttgtgaaacctatcgatgaccggttcgccacggctctgacagcccttaatgatatgggaaaggtcagaaaagacattccccagtgggagccttccaagggctggaacgattggcagcaagtgcccttttgcagccaccacttccatcagctgatcatgaaagacgggcgcgagattgttgtgccttgtcggaatcaggatgaactcgtcggcagagctcgcgtgtctcagggagccggctggtccctgcgggagaccgcttgcctgggaaagagctatgcccaaatgtggcagctcatgtactttcacagacgcgacctgcggcttgcggccaacgctatctgttccgccgtccccgtggattggattccgacatctagaaccacgtggagcatccatgcccaccatcagtggatgaccacagaagacatgctgtccgtttggaatcgggtgtggatcgaggaaaacccttggatggaggataagacccacattagctcttggggagacgtcccctatctcggcaaaagagaggaccaatggtgcgggtccctgatcggacttacagctcgcgccacctgggcgacaaatattcaggtggctatcaaccaggttcggagactgattggcaatgaaaactacctcgattacatgaccagcatgaagcgcttcaaaaatgagtctgaccccgaaggggccctgtggtga

SEQ ID NO: 18872 - RNA, 9879 nt, synthetic construct
  misc_feature 1..9879: note = derived and/or modified CDS sequence (opt5) from DENV-1__FJ182026__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacgggggaaatctctcctgtttaagaccagcgccggcgttaatatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaaaacgaaaagggggttacgcagaatggacggcttatcaccgcgaaccccattgtgacagataaagagaagcctgtcaatatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagacacagcgtgggatttcggctctatcgggggagtgtttaccagcgttggcaaactcgtccatcagattttcgggacggcctacggagtgctgttttccggcgtgagctggaccatgaagatcgggattggcgtccttctgacatggctcggactgaactctagatccaccagcctgtctatgacatgtatcgctgtgggccttgttaccctctacctgggggtgatggtccaggccgactccggatgcgtgattaattggaaaggccgcgaactgaagtgtgggagcggaatcttcgttacaaacgaggtgcacacctggacggaacaatataagtttcaggctgattcccctaaacggctctctgccgcgattggcaaggcctgggaggagggggtctgcggcatcagaagcgctacacgcctggaaaacatcatgtggaaacagatttccaatgagcttaaccatatcctgctcgaaaatgacatgaagttcaccgtggttgtgggagacgtcgccggcattctggctcaggggaaaaagatgatccggccgcaacccatggagtacaaatattcttggaaaagctggggaaaggccaagattatcggcgccgatgtgcagaacaccacatttatcattgacgggcctaatacccccgaatgtcctgatgaccagagagcttggaacatctgggaggtggaggattacggattcggcatttttacgacaaatatctggctgaaacttcgcgactcctatacccaggtctgcgatcaccggctcatgagcgcggccattaaagactctaaggctgttcacgccgatatgggctactggatcgaatccgagaaaaacgaaacatggaagctggccagagctagcttcatcgaggtgaagacctgtatttggcccaaatctcatacactgtggtccaatggggtgctcgaaagcgagatgatcattccgaagatctatggaggccctatttctcaacacaactaccgccccgggtacttcacccagacggccggaccttggcatctgggcaaacttgagctggactttgatctctgcgaagggaccacagtcgtggttgacgagcactgcggaaatcggggccccagcctgagaaccacaaccgtgacgggcaagatcatccacgaatggtgttgccggtcctgtacactgcctccccttcgcttcagaggggaggatggatgctggtatggcatggagattcggccggtcaaagaaaaggaggaaaacctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaatgacctgatcagactttgcattatggttggcgccaacgcctctgatcgcatgggcatggggaccacatacctggctctcatggccacgttcaagatgagacctatgtttgcggtgggactcctgttccggcgcctgaccagcagagaggtccttctgctcacaatcggcctgtccctggtggcttctgtggaacttcccaatagcctggaggaactcggggacggactggccatgggcatcatgattctcaaactgcttaccgattttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaacaaaatttggggccggcgctcttggccccttaacgaaggcatcatggccgtggggatcgtctccattctgctcagctccctgctcaagaatgacgtgcctctggcgggaccccttatcgccggcgggatgctgattgcttgttacgttatcagcggatctagcgccgatctgtccctcgagaaagctgccgaggtgtcttgggaagaggaagccgagcatagcggcgcttcccacaacattctggtcgaagtgcaggacgatgggaccatgaagatcaaagacgaggagagagatgacacacttaccatcctgctcaaggcgacactgctcgccgtttctggagtgtatcctctgagcattcccgctacccttttcgtctggtacttctggcagaagaagaagcagcggtccggcgtgctgtgggatacgccttctcccccggaagtcgagcgcgccgtgctggacgatggcatctatagaattatgcagcgggggctcctgggacgcagccaggttggcgtgggggtctttcaagaaaatgtgttccataccatgtggcacgttacaagaggagccgtgcttatgtaccagggcaaacggctggagccttcctgggctagcgtcaagaaagacctcatctcttacgggggaggctggagactgcagggctcctggaacgccggggaggaagtccaggtgattgcggttgagcccggaaagaatcctaaaaacgtccaaaccgctcccggcacatttaagaccccggaaggggaggtgggagccatcgccctcgacttcaagcctggcacaagcgggtctcccattgtgaatcgcgaaggaaaaatcgtcggcctgtatggcaacggggtggttacgacctccggaacatacgtgagcgctatcgcccaggcgaaggcttcccaggagggccctcttcccgagattgaagatgaggtctttcggaaaagaaatctgaccatcatggacctgcaccccgggtctggaaagacccgccggtatctccctgccattgtgagagaagccatcaaacgcaagctgcggacacttattctggctccgacgagagttgtggccagcgagatggctgaagccctcaagggcatgcccatccgctaccaaaccacagcggtcaaatccgagcataccgggaaggagatcgtggatctgatgtgccacgccacattcaccatgcggctgctcagccctgttagagtgcccaactataatatgattatcatggacgaagctcattttacggatccttcttccattgccgctcggggctacatcagcacacgcgtcggaatgggcgaggccgccgctattttcatgaccgcgacaccccctgggtctgtggaagcctttccgcagagcaacgctgtgatccaggacgaggaaagagatatccccgagcggtcctggaactctggatatgagtggattacagacttccctggcaaaaccgtctggtttgttcccagcatcaagtccgggaacgatattgccaattgtcttcgcaaaaacggaaagagagtgatccagctgtctcggaagacattcgacaccgaataccagaagacgaagaacaatgattgggactacgtggtcacaaccgacattagcgagatgggcgccaacttcagagctgatcgcgtgatcgaccctcggagatgcctgaaacccgttattctcaaggatgggccggaacgcgtgatcctggccggccctatgcccgtcacagtggcgtccgctgcccagcggagaggacgcatcggccggaatcacaacaaagagggggaccagtatatttacatgggacagccccttaataacgatgaggaccatgcccactggaccgaagctaagatgctgctcgataatatcaacacgcctgagggcattatccccgccctgtttgaacctgagagagaaaagagcgcggccattgacggggagtatcgcctgagaggagaggctcggaaaaccttcgttgaactcatgcgcagaggcgatcttccggtgtggctgtcttacaaggtcgcctccgaggggtttcaatatagcgaccggcgctggtgcttcgatggcgaaagaaataaccaggtgctggaggaaaatatggacgtcgagatctggacaaaagagggagaacggaagaaactcagaccccgctggctggatgctcggacctactccgaccctcttgccctgagagagtttaaggagttcgctgccggccgccggtctgtgagcggggacctcatcctggagattggaaaactgccccagcacctcacacagagagcgcaaaacgcccttgataatctggttatgctgcataactccgaacagggcgggcgggcttatcgccacgccatggaggagctccctgacaccatcgaaacactgatgcttctggctctcattgccgtgctgaccggaggcgtgacgctgtttttcctctctggcagagggcttggaaagacaagcatcggcctgctgtgtgtcatggcctccagcgttctcctgtggatggcttctgtggagccccattggattgcggcctccatcatccttgaatttttcctgatggtgctcctgattccggagcctgatcggcagcgcacaccccaggacaatcaactggcttacgtcgtgatcgggctcctttttatgattctgaccgttgccgccaacgagatgggactgctcgaaacaaccaagaaagatctgggcatcgggcacgtggctgtcgagaaccaccatcacgccgcgatgcttgacgtggatctgcatcctgccagcgcttggacactctacgccgtcgctacgaccattatcacacccatgatgagacacaccattgaaaatacaaccgccaacatctctctgacggcgatcgccaatcaggctgccattctgatgggactcgacaagggctggcctatctccaaaatggatattggcgtgccccttctggctctggggtgctatagccaggttaacccgctcaccctgacagccgctgtgcttatgctggtcgcccattacgcgatcattggacctggcctccaagccaaggctacccgggaggcccagaaacgcacagctgccgggatcatgaagaatcccaccgtggacggaatcgttgccattgatctggaccccgtggtctatgatgcgaagttcgaaaaacagctgggccagatcatgctccttattctgtgtacgtctcaaatcctgctcatgagaacaacctgggctctgtgcgagagcattacacttgccaccgggcctctgaccacactctgggagggatccccgggcaagttttggaacacgaccatcgctgtgtctatggccaatatcttccggggcagctacctggccggggctggactggccttctccctcatgaaaagccttggcgggggacgcagaggcacaggggcgcagggagaaaccctgggcgagaagtggaaacggcagctgaaccagctctccaagtctgaatttaatacatataagagaagcggcattatggaggtggaccgctccgaagccaaagaggggctgaagcggggagagaccacgaaacacgctgtttctagaggcacagccaaacttcgctggttcgtcgaacggaacctggtgaaacccgaggggaaggtgatcgacctcggatgtggcagagggggatggagctactattgcgctggcctgaagaaagtcaccgaagttaagggctacaccaaagggggacctggccacgaggaacccattcctatggccacatacgggtggaatctggtgaagctccattccggaaaagatgtgtttttcattccccctgagaagtgtgacacccttctgtgcgatatcggcgagtctagcccgaaccccacaatcgaagaggggcgcacgctgcgggtcctcaaaatggtggaaccttggctgagaggaaatcaattttgtattaagatccttaacccctatatgccttccgttgtggagaccctggagcagatgcagcgcaagcacggcggcatgctcgtccggaatcccctgagcagaaactctacacatgaaatgtactgggtgtcctgcgggaccggaaatatcgttagcgcggtgaacatgacatctcgcatgctgctcaaccggttcaccatggcccacagaaaaccgacgtatgagcgcgacgtcgatctgggcgctgggaccagacacgtggccgtggaacctgaggtcgctaatcttgacattatcggacagcggattgaaaacatcaagcatgagcacaaatccacatggcattacgatgaggacaatccctataagacctgggcctaccacggcagctatgaagttaaaccctctgggtccgctagctccatggtgaacggagtggtcaagctgctcacaaagccttgggatgtgattcccatggttacccaaatcgccatgacagacaccacgccttttggccagcagcgcgtgttcaaagagaaggtcgatacaagaaccccgaaagcgaagcggggcaccgcccaaatcatggaagtgacagctaaatggctgtgggggtttcttagcagaaataagaagccccggatttgtacgcgcgaggagttcaccagaaaagttcggtctaacgccgctatcggagccgtgtttgtcgacgagaatcagtggaacagcgccaaggaggcggtggaagacgagcgcttctgggatctggttcatagagaacgggagctccacaaacagggcaagtgcgctacatgcgtgtacaatatgatggggaaacgcgaaaagaagctgggagagtttggcaaagccaaggggtccagagccatttggtacatgtggctgggcgctcggttcctcgagttcgaagccctgggatttatgaacgaggaccactggttctctcgcgaaaatagcctttccggcgtcgagggggagggactgcataaactcggctatatcctgagagatatttctaagatccctgggggaaacatgtacgctgacgataccgccggctgggacacacggatcaccgaagatgaccttcagaatgaggcgcgcattacagatatcatggaacccgagcacgccctgctcgctaaaagcatttttaagctgacctatcaaaacaaagtggtcagagtgcagcggcctgccaagaatgggacggttatggacgtgatctcccgcagagatcagcggggctctggacaggtcggcacctacgggctgaacacattcaccaacatggaagctcaactcattagacagatggagagcgagggaatcttttcccccagcgaactggagacaccgaatcttgccgaacgcgtgctggactggctcgagaagtatggcgtggaacggctgaaaagaatggcgatctctggggatgactgtgttgtgaagcctattgacgatcgcttcgccaccgctcttacggccctgaacgacatgggaaaagtccggaaggatatcccccagtgggagccttccaaaggctggaatgactggcagcaagtgcccttttgcagccatcacttccaccagctcattatgaaggatgggagagagatcgttgtgccttgtcgcaaccaggacgaactggtcggccgggctagagtgtctcagggagccggctggtccctgcgcgagacagcttgcctcggaaagagctacgcccaaatgtggcagctgatgtattttcatcggagagatcttcgcctggcggccaatgctatttgttccgccgtccccgtggactggatcccgacctctcggacaacctggagcattcacgcccatcaccagtggatgacgaccgaagatatgctctccgtttggaacagagtgtggatcgaggaaaatccttggatggaggacaaaacacatatcagctcttggggagatgtcccctacctgggcaagcgggaggaccaatggtgcgggtcccttattggactgaccgctagagccacatgggcgaccaacatccaggtggctattaatcaggttcgccggctcatcggcaacgaaaattacctggactatatgacaagcatgaaaagattcaagaacgagtctgatcccgaaggggccctgtggtga

SEQ ID NO: 18873 - RNA, 9879 nt, synthetic construct
  misc_feature 1..9879: note = derived and/or modified CDS sequence (opt5) from DENV-1__FJ182027__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagctctgtgaagatacaatcacctacaaatgcccccgcattacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagatccagcgggttgaaacctgggccctgcgccaccccggcttcacagtgattgctctttttctggcccatgcgatcgggacctctatcacccagaagggaattatcttcattctcctgatgcttgtcacacctagcatggccatgagatgcgtgggcatcgggtcccgggattttgttgagggactgagcggcgctacgtgggtggacgtcgtgctcgagcacgggtcttgtgtgaccacaatggccaaggataaacccaccctggacattgaactgctcaagacagaggtcaccaaccctgctgttctgcgcaaactttgcatcgaagccaagatttccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgatcacatgcgctaagtttaagtgcgtgacgaaacttgagggaaagatcgttcagtacgaaaacctgaaatattccgtgattgtcaccgtgcacacaggcgaccagcatcaagttgggaatgagagcaccgaacacggaacaaccgccacgatcacaccccaggctcctacaaccgagattcagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaatccagacctccggaacaaccacgatttttgccggccatctcaaatgcagactgaagatggataaacttacactgcgggggatgagctatgtgatgtgtaccggctctttcaagctcgagaaagaagtcgctgagacccagcacggaacagtgctggttcagatcaagtacgagggcaccgacgccccgtgcaagatccctttctccacacaagatgaaaaaggggtgacgcagaacggaagactgattaccgcgaatcccatcgtcacagacaaggagaaacctgtgaacattgaagctgagccgccctttggcgagagctatatcgtgattggggccggagaaaaggcccttaaactctcttggttcaagaagggcagctccatcgggaaaatgtttgaggctaccgcccgcggcgctcggagaatggccatcctgggagatacagcgtgggacttcggctctattgggggagtttttaccagcgtcggcaagctggtgcatcagatcttcgggacggcctacggagtgctcttttccggcgtcagctggaccatgaaaattgggatcggcgtgctgcttacatggctgggactcaattctcgctccaccagcctgtctatgacatgtattgctgttggcctggtgaccctttacctcggggtcatggtgcaggccgattccggatgcgttatcaactggaagggccgggaactgaaatgtgggagcggaattttcgtgacaaatgaggtccacacctggacggaacaatataagtttcaggctgactcccctaagagactgtctgccgcgatcggcaaagcctgggaggagggggtgtgcggcatccgcagcgctacacggctcgaaaacattatgtggaagcagatctccaacgagctgaatcatattcttctggaaaacgacatgaaattcaccgttgtggtcggagatgtggccggcatcctcgctcaggggaagaaaatgattagaccgcaacccatggagcacaagtactcttggaaaagctggggaaaggccaagatcatcggcgccgacgtgcagaataccacatttattatcgatgggcctaacacccccgaatgtcctgacgatcagcgcgcttggaatatttgggaggtcgaggactatggattcggcatctttacgacaaacatttggctgaaactgcgggattcctacacccaggtttgcgaccacagacttatgagcgcggccatcaaggattctaaagctgtgcatgccgacatgggctattggatcgaatccgagaagaatgaaacatggaaactcgcccgcgctagcttcattgaggtgaagacctgtatctggcccaagtctcacacactgtggtccaacggggtcctggaaagcgagatgattatcccgaaaatttacggaggccctatctctcaacataattatcggcccgggtacttcacccagacggccggaccttggcacctcggcaagctggagcttgattttgacctgtgcgaagggaccacagtggttgtggatgagcactgcggaaacagaggccccagcctccggaccacaaccgtcacgggcaaaatcattcatgaatggtgttgccgctcctgtacactgcctcccctgagattcagaggggaagacggatgctggtacggcatggagatccggccggtgaaggaaaaagaggaaaatcttgttaagagcatggtgtctgcggggtccggagaggtcgacagcttttccctcggcctgctgtgtatttctatcatgattgaagaggtgatgcgcagccggtggtccagaaagatgctcatgaccgggacactggctgttttctttcttctgatcatgggacagctcacctggaacgatctgattcgcctgtgcatcatggtgggcgccaatgcctctgacagaatgggcatggggaccacatatcttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcattatgatcctgaagctcctgaccgactttcaatcccaccagctttgggccacactgctcagcctgaccttcattaaaacgacattttctctgcattacgcttggaagaccatggccatggttctttccatcgtgagcctgttccccctctgtctgtctaccacatcccagaaaaccacatggctccctgtgctgcttgggagcctgggatgcaagccgctgacgatgtttctcattgctgagaataagatctggggccgcagatcttggcccctgaacgaaggcatcatggccgtcgggattgtgtccatccttctgagctccctcctgaaaaacgatgttcctctcgcgggacccctgattgccggcgggatgcttatcgcttgttatgtgattagcggatctagcgccgacctgtccctggagaaggctgccgaggtctcttgggaagaggaagccgagcacagcggcgcttcccataatatcctcgtggaagttcaggatgacgggaccatgaaaatcaaggatgaggagcgggacgatacactgaccattcttctgaaagcgacactcctggccgtgtctggagtctaccctctcagcatccccgctaccctgttcgtgtggtatttctggcaaaagaaaaagcagcgctccggcgtcctttgggacacgccttctcccccggaagtggagagagccgttctggatgacggcatttaccggatcatgcagcgcgggctgctcggaagaagccaggtgggcgtcggggtgtttcaagaaaacgttttccacaccatgtggcacgtgacacggggagccgtcctgatgtatcagggcaagagacttgagccttcctgggctagcgtgaaaaaggacctgatttcttacgggggaggctggcgcctccagggctcctggaataccggggaggaagtgcaggttatcgccgtcgagcccggcaagaaccctaagaatgtgcaaacagcgcccggcacctttaaaacaccggaaggggaggtgggagctattgccctggatttcaagcctggcacgagcgggtctcccatcgtcaaccgggaaggaaagatcgtgggcctctacggcaatggggttgtgaccacatccggaacctatgtcagcgccattgctcaggccaaagcgtcccaggagggccctctgcccgagatcgaagacgaggtgtttagaaagcgcaaccttaccattatggatctgcatcccgggtctggaaaaacacggagatacctgcctgctatcgttcgcgaagccattaagcggaaactcagaacgctgatccttgccccgacccgcgtggtcgctagcgagatggccgaagctctgaagggcatgcccatccggtatcaaacaaccgccgtgaagtccgagcacacagggaaagagattgttgacctcatgtgccatgcgaccttcacgatgagactgctgagccctgtgcgggtccccaattacaacatgatcattatggatgaagcccactttacagacccttcttccatcgctgcccgcggctatattagcaccagagtgggaatgggcgaggctgccgccatcttcatgaccgctacaccccctgggtctgtggaagcgtttccgcagagcaatgccgtcatccaggatgaggaacgggacattcccgagcgctcctggaactctggatacgagtggatcaccgatttccctggcaagacagtttggtttgtgcccagcattaaatccgggaatgacatcgctaactgtctcagaaagaatggaaaacgggtgattcagctttctagaaagaccttcgatacggaatatcaaaagaccaagaacaacgactgggactacgtcgtgaccacagatatcagcgagatgggcgccaatttccgcgccgaccgggttattgatcctagacgctgcctgaagcccgtgatcctgaaagacgggccggaacgggtcatcctcgctggccctatgcccgtgaccgttgcctccgcggctcagagacgcggacggattggcagaaaccataataaggagggggatcagtacatctatatgggacagcccctgaacaatgacgaggatcacgcccactggacggaagccaaaatgcttctggacaacattaatacccctgagggcatcattcccgctctctttgaacctgagcgcgaaaagagcgccgcgatcgatggggagtacagactgcggggagaggcccgcaagacattcgtggaactgatgagacggggcgacctcccggtctggctttcttataaagtggcttccgaggggtttcaatacagcgatcgcagatggtgcttcgacggcgaacggaacaatcaggtcctggaggaaaacatggatgtggagatctggaccaaggagggagaacgcaaaaagctgcgcccccggtggctcgacgccagaacatattccgaccctctggctcttagagagtttaaagagttcgccgctggccggagatctgttagcggggatctgattctcgagatcggaaagctgccccagcatctgacccagcgggcccaaaatgcgctcgacaaccttgtgatgctgcacaattccgaacagggcgggcgcgcctacagacatgctatggaggagctgcctgatacaattgaaaccctcatgctgcttgccctgatcgctgtgctcacgggaggcgtcacactgtttttcctgtctggccgggggctcggaaaaaccagcattggccttctgtgtgttatggcctccagcgtgctgctctggatggcctctgtggagccccactggatcgctgcgtccatcattctggaatttttccttatggtcctgctcatcccggagcctgaccgccagagaacaccccaggataaccaactggcctatgtggttattgggctgctctttatgatccttacagtggctgccaatgagatgggactgctggaaaccacaaagaaggacctcggcattgggcacgtcgccgtggagaaccatcaccatgctgccatgctggatgtcgaccttcaccctgcgagcgcctggacgctgtacgctgtggccaccacaatcattacccccatgatgcggcatacaatcgaaaacaccacggctaatatctctctcaccgccattgcgaaccaggccgctatcctgatgggactggataaaggctggcctatttccaagatggacatcggcgttcccctccttgccctggggtgctacagccaggtgaatccgctgacactcaccgctgccgtcctgatgcttgtggctcactatgccattatcggacctggcctgcaagcgaaagccacacgcgaggctcagaagagaaccgccgctgggatcatgaaaaaccccacggttgatggaattgtggccatcgacctcgatcccgtcgtgtacgacgccaagttcgaaaagcagctgggccagattatgctgctcatcctttgtacatctcaaattctgctgatgcggaccacatgggcgctctgcgagagcatcaccctggctaccgggcctcttacaacgctgtgggagggatccccgggcaaattttggaataccacaatcgccgtgtctatggctaacattttccgcggcagctatctcgccggggccggactggctttctccctgatgaaaagcctcggcgggggaagacggggcaccggggcccagggagaaacacttggcgagaaatggaagagacagctgaatcagctgtccaaatctgaatttaacacctacaagcgcagcggcatcatggaggttgaccggtccgaagcgaaggaggggctcaaaagaggagagacgacaaagcacgccgtctctcgcggcaccgctaaactgcggtggttcgtggaaagaaatcttgtgaagcccgaggggaaagtcattgatctgggatgtggccgcgggggatggagctattactgcgccggcctcaagaaggttaccgaagtgaaaggctatacaaaaggcgggcctgggcatgaggaacccatccctatggctacctacgggtggaacctggtgaaactgcactccggaaaggacgtctttttcattccccctgagaaatgtgatacactcctttgcgacatcggcgagtctagcccgaatcccacgattgaagaggggcggaccctgagagtgctgaagatggttgaaccttggctccgcggaaaccaattttgtatcaaaatcctgaatccctacatgccttccgtggtcgagacacttgagcagatgcagcggaagcatggcggcatgctggtgagaaaccccctcagccgcaattctacccacgaaatgtattgggtttcctgcgggacaggaaacattgtgagcgccgtcaatatgacctctcggatgctgctgaacagattcacgatggcgcaccgcaagccgacctacgagagagatgtggacctcggcgccgggacacggcatgtggctgtcgaacctgaggttgccaacctggatatcattggacagcgcatcgaaaatattaaacacgagcataagtccacctggcactatgacgaggataacccctacaaaacatgggcttatcatggcagctacgaagtgaagccctctgggtccgccagctccatggtgaatggagtcgtgaaacttctgaccaagccttgggacgttatccccatggtgacacaaatcgctatgaccgatacgacaccttttggccagcagagagtcttcaaggagaaagtggacacccggaccccgaaggccaaaagaggcacagcgcaaattatggaagttacggccaagtggctctgggggtttctgagccggaacaaaaagccccgcatctgtaccagagaggagttcacacggaaggtgcgctctaatgctgccattggagctgtctttgtggacgagaaccagtggaatagcgccaaagaggccgttgaagatgagagattctgggaccttgtgcaccgggaacgcgagctgcacaagcagggcaaatgcgcgacctgcgtctataacatgatggggaagagagagaaaaagctcggagagtttggcaaggctaaagggtcccgggccatctggtacatgtggctgggcgcccgcttcctggagttcgaagctctcggatttatgaatgaggatcattggttctctagagaaaacagcctgtccggcgtggagggggagggacttcacaagctgggctacattctccgggacatctctaaaatccctgggggaaatatgtatgccgatgacacagctggctgggatacccgcattacagaagacgatctgcagaacgaggccagaatcaccgacattatggaacccgagcatgcgcttctggccaagagcatctttaaactcacgtaccaaaataaggtcgtgcgggttcagcgccctgctaaaaacgggaccgtgatggatgtcatttccagacgggaccagagaggctctggacaggtgggcacatatgggctgaataccttcacaaacatggaagcccaactgatccgccagatggagagcgagggaatcttttcccccagcgaactcgagaccccgaacctggctgaacgggtgcttgattggctggagaagtacggcgttgaaagactcaagcgcatggccatttctggggacgactgtgtggtcaaacctatcgatgaccggttcgcgacggccctgacagctcttaatgatatgggaaaggtgagaaaagacattccccagtgggagccttccaagggctggaacgattggcagcaagttcccttttgcagccaccacttccatcagctgatcatgaaagacgggcgcgagattgtggtcccttgtcggaatcaggatgaactcgtgggcagagcccgcgtctctcagggagctggctggtccctgcgggagaccgcctgcctgggaaagagctatgctcaaatgtggcagctcatgtactttcacagacgcgacctgcggcttgccgcgaacgccatctgttccgctgtgcccgttgattggattccgacatctagaaccacgtggagcatccatgcccaccatcagtggatgaccacagaagacatgctgtccgtgtggaatcgggtctggatcgaggaaaacccttggatggaggataagacccacattagctcttggggagacgtgccctatctcggcaaaagagaggaccaatggtgcgggtccctgatcggacttacagcccgcgctacctgggccacaaatattcaggttgcgatcaaccaggtgcggagactgattggcaatgaaaactacctcgattacatgaccagcatgaagcgcttcaaaaatgagtctgaccccgaaggggctctgtggtga

SEQ ID NO: 18874 - RNA, 9879 nt, synthetic construct
  misc_feature 1..9879: note = derived and/or modified CDS sequence (opt5) from DENV-1__FJ024449__SS-prME
  source 1..9879: mol_type = other RNA
agcgtgaccatgctgctcatgctgatgcccacagcccttgctttccacctgacgaccagaggcggggagcctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattatcattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcccacacccaggtctgcgaccaccggcttatgagcgcggccatcaaagattctaaggctgttcatgccgacatgggctattggatcgaatccgagaaaaatgaaacatggaagctcgccagagctagcttcattgaggtgaagacctgtatctggcccaaatctcacacactgtggtccaacggggtgctggaaagcgagatgattatcccgaagatttacggaggccctatctctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcattcatgaatggtgttgccggtcctgtacactgcctcccctgcgcttcagaggggaggacggatgctggtacggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttctttcttctgatcatgggacagctcacctggaacgatctgattagactgtgcatcatggttggcgccaatgcctctgaccgcatgggcatggggaccacatatcttgctctgatggccacgttcaagatgagacctatgtttgcggtgggactcctgttccggcgcctcaccagcagagaggtcctgcttctgacaatcggcctctccctggtggcttctgtggaactgcccaacagccttgaggaactgggggatggactcgccatgggcattatgatcctgaaactcctgaccgactttcaatcccaccagctttgggccacactgctcagcctgaccttcattaagacgacattttctctgcattacgcttggaaaaccatggccatggtcctttccatcgttagcctgttccccctctgtctgtctaccacatcccagaagaccacatggctccctgtgctgcttgggagcctgggatgcaagccgctgacgatgtttctcattgctgagaataaaatctggggccggcgctcttggcccctgaacgaaggcatcatggccgtggggattgtctccatccttctgagctccctcctgaagaacgatgtgcctctcgcgggacccctgattgccggcgggatgcttatcgcttgttatgttattagcggatctagcgccgacctgtccctggagaaagctgccgaggtgtcttgggaagaggaagccgagcacagcggcgcttcccataatatcctcgtcgaagtgcaggatgacgggaccatgaagatcaaagatgaggagagagacgatacactgaccattcttctgaaggcgacactcctggccgtttctggagtgtaccctctcagcatccccgctaccctgttcgtctggtatttctggcagaagaagaagcagcggtccggcgtgctttgggacacgccttctcccccggaagtcgagcgcgccgtgctggatgacggcatttacagaatcatgcagcgggggctgctcggacgcagccaggttggcgtgggggtctttcaagaaaacgtgttccacaccatgtggcacgttacaagaggagccgtgctgatgtatcagggcaaacggcttgagccttcctgggctagcgtcaagaaagacctgatttcttacgggggaggctggagactccagggctcctggaataccggggaggaagtccaggtgatcgccgttgagcccggaaagaaccctaaaaatgtccaaacagcgcccggcacctttaagacaccggaaggggaggtgggagctattgccctggatttcaagcctggcacgagcgggtctcccatcgtgaaccgcgaaggaaaaatcgtcggcctctacggcaatggggtggttaccacatccggaacctatgtgagcgccattgctcaggccaaggcgtcccaggagggccctctgcccgagatcgaagacgaggtctttcggaaaagaaaccttaccattatggatctgcatcccgggtctggaaagacacgccggtacctgcctgctatcgtgagagaagccattaaacgcaagctccggacgctgatccttgccccgaccagagttgtggctagcgagatggccgaagctctgaagggcatgcccatccgctatcaaacaaccgccgtcaaatccgagcacacagggaaggagattgtggacctcatgtgccatgcgaccttcacgatgcggctgctgagccctgttagagtgcccaattacaacatgatcattatggatgaagcccactttacagacccttcttccatcgctgcccggggctatattagcacccgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcaccgatttccctggcaaaacagtctggtttgttcccagcattaagtccgggaatgacatcgctaactgtctccgcaaaaatggaaagagagtgattcagctttctcggaagaccttcgatacggaatatcagaaaaccaagaacaacgactgggactacgtggtcaccacagatatcagcgagatgggcgccaatttcagagccgaccgcgtgattgatcctcggagatgcctgaaacccgttatcctgaaggacgggccggaacgcgtgatcctcgctggccctatgcccgtcaccgtggcctccgcggctcagcggagaggacgcattggccggaaccataataaagagggggatcagtacatctatatgggacagcccctgaacaatgacgaggatcacgcccactggacggaagccaagatgcttctggacaacattaatacccctgagggcatcattcccgctctctttgaacctgagagagaaaagagcgccgcgatcgatggggagtaccgcctgagaggagaggcccggaaaacattcgttgaactgatgcgcagaggcgacctcccggtgtggctttcttataaggtcgcttccgaggggtttcaatacagcgatcggcgctggtgcttcgacggcgaaagaaacaatcaggtgctggaggaaaacatggatgtcgagatctggaccaaagagggagaacggaagaaactgagaccccgctggctcgacgcccggacatattccgaccctctggctcttagagagtttaaggagttcgccgctggccgccggtctgtgagcggggatctgattctcgagatcggaaaactgccccagcatctgacccagagagcccaaaatgcgctcgacaaccttgttatgctgcacaattccgaacagggcgggcgggcctaccgccatgctatggaggagctgcctgatacaattgaaaccctcatgctgcttgccctgatcgctgtgctcacgggaggcgtgacactgtttttcctgtctggcagagggctcggaaagaccagcattggccttctgtgtgtcatggcctccagcgttctgctctggatggcctctgtggagccccactggatcgctgcgtccatcattctggaatttttccttatggtgctgctcatcccggagcctgaccggcagcgcacaccccaggataaccaactggcctatgtcgtgattgggctgctctttatgatccttacagttgctgccaatgagatgggactgctggaaaccacaaagaaagacctcggcattgggcacgtggccgtcgagaaccatcaccatgctgccatgctggatgtggaccttcaccctgcgagcgcctggacgctgtacgctgtcgccaccacaatcattacccccatgatgagacatacaatcgaaaacaccacggctaatatctctctcaccgccattgcgaaccaggccgctatcctgatgggactggataagggctggcctatttccaaaatggacatcggcgtgcccctccttgccctggggtgctacagccaggttaatccgctgacactcaccgctgccgtgctgatgcttgtcgctcactatgccattatcggacctggcctgcaagcgaaggccacacgggaggctcagaaacgcaccgccgctgggatcatgaagaaccccacggtggatggaattgttgccatcgacctcgatcccgtggtctacgacgccaagttcgaaaaacagctgggccagattatgctgctcatcctttgtacatctcaaattctgctgatgagaaccacatgggcgctctgcgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggtggaccgctccgaagcgaaagaggggctcaagcggggagagacgacaaaacacgccgtttctagaggcaccgctaagctgcgctggttcgtcgaacggaatcttgtgaaacccgaggggaaggtgattgatctgggatgtggcagagggggatggagctattactgcgccggcctcaagaaagtcaccgaagttaagggctatacaaaagggggacctggccatgaggaacccatccctatggctacctacgggtggaacctggtgaagctgcactccggaaaagacgtgtttttcattccccctgagaagtgtgatacactcctttgcgacatcggcgagtctagcccgaatcccacgattgaagaggggcgcaccctgcgggtcctgaaaatggtggaaccttggctcagaggaaaccaattttgtatcaagatcctgaatccctacatgccttccgttgtggagacacttgagcagatgcagcgcaagcatggcggcatgctggtccggaaccccctcagcagaaattctacccacgaaatgtattgggtgtcctgcgggacaggaaacattgttagcgccgtgaatatgacctctcgcatgctgctgaaccggttcacgatggcgcacagaaaaccgacctacgagcgcgatgtcgacctcggcgccgggacaagacatgtggctgtggaacctgaggtcgccaacctggatatcattggacagcggatcgaaaatattaagcacgagcataaatccacctggcactatgacgaggataacccctacaagacatgggcttatcatggcagctacgacgttaaaccctctgggtccgccagctccatggtgaatggagtggtcaaacttctgaccaagccttgggatgtgatccccatggttacacaaatcgctatgaccgacacgacaccttttggccagcagcgcgtgttcaaagaaaaggtcgacaccagaaccccgaaagccaagcggggcacagcgcaaattatggaggtgacggccaaatggctctgggggtttctgagcagaaacaagaagccccggatctgtacccgcgaagagttcacaagaaaagttcggtctaatgctgccattggagctgtgtttgtcgatgaaaaccagtggaatagcgccaaggaggccgtggaggacgaacgcttctgggatcttgttcacagagagcgggaactgcacaaacagggcaagtgcgcgacctgcgtgtataacatgatggggaaacgcgagaagaagctcggagaatttggcaaagctaaggggtccagagccatctggtacatgtggctgggcgcccggttcctggagttcgaggctctcggatttatgaatgaagaccattggttctctcgcgagaacagcctgtccggcgtcgaaggggagggacttcacaaactgggctacattctcagagatatctctaagatccctgggggaaatatgtatgccgacgatacagctggctgggacacccggattacagaggatgacctgcagaacgaagcccgcatcaccgatattatggagcccgaacatgcgcttctggccaaaagcatctttaagctcacgtaccaaaataaagtggtcagagtgcagcggcctgctaagaacgggaccgttatggacgtgatttcccgcagagatcagcggggctctggacaggtcggcacatatgggctgaataccttcacaaacatggaggcccaactgatcagacagatggaaagcgagggaatcttttcccccagcgagctcgaaaccccgaacctggctgagcgcgtgcttgactggctgaagaaatacggcgtggaacggctcaagagaatggccatttctggggacgattgtgttgtgaaacctatcgacgatcgcttcgcgacggccctgacagctcttaatgacatgggaaaggtccggaaagatattccccagtgggagccttccaagggctggaacgactggcagcaagtgcccttttgcagccaccacttccatcagctgatcatgaaggatgggagagaaattgttgtgccttgtcgcaatcaggacgagctcgtcggccgggccagagtgtctcagggagctggctggtccctgcgcgagaccgcctgcctggggaaaagctatgctcaaatgtggcagctcatgtactttcaccggagagatctgcgccttgccgcgaacgccatctgttccgctgtccccgtggactggattccgacatctcggaccacgtggagcatccatgcccaccatcagtggatgaccacagaagatatgctgtccgtttggaatagagtgtggatcgaggaaaacccttggatggaggacaagacccacattagctcttggggagacgtcccctatctcggcaaacgggaagatcaatggtgcgggtccctgatcggacttacagccagagctacctgggccacaaatattcaggtggcgatcaaccaggttcgccggctgattggcaatgagaactacctcgactacatgaccagcatgaagagattcaaaaatgagggggatcccgaaggcgctctgtggtga

SEQ ID NO: 18875 - RNA, 9879 nt, synthetic construct
  misc_feature 1..9879: note = derived and/or modified CDS sequence (opt5) from DENV-1__FJ390383__SS-prME
  source 1..9879: mol_type = other RNA
tccgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagctatacccaggtctgcgaccaccggctcatgtccgcggccatcaaagatagcaaggctgttcacgccgacatgggctactggatcgaatctgagaaaaatgaaacatggaagctggccagagcttccttcattgaggtgaagacctgtatctggcccaaaagccatacactgtggtctaacggggtgctcgaatccgagatgattatcccgaagatttatggaggccctatcagccaacacaattaccgccccgggtacttcacccagacggccggaccttggcatctgggcaaacttgagctggattttgacctctgcgaagggaccacagtcgtggttgatgagcactgcggaaaccggggcccctctctgagaaccacaaccgtgacgggcaagatcattcacgaatggtgttgccggagctgtacactgcctccccttcgcttcagaggggaggacggatgctggtatggcatggagatccggccggtcaaagaaaaggaggaaaatctcgtgaagtccatggttagcgcggggtctggagaggtggactcctttagcctgggcctgctctgtatttccatcattatcgaagaggtcatgagatctcgctggagccggaaaatgctgatgaccgggacacttgctgtgttctttctgctcattatgggacagctgacctggaacgatctgatcagactttgcatcatggttggcgccaatgcctccgaccgcatgggcatggggaccacatacctggctctcatggccacgttcaagatgagacctatgtttgcggtgggactcctgttccggcgcctgacctctagagaggtccttctgctcacaattggcctgagcctggtggcttccgtggaacttcccaactctctggaggaactcggggatggactggccatgggcatcatgattctcaaactgcttaccgactttcaaagccatcagctgtgggccacactcctgtccctgaccttcatcaagacgacatttagccttcactatgcttggaaaaccatggccatggtcctgtctattgtttccctcttccccctgtgtctcagcaccacatctcagaagaccacatggctgcctgtgcttctggggtccctgggatgcaagccgctcacgatgtttctgatcgctgagaataaaatctggggccggcgcagctggccccttaacgaaggcattatggccgtggggatcgtctctattctgctctccagcctgctcaagaacgatgagcctctggcgggaccccttatcgccggcgggatgctgattgcttgttacgtgatctccggaagctctgccgacctgagcctcgagaaagctgccgaagtttcctgggaggaagaggccgaacattctggcgctagccacaatatcctggtggaggtccaggatgacgggaccatgaagattaaagatgaggaaagagacgatacacttaccatcctgctcaaggcgacactgctcgccgtgtccggagtttatcctctgtctattcccgctacccttttcgtgtggtacttctggcagaagaagaagcagcggagcggcgtcctgtgggacacgcctagccctcccgaggtggaacgcgccgtcctggatgacggcatctatagaattatgcagcgggggctcctgggacgctctcaggtgggcgttggggtgtttcaagagaacgtcttccataccatgtggcacgtgacaagaggagccgttcttatgtaccagggcaaacggctggagcccagctgggcttccgtgaagaaagacctcatcagctacgggggaggctggagactgcagggctcttggaataccggggaagaggtccaggtgattgccgtggaacccggaaagaaccctaaaaatgttcaaacagcgcccggcacctttaagacaccggagggggaagtcggagctatcgccctcgatttcaagcctggcacgtccgggagccccatcgtgaaccgcgagggaaaaattgtgggcctgtatggcaatggggtcgtgaccacatctggaacctacgtttccgccatcgctcaggccaaggcgagccaggagggccctcttcccgaaattgaggacgaagtgtttcggaaaagaaacctgaccatcatggatctgcaccccgggtccggaaagacacgccggtatctccctgctattgtcagagaggccatcaaacgcaagctgcggacgcttatcctggccccgaccagagtggttgcttctgaaatggccgaggctctcaagggcatgcccattcgctaccaaacaaccgccgtgaaaagcgagcatacagggaaggaaatcgtcgacctgatgtgccacgcgaccttcacgatgcggctgctctcccctgtgagagttcccaattataacatgattatcatggatgaggcccattttacagaccctagctctattgctgcccggggctacatctccacccgcgtgggaatgggcgaagctgccgccatcttcatgaccgctacaccccctgggagcgtcgaggcgtttccgcagtctaatgccgtgattcaggatgaagagagagacatccccgagcggagctggaactccggatatgaatggattaccgatttccctggcaaaacagtgtggtttgtcccctctatcaagagcgggaatgacattgctaactgtcttcgcaaaaatggaaagagagttatccagctgtcccggaagaccttcgatacggagtaccagaagaccaagaacaacgactgggactacgtggtgaccacagatatttctgaaatgggcgccaatttcagagccgaccgcgtcatcgatcctcggagatgcctgaaacccgtgatcctcaaggacgggccggagcgcgttattctggctggccctatgcccgtgaccgtcgccagcgcggctcagcggagaggacgcatcggccggaaccacaataaagagggggatcagtatatttacatgggacagccccttaacaatgacgaagatcatgcccactggacggaggccaagatgctgctcgacaacatcaatacccctgaaggcattatccccgctctgtttgagcctgaaagagagaagtccgccgcgatcgatggggagtatcgcctgagaggagaagcccggaaaacattcgtggagctcatgcgcagaggcgaccttccggtttggctgagctacaaggtggcttctgaagggtttcaatattccgatcggcgctggtgcttcgacggcgagagaaacaatcaggtcctggaagagaacatggatgtggagatttggaccaaagaaggagagcggaagaaactcagaccccgctggctggacgcccggacatacagcgaccctcttgctctgagagaatttaaggagttcgccgctggccgccggtccgtctctggggatctcatcctggaaattggaaaactgccccagcacctcacccagagagcccaaaatgcgcttgacaacctggtgatgctgcataatagcgagcagggcgggcgggcctatcgccacgctatggaggaactccctgatacaatcgagaccctgatgcttctggccctcattgctgttctgacgggaggcgtgacactgtttttcctctccggcagagggcttggaaagacctctatcggcctgctgtgtgtgatggccagctccgtcctcctgtggatggccagcgttgaaccccattggatcgctgcgtctattatccttgagtttttcctgatggtgctcctgattccggagcctgaccggcagcgcacaccccaggataaccaactggcctacgtggtcatcgggctcctttttatgattctgacagtggctgccaatgaaatgggactgctcgagaccacaaagaaagacctgggcatcgggcacgttgccgtggaaaaccaccatcacgctgccatgcttgatgtcgacctgcatcctgcgtccgcctggacgctctacgctgtggccaccacaattatcacccccatgatgagacacacaatcgagaacaccacggctaatattagcctgaccgccatcgcgaaccaggccgctattctgatgggactcgataagggctggcctatctctaaaatggacattggcgtcccccttctggccctggggtgctattcccaggtgaatccgctcacactgaccgctgccgttcttatgctggtggctcattacgccatcatcggacctggcctccaagcgaaggccacacgggaagctcagaaacgcaccgccgctgggattatgaagaaccccacggtcgatggaatcgtggccattgacctggatcccgttgtgtatgacgccaagttcgagaaacagctgggccagatcatgctccttattctgtgtacaagccaaatcctgctcatgagaaccacatgggcgctgtgcgagtctatcacccttgctaccgggcctctgacaacgctctgggaaggaagcccgggcaagttttggaataccacaattgccgtctccatggctaacatcttccggggctcttacctggccggggccggactggctttcagcctcatgaaatcccttggcgggggacgcagaggcaccggggcccagggagagacactgggcgaaaagtggaaacggcagctgaatcagctcagcaagtccgagtttaacacctataagagatctggcattatggaagtggaccgcagcgaggcgaaagaggggctgaagcggggagaaacgacaaaacacgccgtgtccagaggcaccgctaaacttcgctggttcgttgagcggaatctggtcaaacccgaagggaaggtgatcgatctcggatgtggcagagggggatggtcttactattgcgccggcctgaagaaagtgaccgaggtcaagggctacacaaaagggggacctggccacgaggaacccattcctatggctacctacgggtggaacctggttaagctccatagcggaaaagacgtgtttttcattccccctgagaagtgtgatacacttctgtgcgacatcggcgaatcctctccgaatcccacgatcgaggaagggcgcaccctgcgggtgctcaaaatggtcgagccttggctgagaggaaaccaattttgtatcaagattcttaatccctatatgcctagcgtggttgagacactggaacagatgcagcgcaagcacggcggcatgctcgtgcggaaccccctgtccagaaatagcacccatgagatgtactgggtctcttgcgggacaggaaacatcgtgtccgccgttaatatgaccagccgcatgctgctcaaccggttcacgatggcgcacagaaaaccgacctatgaacgcgatgtggacctgggcgccgggacaagacacgtcgctgtggagcctgaagtggccaaccttgatattatcggacagcggattgagaatatcaagcatgagcacaaatctacctggcattacgacgaagataacccctataagacatgggcttaccacggctcctatgaggtcaaacccagcgggtctgcctccagcatggttaatggagtggtgaagctgctcaccaagccttgggacgtcatccccatggtgacacaaattgctatgaccgatacgacaccttttggccagcagcgcgttttcaaagaaaaggtggacaccagaaccccgaaagccaagcggggcacagcgcaaatcatggaggtcacggccaaatggctgtgggggtttctttccagaaacaagaagccccggatttgtacccgcgaagagttcacaagaaaagtgcggagcaatgctgccatcggagctgtttttgtggacgagaaccagtggaactctgccaaggaagccgtcgaggatgaacgcttctgggacctggtgcatagagagcgggaactccacaaacagggcaagtgcgcgacctgcgtttacaacatgatggggaaacgcgagaagaagctgggagagtttggcaaagctaaggggagcagagccatttggtacatgtggctgggcgcccggttcctcgagttcgaggctctgggatttatgaatgaagatcactggttctcccgcgagaactctcttagcggcgtggagggggaaggactgcataaactcggctatatcctgagagacatctccaagattcctgggggaaatatgtacgccgatgacacagctggctgggatacccggatcacagaggacgatcttcagaacgaagcccgcattaccgacatcatggagcccgaacacgcgctgctcgccaaatctatttttaagctgacgtatcaaaataaagtcgtgagagtccagcggcctgctaagaacgggaccgtgatggatgttatcagccgcagagaccagcggggctccggacaggtgggcacatacgggctgaataccttcacaaacatggaggcccaactcatcagacagatggagtctgaaggaatttttagcccctccgagctggaaatcccgaaccttgctgagcgcgtcctggattggctcgaaaagtatggcgtggagcggctgaaaagaatggccattagcggggacgactgtgtggttaagcctatcgatgaccgcttcgcgaccgcccttacggctctgaatgatatgggaaaagtgcggaaggacattccccagtgggagccttctaaaggctggaacgattggcagcaagtccccttttgctcccatcacttccaccagctcatcatgaaggacgggagagaaattgtggttccttgtcgcaatcaggatgagctggtgggccgggccagagtcagccagggagctggctggtctctgcgcgaaacagcctgcctcgggaagtcctacgctcaaatgtggcagctgatgtattttcatcggagagaccttcgcctggccgcgaacgccatctgtagcgctgtgcccgtcgattggatcccgacctcccggacaacctggtctattcacgcccatcaccagtggatgacgaccgaggacatgctcagcgtgtggaatagagtttggatcgaagagaacccttggatggaggataaaacacatatttccagctggggagacgtgccctacctgggcaagcgggaagaccaatggtgcgggtctcttatcggactgaccgccagagctacatgggccaccaatattcaggtcgcgatcaaccaggtgcgccggctcatcggcaatgagaactacctggattatatgacatccatgaaaagattcaagaatgaaggggaccccgagggcgctctgtggtga

SEQ ID NO: 18876 - RNA, 9879 nt, synthetic construct
  misc_feature 1..9879: note = derived and/or modified CDS sequence (opt5) from DENV-1__FJ182033__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacgagcgccggcgttaatatgtgcacccttattgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccattggcaagctggtgcatcagatcttcgggacagcctacggagtgctctttagcggcgtctcttggaccatgaaaattgggatcggcgtgctgcttacgtggctgggactcaattcccggagcacctctctgtccatgacatgtattgctgttggcctggtgaccctttacctcggggtcatggtgcaggccgatagcggatgcgttatcaactggaagggcagagaactgaagtgtgggtccggaattttcgtgacaaatgaggtccacacctggacagaacaatataaatttcaggctgactctcctaagcgcctgagcgccgcgatcggcaaagcctgggaggagggggtgtgcggcatccggtccgctaccagactcgaaaacattatgtggcgccagatctctaacgagctgaatcatattcttctggaaaacgacatgaagttcacggttgtggtcggagatgtggtgggcatcctcgcccaggggaaaaagatgattcggccgcaacccatggagcacaaatacagctggaagtcctggggaaaggctaaaatcatcggcgccgacgtccagaatacaacctttattatcgatgggcctaacacccccgaatgtcctgacgatcagagagcctggaatatttgggaggttgaggactatggattcggcatctttacaaccaacatttggctgaagctgcgcgatagctacacacaggtgtgcgaccaccggcttatgtctgctgcgatcaaagattccaaggccgtgcatgctgacatgggctattggatcgaaagcgagaaaaatgaaacatggaagctcgccagagcctctttcattgaggtcaagacctgtatctggcccaaatcccacacactgtggagcaacggggtgctggaatctgagatgattatcccgaagatttacggaggccctatcagccaacataattatcgccccgggtacttcacccagacagctggaccttggcacctcggcaaactggagcttgattttgacctgtgcgaagggaccacggttgtggtcgatgagcactgcggaaaccggggcccctccctcagaaccacaaccgtgacaggcaagatcattcatgaatggtgttgccggagctgtaccctgcctcccctgcgcttcaaaggggaggacggatgctggtacggcatggagatcagaccggttaaggaaaaggaggaaaatcttgtgaaatctatggtctccgccgggagcggagaggtggactccttttctctcggcctgctgtgtattagcatcatgattgaagaggttatgcggtccagatggtctcgcaagatgctcatgacggggacactggcggtgttctttcttctgatcatgggacagctcacctggaacgatctgattcggagctgcatcatggtcggcgctaatgcctccgacagaatgggcatggggacaacctatctggcccttatggctaccttcaaaatgcgccctatgtttgccgtgggactcctgttcagacggctgacatctcgcgaggtgctcctgcttacgatcggcctgagcctcgtcgcgtccgttgaactgcccaacagcctggaggaacttggggatggactggctatgggcattatgatcctcaagctgctcaccgactttcaatcttaccagctgtgggccacacttctgtccctcaccttcattaaaacaacctttagcctgcactatgcctggaagacgatggctatggtgctgtctatcgtgtcccttctgcccctctgtctgagcacaacctctcagaagaccacatggctccctgtcctgcttgggtccctgggatgcaaaccgctgaccatgttcctcattgccgagaataagatctggggcagaaaaagctggcccctgaacgaaggcatcatggctgtggggattgtttccatccttctgagctctctcctgaagaacgatgtgcctctcgccggacccctgattgcgggcgggatgcttatcgcctgttacgtcattagcggatcctctgctgacctgagcctggagaaagccgctgaggtgtcctgggaagaggaagccgagcattctggcgccagccacaatatcctcgttgaagtgcaggatgacgggacaatgaagatcaaagatgaggagcgggacgatacgctgaccattcttctgaaggctacactcctggcggtctccggagtgtatcctctctctatccccgccaccctgtttgtctggtacttctggcaaaagaaaaagcagcgcagcggcgtgctttgggacacacctagccctcccgaagttgagagagctgtgctggatgacggcatttatcggatcatgcagcgcgggctgctcggaagaagccaggtcggcgtgggggttttccaagaaaacgtgtttcataccatgtggcacgtcacgcggggagccgtgctgatgtaccagggcaaacgccttgagccctcttgggcctccgtgaagaaagacctgattagctacgggggaggctggagactccagggctcttggaataccggggaggaagttcaggtcatcgctgtggagcccggaaagaaccctaagaatgtgcaaacagcccccggcaccttcaaaacaccggaaggggaggtcggagcgattgctctggattttaagcctggcacctccgggagccccatcgtgaaccgggaaggaaaaatcgttggcctctatggcaatggggtggtcacaacgtccggaacctacgtgtctgccattgcccaggctaaggccagccaggagggccctctgcccgagatcgaagacgaggttttcagaaaacgcaaccttacaattatggatctgcaccccgggtccggaaagacccggagatatctgcctgcgatcgtgcgcgaagctattaagcggaaactcagaaccctgatccttgccccgacacgcgtcgtggccagcgagatggctgaagccctgaagggcatgcccatccggtaccaaacgaccgctgttaaatctgagcatacagggagagagattgtggacctcatgtgccacgccacctttacaatgcgcctgctgtcccctgtccgggtgcccaattataacatgatcattatggatgaagcgcatttcaccgaccctagctctatcgccgctagaggctacattagcacgcgggtgggaatgggcgaggccgctgccatctttatgacagccacaccccctgggtccgtcgaggctttcccgcagtctaatgcggttatccaggatgaggaacgcgacattcccgagagaagctggaactccggatatgagtggatcaccgattttcctggcaagacagtgtggttcgtgccctctattaaaagcgggaatgacatcgccaactgtctccggaagaatggaaagcgcgtcattcagctttccagaaaaacctttgatacagaataccaaaagaccaaaaacaacgactgggactacgtggttacgacagatatcagcgagatgggcgctaatttccgggccgacagagtgattgatcctcgccggtgcctgaagcccgtcatcctgaaagacgggccggaaagagtgatcctcgccggccctatgcccgttaccgtggcttctgccgcgcagcgccggggaagaattggccgcaaccacaataaggagggggatcagtatatctacatgggacagcccctgaacaatgacgaggatcatgctcactggacagaagccaagatgcttctggacaacattaatacccctgagggcatcattcccgccctcttcgaacctgagcgggaaaaatccgctgccatcgatggggagtatagactgcgcggagaggcgagaaagacgtttgtcgaactgatgcggcgcggcgacctcccggtgtggcttagctacaaagtcgcctccgaggggttccaatattctgatagacggtggtgctttgacggcgaacgcaacaatcaggtgctggaggaaaacatggatgttgagatctggaccaaggagggagaacgcaagaagctgcggcccagatggctcgacgctcgcacatacagcgaccctctggcccttcgggagttcaaagaatttgctgccggcagacgctccgtgtctggggatctgattctcgagatcggaaagctgccccagcacctgacccagcgggctcaaaatgccctcgacaaccttgtgatgctgcataatagcgaacagggcgggagagcgtatcggcacgccatggaggagctgcctgatacaattgaaaccctcatgctgcttgctctgatcgccgtcctcacaggaggcgttaccctgttctttctgtccggccgcgggctcggaaagacgagcattggccttctgtgtgtgatggcttcttccgccctgctctggatggccagcgtggagccccattggatcgctgcgtctatcattctggagttctttcttatggtcctgctcatcccggagcctgacagacagcggacaccccaggataaccaactggcctacgtggttattgggctcctgttcatgatccttaccgtggctgccaatgagatgggactgctggaaaccaccaagaaggacctcggcattgggcacgtcgccgtggagaaccaccatcacgctaccatgctggatgtcgaccttcatcctgcctccgcgtggacactgtacgccgtggctacgaccatcattacacccatgatgcgccacaccatcgaaaacacaaccgccaatatcagcctcacggctattgccaaccaggcggccatcctgatgggactggataaaggctggcctatttctaagatggacatcggcgttcccctccttgctctggggtgctatagccaggtgaatccgctgaccctcacagccgctgtcctgatgcttgtggcccattacgctattatcggacctggcctgcaagccaaagcgaccagagaggcccagaagcggacagctgccgggatcatgaagaaccccaccgttgatggaattgtggctatcgacctcgatcccgtcgtgtatgacgccaaatttgaaaagcagctgggccagattatgctgctcatcctttgtacgtcccaaattctgctgatgcgcacaacctgggccctctgcgagtctatcacactggcgaccgggcctcttaccacactgtgggagggaagcccgggcaaattctggaatacgaccatcgctgtgtccatggccaacatttttagaggcagctacctcgctggggccggactggccttctccctgatgaagtctctcggcgggggacggcgcggcacaggggctcagggagaaacccttggcgagaaatggaagagacagctgaatcagctgagcaagtccgagttcaacacatataaacggtctggcatcatggaggttgacagaagcgaagccaaggaggggctccgccggggagagaccacgaaacacgcggtctccagaggcacagccaagctgcgctggtttgtggaacggaatcttgtgaaacccgaggggaaggtcattgatctgggatgtggcagagggggatggtcttactattgcgctggcctcaagaaagttaccgaagtgaagggctacaccaaagggggactgggccacgaggaacctatccccatggccacatacgggtggaacctggtgaagctccatagcggaaaagacgtcttctttattcctcccgagaagtgtgatacccttctgtgcgacatcggcgagtccagccctaatccgacaattgaagaggggcgcacgctgcgggtgctcaaaatggttgaaccctggctgagaggaaaccaattctgtatcaagatccttaatccttatatgccctctgtggtcgagaccctggagcagatgcagcgcaagcacggcggcatgctcgtgcggaaccctctgtccagaaatagcacacatgaaatgtactgggtttcttgcgggaccggaaacattgtgtccgctgtcaatatgacaagccgcatgctgctcaaccggtttaccatggcccacagaaaacccacgtatgagcgcgatgtggacctgggcgcggggaccagacacgtggccgtcgaaccggaggttgctaaccttgatatcattggacagcggatcgaaaatattaagcatgagcacaaatctacatggcattacgacgaggataacccttataagacctgggcctaccacggctcctatgaagtgaaacccagcgggtccgctagctctatggtgaatggagtcgtgaagctgctcacaaagccctgggacgttatccctatggtgacccaaatcgccatgacagataccacgcccttcggccagcagcgcgtctttaaagagaaggtggacacaagaacccctaaagctaagcggggcaccgcccaaattatggaagttacagcgagatggctgtgggggttccttagccggaacaaaaagccgcgcatctgtacgagagaggaatttacccggaaggtgcgctccaatgccgctattggagccgtcttcgtggacgagaaccagtggaactctgctaaagaggccgttgaagatgagagattttgggacctggtgcatcgggaacgcgagctccacaagcagggcaaatgcgccacatgcgtctacaacatgatggggaagagagagaagaagctgggagagttcggcaaggcgaaagggagccgggctatctggtacatgtggctgggcgcccgctttctcgagttcgaagccctgggattcatgaatgaggatcactggttttccagagaaaactctcttagcggcgtggagggggagggactgcataagctcggctatattctgcgggacatctccaaaatccccgggggaaatatgtacgctgatgacaccgccggctgggatacacgcattaccgaagacgatcttcagaacgaggctaagatcacagacattatggaacctgagcacgccctgctcgcgacctctatcttcaaactgacgtatcaaaataaggtcgtgagagttcagcggcccgcccgcaacgggaccgtgatggatgtcattagcagacgggaccagagaggctccggacaggtgggcacatacgggctgaatacctttacaaacatggaagctcaactcatccgccagatggagagcgagggaatcttcctgccttctgaacttgagacccccaacctggccgaacgggtgctcgattggctggagaaacatggcgttgaaagacttaagcgcatggctatttccggggacgactgtgtggtcaagccgatcgatgaccggtttgccacggcgctgacagccctcaatgatatgggaaaagtgagaaaggacattcctcagtgggagcccagcaaaggctggaacgattggcagcaagttcctttctgctctcaccactttcatcagctgatcatgaaggacgggcgcgagattgtggtcccctgtcggaatcaggatgaactggtgggcagagctcgcgtctcccagggagccggctggagcctccgggagaccgcttgcctggggaaatcctatgcccaaatgtggcagcttatgtacttccacagacgcgacctgcggctcgctgccaacgcgatctgttctgccgtgcctgttgattgggtgcccacaagcagaaccacgtggtccattcatgctcaccatcagtggatgaccacagaagacatgctgagcgtctggaatcgggtgtggatcgaggaaaacccgtggatggaggataagacccacatctcttcctggggagacgttccttatcttggcaagagagaggaccaatggtgcgggagcctgattggactcacagcccgcgccacctgggctacaaatatccaggtggccattaaccaggtccggagactgatcggcaatgaaaactacctggattacatgacctctatgaaacgctttaagaatgagagcgaccccgaaggggcgctctggtga

SEQ ID NO: 18877 - RNA, 9879 nt, synthetic construct
  misc_feature 1..9879: note = derived and/or modified CDS sequence (opt5) from DENV-1__FJ182034__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggaactctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttatattgtgatcggggccggagaaaaagctcttaagctcagctggttcaagaaaggctcctctattgggaagatgtttgaggccaccgctagaggcgcccgccggatggcgatcctgggagatacagcctgggacttcggcagcatcgggggagtttttacctccgtcggcaaactggtgcatcagattttcgggacagcttacggagtgctctttagcggcgtctcttggaccatgaagatcgggattggcgtgctgcttacgtggctgggactcaattccagaagcacctctctgtccatgacatgtatcgccgttggcctggtgaccctttacctcggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctgagcgcggccattggcaaggcttgggaggagggggtgtgcggcatcagatccgccacccgcctcgaaaacatcatgtggaaacagatttctaacgagctgaatcatatccttctggaaaacgacatgaagttcacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttaacctgtgcgaagggaccacggtggttgtggacgagcactgcggaaatcggggcccctccctcagaaccacaaccgtcacaggcaagatcatccacgaatggtgttgccggagctgtaccctgcctcccctgcgcttcaaaggggaggatggatgctggtatggcatggagattagaccggtgaaggaaaaggaggaaaaccttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaatgacctgatccggctgtgcattatggtgggcgccaacgctagcgatagaatgggcatggggatgacataccttgccctgatggcgaccttcaaaatgcgccctatgctcgctgtcggactgctctttagacggctgacctcccgcgaggtgcttctgctcacaatcggcctgtctctggtggccagcgtcgaacttcccaattccctggaggaactcggggacggactggccatgggcatcatgattctcaagctgcttacggatttccaaagccatcagctgtgggctaccctcctgtctctgacatttatcaaaaccacatattcccttcactacgcctggaagaccatggctatggttctgagcattgtgtctctcttccccctgtgtctctccacgacaagccagaagaccacctggctgcctgtgcttctggggtctctgggatgcaaaccgctcacaatgtttctgatcgccgagaacaagatttggggcagaaaatcctggccccttaacgaaggcatcatggcggtcgggatcgtgagcattctgctctccagcctgctcaagaatgacgttcctctggccggaccccttatcgctggcgggatgctgattgcctgttatgtgatctctggaagctccgctgatctgtctctcgagaaagccgccgaggtcagctgggaagaggaagctgagcattccggcgcgtctcacaacattctggtggaagttcaggacgatgggaccatgaagatcaaagacgaggagcgggatgacacacttacgatcctgctcaaggccaccctgctcgctgtgagcggagtctaccctctgtccattcccgccacacttttcgtgtggtatttttggcaaaagaaaaagcagcgctctggcgtcctgtgggataccccttcccctcccgaagtggagagagccgttctggacgatggcatctaccggattatgcagcgcgggctcctgggaagatcccaggtgggcgtcggggtgttccaagaaaatgttttccatacaatgtggcacgtgacccggggagctgtccttatgtaccagggcaaacgcctggagcccagctgggcctctgtgaagaaagacctcatctcctatgggggaggctggagactgcagggcagctggaacacgggggaggaagtgcaggttattgcggtcgagcccggaaagaatcctaagaacgtgcaaaccgctcccggcacatttaaaacctctgaaggggaggtgggagccatcgccctcgacttcaagccgggcacatccgggagccctattgtcaatcgggaaggaaaaatcgtgggcctgtacggcaacggggttgtgaccacatccggaacgtatgtctctgctatcgcccaggcgaaggctagccaggagggcccccttcctgagattgaaaatgaggtgtttagaaaacgcaacctgaccatcatggatctgcaccccgggtccggaaagacacggagatacctccccgccattgttcgcgaagccatcaagcggaaactgagaacccttattctggctcctacccgcgtggtcgccagcgagatggctgaagccctcaagggcatgccgatccggtatcaaacaacggcggtgaaatctgagcataccgggaaggagatcgttgacctgatgtgccacgccacattcaccatgagactgctctcccccgtgcgcgtccctaattacaacatgattatcatggatgaagctcattttacagaccccagctctattgccgctcggggctatatcagcaccagagtgggaatgggcgaggccgccgctattttcatgacggcgacacctcccgggtccgtggaagcctttcctcagtctaatgctgtcatccaggatgaggaacgggacatcccggagcgcagctggaactccggatacgagtggattaccgatttccccggcaaaaccgtttggtttgtgccttctatcaagagcgggaatgacattgccaactgtcttagaaagaacggaaaacgggtgatccagctgtcccgcaagacattcgataccgaataccagaagacaaagaataacgactgggattatgtcgtgaccacggacattagcgagatgggcgccaattttagagctgaccgggttatcgatcccagacgctgcctgaaacctgtgattctcaaggacgggcccgaacgggtcatcctggccggcccgatgcctgtgacagttgcgtctgctgcccagagacgcggacggatcggcagaaaccacaataaggagggggatcagtacatttatatgggacagccccttaacaatgacgaggatcatgcccactggaccgaagctaaaatgctgctcgacaacatcaatacacccgagggcattatccctgccctgttcgaacccgagcgcgaaaagtccgcggccattgatggggagtaccggctgagaggagaggctcgcaaaaccttcgtggaactcatgagacggggcgaccttcctgtctggctgagctataaggtggcctccgaggggtttcaatactctgatcgcagatggtgcttcgacggcgaacggaacaatcaggtcctggaggaaaacatggatgtggagatctggacgaaagagggagaacgcaagaaactcagaccgcggtggctggacgctagaacctatagcgatccccttgccctgcgcgagtttaaggagttcgctgccggccggagatccgtttctggggacctcatcctggagattggaaagctgcctcagcacctcacacagcgcgcgcaaaatgcccttgacaacctggtgatgctgcataatagcgaacagggcgggcgggcttacagacacgccatggaggagctccccgataccatcgaaacactgatgcttctggctctcattgccgtgctgaccggaggcgtcacactgtttttcctctccggccgggggcttggaaaaaccagcatcggcctgctgtgtgttatggcctcttccgtgctcctgtggatggctagcgtggagcctcattggattgcggcctctatcatccttgaatttttcctgatggtcctcctgattcccgagccggaccgccagagaacgcctcaggataaccaactggcttacgtggttatcgggctcctttttatgattctgacagtggccgccaacgagatgggactgctcgaaaccaccaagaaagacctgggcatcgggcacgtcgctgtggagaatcaccatcacgccgcgatgcttgatgtcgacctgcatcccgcctccgcttggacactctatgccgtggctaccacaattatcacgcctatgatgcggcacaccattgaaaacacaaccgccaatatcagcctgacagcgatcgccaaccaggctgccattctgatgggactcgataagggctggcccatctctaaaatggacattggcgttcctcttctggctctggggtgctacagccaggtgaatcccctcaccctgacggccgctgtccttatgctggtggcccattatgcgatcattggaccgggcctccaagccaaggctacccgcgaggcccagaagagaacagctgccgggatcatgaaaaaccctaccgttgatggaatcgtggccattgacctggatcccgtcgtgtacgacgcgaagttcgaaaaacagctgggccagatcatgctccttattctgtgtacatcccaaatcctgctcatgcggaccacgtgggctctgtgcgagtctattacacttgccaccgggcccctgacaaccctctgggagggaagccctggcaagttttggaataccacaatcgctgtgtccatggccaacatcttccgcggcagctatctggccggggctggactggccttttccctcatgaaatctcttggcgggggaagacggggcacgggggcgcagggagaaaccctgggcgagaagtggaagcgccagctgaatcagctcagcaaatccgagttcaacacatacaagagatctggcattatggaggttgatcggagcgaagccaaagaggggctgaagagaggagagaccacaaaacacgctgtctcccgcggcaccgccaaacttcggtggttcgtggaaagaaatctggtgaagccggaggggaaagtcatcgacctcggatgtggccgcgggggatggtcttattactgcgctggcctgaagaaagttacggaagtgaagggctacacaaaagggggacccggccacgaggaacctattcccatggccacctatgggtggaacctggtgaagctccatagcggaaaagacgtctttttcatccctcccgagaagtgtgatacccttctgtgcgacattggcgagtccagccctaatccgacaatcgaagaggggcggaccctgagagtgctcaagatggttgaaccctggctgcgcggaaaccaattttgtattaaaatccttaatccttacatgccctctgtggtcgagacactggagcagatgcagcggaagcacggcggcatgctcgtgagaaaccctctgtcccgcaatagcacgcatgaaatgtattgggtttcttgcgggaccggaaacatcgtgtccgcggtcaacatgacaagccggatgctgctcaatagattcaccatggcccaccgcaaacccacatacgagcgggatgtggacctgggcgctgggaccagacacgtggccgtcgaaccggaggttgctaaccttgatattatcggacagcgcattgaaaatatcaagcatgagcacaaatctacgtggcattatgacgaggataacccttacaagacctgggcctatcacggctcctacgaagtgaagcccagcgggtccgctagctctatggtgaatggagtcgtgaaactgctcacaaagccctgggacgttattcctatggtgacccaaatcgccatgacagataccacaccctttggccagcagagagtcttcaaagagaaggtggacacccggacgcctaaagcgaagcgcggcacagcccaaatcatggaagttaccgctaagtggctgtgggggtttcttagcagaaacaaaaagccgcggatttgtaccagagaggagttcacacggaaagtgcgctccaatgccgctatcggagccgtctttgtggatgagaaccagtggaactctgccaaggaggcggttgaagacgagagattctgggacctggtgcatcgggaacgcgagctccacaaacagggcaagtgcgctacgtgcgtctacaacatgatggggaagagagagaaaaagctgggagagtttggcaaagccaaggggagccgggccatttggtatatgtggctgggcgctcgcttcctcgagtttgaagccctgggattcatgaatgaggatcactggttctccagagaaaactctcttagcggcgtggagggggagggactgcataaactcggctacatcctgcgggacatttccaagatccccgggggaaatatgtatgctgatgacaccgccggctgggatacacgcatcaccgaagacgatcttcagaacgaggcgaaaattacagacatcatggaacctgagcacgccctgctcgctaagtctatttttaagctgacctaccaaaataaagtcgtgagagttcagcggcccgccaagaacgggacagtgatggatgtcatcagccgcagagaccagcggggctccggacaggtgggcacctatgggctgaacacgttcaccaatatggaagctcaactcattcgccagatggagagcgagggaatcttttctccttccgaactggagacacccaaccttgccggcagagtgctggattggctcgaaaaacatggggttgagcggctgaagagaatggcgatcagcggagacgattgtgtggtcaaaccgattgacgaccgcttcgccaccgctcttacagccctgaatgatatgggcaaggtgcggaaggacatccctcagtgggaaccctctaaagggtggaacgattggcagcaagttcctttttgctcccaccacttccatcagctcattatgaaggacggcagagagatcgtggtcccctgtcgcaatcaggatgagctggtgggacgggctagagtcagccagggcgccgggtggtccctgcgcgaaaccgcttgcctcggaaaatcttacgcccaaatgtggcagctgatgtattttcaccggagagaccttcgcctggcggccaacgctatttgtagcgccgtgcctgttgattgggtgcccacgtcccggacaacctggagcatccatgcccaccatcagtggatgacaaccgaggacatgctctctgtctggaatagagtgtggattgaagagaacccgtggatggaagataagacgcacatctccagctggggcgacgttccttacctggggaaacgcgaggatcaatggtgcggatctcttatcggcctgaccgctcgggccacatgggcgaccaatattcaggtggctatcaaccaggtcagacggctcattgggaatgagaactacctggactatatgacaagcatgaagagattcaagaatgaatccgaccccgagggcgccctgtggtga

SEQ ID NO: 18878 - RNA, 9879 nt, synthetic construct
  misc_feature 1..9879: note = derived and/or modified CDS sequence (opt5) from DENV-1__FJ182036__SS-prME
  source 1..9879: mol_type = other RNA
agcgtgaccatgctgctcatgctgatgcccacagcccttgctttccacctgacgaccagaggcggggaacctcatatgattgtctccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgccacacctagcatggctatgagatgcgtcggcattgggtcccgggattttgtggagggactgagcggcgccacgtgggttgacgtggtcctcgagcacgggtcttgtgtgaccacaatggctaaggataaacccaccctggacatcgaactgctcaagacagaggtgaccaaccctgccgtcctgcgcaaactttgcattgaagcgaagatctccaatacgacaaccgatagcagatgtccgacccaaggagaggccacactggttgaagaacaagacgctaacttcgtgtgccggcgcacctttgtggatagaggctggggcaatgggtgtggactcttcggcaaagggtctctgattacatgcgccaagtttaagtgcgtcacgaaacttgagggaaagatcgtgcagtacgaaaacctgaaatattccgttatcgtgaccgtccacacaggcgaccagcatcaagtggggaatgagagcaccgaacacggaacaaccgctacgattacaccccaagcccctaccaccgagatccagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcttccacatctcaagagacctggaatcgccaggacctgctcgtcaccttcaaaacagcgcacgccaagaagcaggaagtggtcgtgctgggaagccaagagggcgctatgcacacggccctgaccggggccacagaaattcagacctccggaacaaccacgatctttgctggccatctcaaatgcagactgaagatggataaacttacactgaaggggatgagctatgttatgtgtaccggctctttcaaactcgagaaggaactggccgagacccagcacggaacagtgctggtccagattaagtacgagggcaccgacgcgccgtgcaaaatccctttctccacacaagatgaaaagggggtgacgcagaacggacggcttatcaccgctaatcccattgttacagacaaagagaagcctgtgaacatcgaagccgagccgccctttggcgagagctatattgtcatcggggccggagaaaaagctctcaagctgtcttggttcaagaaaggcagctccattgggaagatgtttgaggccaccgctagaggcgcccgccggatggcgatcctgggagatacagcctgggacttcggctctatcgggggagtgtttaccagcgtgggcaaactcgttcatcagattttcgggacggcttacggagtcctgttttccggcgtgagctggaccatgaagatcgggattggcgtgcttctgacatggctcggactcaattctagatccaccagcctgtctatgacatgtatcgccgtcggccttgtgaccctctacctgggggttatggtgcaggctgattccggatgcgtcattaactggaaaggccgcgaactgaagtgtgggagcggaatcttcgtgacaaatgaggttcacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgtcgtggttggagatgtggctggcattctggcccaggggaaaaagatgatccggccgcaacccatggagtacaaatattcttggaaaagctggggaaaggccaagattatcggcgctgacgtccagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctaaggccgtccacgccgacatgggctactggatcgaatccgagaaaaatgaaacatggaagctggctagagccagcttcatcgaggttaagacctgtatttggcccaaatctcatacactgtggtccaacggggtgctcgaaagcgagatgatcattccgaagatctatggaggccctatgtctcaacacaattaccgccccgggtacttcacccagacggcgggaccttggcatctgggcaaacttgagctggattttgacctctgcgaagggaccacagtggtcgtggatgagcactgcggaaaccggggccccagcctgagaaccacaaccgttacgggcaagattatccacgaatggtgttgccggtcctgtacactgcctccccttcgcttcagaggggaggacggatgctggtatggcatggagatccggccggtgaaagaaaaggaggaaaatctcgtcaagagcatggtgtctgctgggtccggagaggttgacagcttttccctgggcctgctctgtatttctatcatgattgaagaggtgatgagaagccgctggtcccggaaaatgctgatgaccgggacacttgccgtcttctttctgctcatcatgggacagctgacctggaacgatctgattagactttgcatcatggtgggcgccaatgcttctgaccgcatgggcatggggaccacatacctggccctcatggcgacgttcaagatgagacctatgtttgctgttggactgctgttccggcgcctgaccagcagagaggtgcttctgctcacaattggcctgtccctggtcgcctctgtggaacttcccaacagcctggaggaactcggggatggactggccatgggcatcatgatcctcaaactgcttaccgactttcaatcccatcagctgtgggctacactcctgagcctgaccttcattaagacgacattttctcttcactatgcctggaaaaccatggctatggtgctgtccatcgtcagcctcttccccctgtgtctctctaccacatcccagaagaccacatggctgcctgttcttctggggagcctgggatgcaagccgctcacgatgtttctgattgccgagaataaaatctggggccggcgctcttggccccttaacgaaggcattatggcggtggggatcgtgtccatcctgctcagctccctgctcaagaacgatgtccctctggccggaccccttattgctggcgggatgctgatcgcctgttacgtgattagcggatctagcgctgacctgtccctcgagaaagccgccgaggtttcttgggaagaggaagctgagcatagcggcgcgtcccacaatatcctggtggaagtccaggatgacgggaccatgaagattaaagatgaggagagagacgatacacttaccatcctgctcaaggccacactgctcgctgtgtctggagtttatcctctgagcatccccgccacccttttcgtgtggtacttctggcagaagaagaagcagcggtccggcgtcctgtgggacacgccttctcccccggaagtggagcgcgccgtcctggatgacggcatttatagaatcatgcagcgggggctcctgggacgcagccaggtgggcgttggggtgtttcaagaaaacgtcttccataccatgtggcacgtgacaagaggagctgttcttatgtaccagggcaaacggctggagccttcctgggccagcgtgaagaaagacctcatttcttacgggggaggctggagactgcagggctcctggaataccggggaggaagtccaggtgatcgcggtggagcccggaaagaaccctaaaaatgttcaaacagctcccggcacctttaagacaccggaaggggaggtcggagccattgccctcgatttcaagcctggcacgagcgggtctcccatcgtgaaccgcgaaggaaaaattgtgggcctgtatggcaatggggtcgtgaccacatccggaacctacgttagcgctatcgcccaggcgaaggcttcccaggagggccctcttcccgagatcgaagacgaggtgtttcggaaaagaaacctgaccattatggatctgcaccccgggtctggaaagacacgccggtatctccctgccatcgtcagagaagccattaaacgcaagctgcggacgcttatcctggctccgaccagagtggttgccagcgagatggctgaagccctcaagggcatgcccattcgctaccaaacaaccgcggtgaaatccgagcatacagggaaggagatcgtcgacctgatgtgccacgccaccttcacgatgcggctgctcagccctgtgagagttcccaattataacatgatcattatggatgaagctcattttacagacccttcttccatcgccgctcggggctacattagcacccgcgtgggaatgggcgaggccgccgctatcttcatgaccgcgacaccccctgggtctgtcgaagcctttccgcagagcaatgctgtgattcaggatgaggaaagagacatccccgagcggtcctggaactctggatatgagtggatcaccgatttccctggcaaaacagtgtggtttgtccccagcattaagtccgggaatgacatcgccaactgtcttcgcaaaaatggaaagagagttattcagctgtctcggaagaccttcgatacggaataccagaagaccaagaacaacgactgggactacgtggtgaccacagatatcagcgagatgggcgccaatttcagagctgaccgcgtcattgatcctcggagatgcctgaaacccgtgatcctcaaggacgggccggaacgcgttattctggccggccctatgcccgtgaccgtcgcgtccgctgcccagcggagaggacgcatcggccggaaccacaataaagagggggatcagtatatctacatgggacagccccttaacaatgacgaggatcatgcccactggacggaagctaagatgctgctcgacaacattaatacccctgagggcatcattcccgccctgtttgaacctgagagagaaaagagcgcggccatcgatggggagtatcgcctgagaggagaggctcggaaaacattcgtggaactcatgcgcagaggcgaccttccggtttggctgtcttacaaggtggcctccgaggggtttcaatatagcgatcggcgctggtgcttcgacggcgaaagaaacaatcaggtcctggaggaaaacatggatgtggagatttggaccaaagagggagaacggaagaaactcagaccccgctggctggacgctcggacatactccgaccctcttgccctgagagagtttaaggagttcgctgccggccgccggtctgtcagcggggatctcatcctggagatcggaaaactgccccagcacctcacccagagagcgcaaaatgcccttgacaacctggtgatgctgcataattccgaacagggcgggcgggcttatcgccacgccatggaggagctccctgatacaattgaaaccctgatgcttctggctctcatcgccgttctgacgggaggcgtgacactgtttttcctctctggcagagggcttggaaagaccagcattggcctgctgtgtgtgatggcctccagcgtcctcctgtggatggcttctgttgagccccattggatcgcggcctccattatccttgaatttttcctgatggtgctcctgatcccggagcctgaccggcagcgcacaccccaggataaccaactggcttacgtggtcattgggctcctttttatgatcctgacagtggccgccaatgagatgggactgctcgaaaccacaaagaaagacctgggcattgggcacgttgctgtggagaaccaccatcacgccgcgatgcttgatgtcgacctgcatcctgccagcgcttggacgctctacgccgtggctaccacaatcattacccccatgatgagacacacaatcgaaaacaccacggccaatatttctctgaccgcgatcgccaaccaggctgccatcctgatgggactcgataagggctggcctatttccaaaatggacatcggcgtcccccttctggctctggggtgctatagccaggtgaatccgctcacactgaccgccgctgttcttatgctggtggcccattacgcgattatcggacctggcctccaagccaaggctacacgggaggcccagaaacgcaccgctgccgggattatgaagaaccccacggtcgatggaatcgtggccatcgacctggatcccgttgtgtatgacgcgaagttcgaaaaacagctgggccagattatgctccttatcctgtgtacatctcaaattctgctcatgagaaccacatgggctctgtgcgagagcatcacccttgccaccgggcctctgacaacgctctgggagggatccccgggcaagttttggaataccacaattgctgtctctatggccaacatcttccggggcagctacctggccggggctggactggccttctccctcatgaaaagccttggcgggggacgcagaggcaccggggcgcagggagaaacactgggcgagaagtggaaacggcagctgaatcagctctccaagtctgaatttaacacctataagagaagcggcatcatggaggtggaccgctccgaagccaaagaggggctgaagcggggagagacgacaaaacacgctgtgtctagaggcaccgccaaacttcgctggttcgttgaacggaatctggtcaaacccgaggggaaggtgattgatctcggatgtggcagagggggatggagctactattgcgctggcctgaagaaagtgaccgaagtcaagggctacacaaaagggggacctggccacgaggaacccatccctatggccacctacgggtggaacctggttaagctccattccggaaaagacgtgtttttcattccccctgagaagtgtgatacacttctgtgcgacatcggcgagtctagcccgaatcccacgattgaagaggggcgcaccctgcgggtgctcaaaatggtcgaaccttggctgagaggaaaccaattttgtatcaagattcttaatccctatatgccttccgtggttgagacactggagcagatgcagcgcaagcacggcggcatgctcgtgcggaaccccctgagcagaaattctacccatgaaatgtactgggtctcctgcgggacaggaaacatcgtgagcgcggttaatatgacctctcgcatgctgctcaaccggttcacgatggcccacagaaaaccgacctatgagcgcgatgtggacctgggcgctgggacaagacacgtcgccgtggaacctgaggtggctaaccttgatatcattggacagcggatcgaaaatattaagcatgagcacaaatccacctggcattacgacgaggataacccctataagacatgggcctaccacggcagctatgaagtcaaaccctctgggtccgctagctccatggttaatggagtggtgaagctgctcaccaagccttgggacgtcatccccatggtgacacaaattgccatgaccgatacgacaccttttggccagcagcgcgttttcaaagagaaggtggacaccagaaccccgaaagcgaagcggggcacagcccaaatcatggaagtcacggctaaatggctgtgggggtttcttagcagaaacaagaagccccggatctgtacccgcgaggagttcacaagaaaagtgcggtctaatgccgctattggagccgtttttgtggacgagaaccagtggaatagcgccaaggaggcggtcgaagatgagcgcttctgggacctggtgcatagagaacgggagctccacaaacagggcaagtgcgctacctgcgtttacaacatgatggggaaacgcgaaaagaagctgggagagtttggcaaagccaaggggtccagagccatctggtacatgtggctgggcgctcggttcctcgagttcgaagccctgggatttatgaatgaggatcactggttctctcgcgaaaacagcctttccggcgtggagggggagggactgcataaactcggctatattctgagagacatctctaagattcctgggggaaatatgtacgctgatgacacagccggctgggatacccggatcacagaagacgatcttcagaacgaggcgcgcatcaccgacattatggaacccgagcacgccctgctcgctaaaagcatctttaagctgacgtatcaaaataaagtcgtgagagtccagcggcctgccaagaacgggaccgtgatggatgttatttcccgcagagaccagcggggctctggacaggtgggcacatacgggctgaataccttcacaaacatggaagctcaactcatcagacagatggagagcgagggaatcttttcccccagcgaactggagaccccgaaccttgccaagcgcgtcctggattggctcgaaaaatatggcgtggagcggctgaagagaatggcgatctctggggacgactgtgtggttaaacctatcgatgaccgcttcgccacggctcttacagccctgaatgatatgggaaaggtgcggaaagacattccccagtgggaaccttccaagggctggaacgattggcagcaagtccccttttgcagccatcacttccaccagctcatcatgaaggacgggagagagattgtggttccttgtcgcaatcaggatgagctggtgggccgggctagagtctctcagggagccggctggtccctgcgcgaaaccgcttgcctcgggaaaagctacgcccaaatgtggcagctgatgtattttcatcggagagaccttcgcctggcggccaacgctatctgttccgccgtgcccgtcgattggattccgacatctcggaccacgtggagcatccacgcccatcaccagtggatgaccacagaggacatgctctccgtgtggaatagagtttggattgaagagaacccttggatggaagataagacccatatcagctcttggggagacgtgccctacctgggcaaacgggaggaccaatggtgcgggtcccttatcggactgacagctagagccacctgggcgacaaatattcaggtcgctatcaaccaggtgcgccggctcattggcaatgagaactacctggattatatgaccagcatgaagagattcaaaaatgaatctgaccccgagggggccctgtggtga

SEQ ID NO: 18879 - RNA, 9879 nt, synthetic construct
  misc_feature 1..9879: note = derived and/or modified CDS sequence (opt5) from DENV-1__FJ205876__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtgctcacgggaggcgtcacactgtttttcctgtctggcagagggctcggaaagaccagcatcggccttctgtgtgttatggcctccagcgtgctgctctggatggcctctgtggagccccattggattgctgcgtccatcatcctggaatttttccttatggtcctgctcattccggagcctgaccggcagcgcacaccccaggataaccaactggcctacgtggttatcgggctgctctttatgattcttacagtggctgccaatgagatgggactgctggaaaccacaaagaaagacctcggcatcgggcacgtcgccgtggagaaccaccatcacgctgccatgctggatgtcgaccttcatcctgcgagcgcctggacgctgtacgctgtggccaccacaattatcacccccatgatgagacacacaattgaaaacaccacggctaatatctctctcaccgccatcgcgaaccaggccgctattctgatgggactggataagggctggcctatctccaaaatggacattggcgttcccctccttgccctggggtgctatagccaggtgaatccgctgacactcaccgctgccgtcctgatgcttgtggctcattacgccatcattggacctggcctgcaagcgaaggccacacgggaggctcagaaacgcaccgccgctgggatcatgaagaaccccacggttgatggaatcgtggccattgacctcgatcccgtcgtgtatgacgccaagttcgaaaaacagctgggccagatcatgctgctcattctttgtacatctcaaatcctgctgatgagaaccacatgggcgctctgcgagagcattaccctggctaccgggcctcttacaacgctgtgggagggatccccgggcaagttttggaataccacaatcgccgtgtctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgtggcagagggggatggagctactattgcgccggcctcaagaaagttaccgaagtgaagggctacacaaaagggggacctggccacgaggaacccattcctatggctacctacgggtggaacctggtgaagctgcattccggaaaagacgtctttttcattccccctgagaagtgtgatacactcctttgcgacattggcgagtctagcccgaatcccacgatcgaagaggggcgcaccctgcgggtgctgaaaatggttgaaccttggctcagaggaaaccaattttgtattaagatcctgaatccctatatgccttccgtggtcgagacacttgagcagatgcagcgcaagcacggcggcatgctggtgcggaaccccctcagcagaaattctacccatgaaatgtactgggtttcctgcgggacaggaaacatcgtgagcgccgtcaatatgacctctcgcatgctgctgaaccggttcacgatggcgcacagaaaaccgacctatgagcgcgatgtggacctcggcgccgggacaagacacgtggctgtcgaacctgaggttgccaacctggatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaaacttctgaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctctgggggtttctgagcagaaacaagaagccccggatttgtacccgcgaggagttcacaagaaaagtgcggtctaatgctgccatcggagctgtctttgtggacgagaaccagtggaatagcgccaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagctaaggggtccagagccatttggtacatgtggctgggcgcccggttcctggagttcgaagctctcggatttatgaatgaggatcactggttcaaccgcgaaaattctctgagcggcgtggagggggagggacttcataaactgggctatatcctcagagacatttccaagatccctgggggaaacatgtacgccgatgacacagctggctgggatacccggatcacagaagacgatctgcagaatgaggcccgcattaccgacatcatggaacccgagcacgcgcttctggccagatctatttttaaactcacgtatcaaaacaaggtcgtgcgggttcagcgccctgctaaaaatgggaccgtgatggatgtcatcagcagacgggaccagagaggctccggacaggtgggcacatacgggctgaacaccttcacaaacatggaagcccaactgattcgccagatggagtctgagggaatctttagcccctccgaactcgagaccccgaatctggctgaacgggtgcttgattggctggagaagtatggcgttgaaagactcaagcgcatggccatcagcggggacgactgtgtggtcaaacctattgatgaccggttcgcgacggccctgacagctcttaacgatatgggaaaggtgagaaaagacatcccccagtgggagccttctaagggctggaatgattggcagcaagttcccttttgctcccatcacttccaccagctgattatgaaagacgggcgcgagatcgtggtcccttgtcggaaccaggatgaactcgtgggcagagcccgcgtcagccagggagctggctggtctctgcgggagaccgcctgcctggggaagtcctacgctcaaatgtggcagctcatgtattttcatagacgcgacctgcggcttgccgcgaatgccatttgtagcgctgtgcccgttgattggatcccgacatccagaaccacgtggtctattcacgcccatcaccagtggatgaccacagaagacatgctgagcgtgtggaaccgggtctggatcgaggaaaatccttggatggaggataagacccatatctccagctggggagacgtgccctacctcggcaaaagagaggaccaatggtgcgggtctctgattggacttacagcccgcgctacctgggccacaaacatccaggttgcgattaatcaggtgcggagactgatcggcaacgaaaattacctcgattatatgacctccatgaagcgcttcaaaaacgagagcgaccccgaaggggctctgtggtga

SEQ ID NO: 18880 - RNA, 9879 nt, synthetic construct
  misc_feature 1..9879: note = derived and/or modified CDS sequence (opt5) from DENV-1__FJ024455__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgttggcgtgaacatgtgcacccttattgccatggacctgggggaactctgtgaagatacaatgacctacaaatgcccccgcatcacagagaccgaacccgacgatgtggactgttggtgcaatgccacggatacctgggtcacatatggaacctgttcccaaacaggcgagcacagacgggacaagcgctctgtggctctggcccctcatgttgggctgggactcgagaccagaacggaaacatggatgagctccgagggcgcctggaaacagattcagcgggtggaaacctgggctctgcgccaccccggcttcacagtcatcgccctttttctggctcatgccattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtcccacccaaggagaggccacactggtggaagaacaagacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggctctttcaaactcgagaaggaactggccgagacccagcacggaacagtgctggttcagattaagtacgagggcaccgacgctccgtgcaaaatccctttctccacacaagatgaaaagggggtgacgcagaacggacggcttatcaccgccaatcccattgtcacagacaaagagaagcctgtgaacatcgaagcggagccgccctttggcgagagctatattgtgatcggggctggagaaaaagccctcaagctgtcttggttcaagaaaggcagctccattgggaagatgtttgaggccaccgctagaggcgcccgccggatggctatcctgggagatacagcctgggacttcggctctatcgggggagtttttaccagcgtcggcaaactcgtgcatcagattttcgggacggcgtacggagtgctgttttccggcgtcagctggaccatgaagatcgggattggcgtgcttctgacatggctcggactcaattctagatccaccagcctgtctatgacatgtatcgccgttggccttgtgaccctctacctgggggtcatggtgcaggctgattccggatgcgttattaactggaaaggccgcgaactgaagtgtgggagcggaatcttcgtgacaaatgaggtccacacctggacggaacaatataagtttcaggccgactcccctaaacggctctctgctgccattggcaaggcgtgggaggagggggtgtgcggcatcagaagcgccacacgcctggaaaacatcatgtggaaacagatttccaacgagcttaatcatatcctgctcgaaaacgacatgaagttcaccgttgtggtcggagatgtggctggcattctggcccaggggaaaaagatgatccggccgcaacccatggagtacaaatattcttggaaaagctggggaaaggctaagattatcggcgccgacgtgcagaataccacatttatcattgatgggcctaacacccccgaatgtcctgacgatcagagagcctggaatatctgggaggtcgaggactacggattcggcatttttacgacaaacatctggctgaaacttcgcgattcctatacccaggtttgcgaccaccggctcatgagcgctgcgattaaagattctaaggccgtgcacgctgacatgggctactggatcgaatccgagaaaaatgaaacatggaagctggccagagccagcttcatcgaggtgaagacctgtatttggcccaaatctcatacactgtggtccaacggggtcctcgaaagcgagatgatcattccgaagatctatggaggccctatttctcaacacaattaccgccccgggtacttcacccagacggctggaccttggcatctgggcaaacttgagctggattttgacctctgcgaagggaccacagtggttgtggatgagcactgcggaaaccggggccccagcctgagaaccacaaccgtcacgggcaagatcatccacgaatggtgttgccggtcctgtacactgcctccccttcgcttcagaggggaggacggatgctggtatggcatggagattcggccggtgaaagaaaaggaggaaaatctcgttaagagcatggtgtctgccgggtccggagaggtcgacagcttttccctgggcctgctctgtatctctattatgatcgaagaggtgatgagaagccgctggtcccggaaaatgctgatgaccgggacacttgcggttttctttctgctcattatgggacagctgacctggaacgatctgatcagactttgcattatggtgggcgctaatgcctctgaccgcatgggcatggggaccacatacctggccctcatggctacgttcaagatgagacctatgtttgccgtcggactgctgttccggcgcctgaccagcagagaggtgcttctgctcacaatcggcctgtccctggtggcgtctgtcgaacttcccaacagcctggaggaactcggggatggactggctatgggcatcatgattctcaaactgcttaccgactttcaatcccatcagctgtgggccacactcctgagcctgaccttcatcaagacgacattttctcttcactatgcctggaaaaccatggctatggttctgtccattgtgagcctcttccccctgtgtctctctaccacatcccagaagaccacatggctgcctgtgcttctggggagcctgggatgcaagccgctcacgatgtttctgatcgccgagaataaaatttggggccggcgctcttggccccttaacgaaggcatcatggctgtcgggatcgtgtccattctgctcagctccctgctcaagaacgatgttcctctggccggaccccttatcgcgggcgggatgctgattgcctgttacgtgatcagcggatctagcgctgacctgtccctcgagaaagccgctgaggtctcttgggaagaggaagccgagcatagcggcgcctcccacaatattctggtggaagttcaggatgacgggaccatgaagatcaaagatgaggagagagacgatacacttaccatcctgctcaaggctacactgctcgcggtgtctggagtctatcctctgagcattcccgccacccttttcgtgtggtacttctggcagaagaagaagcagcggtccggcgtcctgtgggacacgccttctcccccggaagtggagcgcgctgttctggatgacggcatctatagaattatgcagcgggggctcctgggacgcagccaggtgggcgtcggggtgtttcaagaaaacgttttccataccatgtggcacgtgacaagaggagccgtccttatgtaccagggcaaacggctggagccttcctgggccagcgtgaagaaagacctcatctcttacgggggaggctggagactgcagggctcctggaataccggggaggaagtgcaggttattgctgtcgagcccggaaagaaccctaaaaatgtgcaaacagcccccggcacctttaagacaccggaaggggaggtgggagcgatcgctctcgatttcaagcctggcacgagcgggtctcccattgtcaaccgcgaaggaaaaatcgtgggcctgtatggcaatggggttgtgaccacatccggaacctacgtcagcgccatcgcccaggctaaggcctcccaggagggccctccgcccgagattgaagacgaggtgtttcggaaaagaaaccttaccatcatggatctgcaccctgggtctggaaagacacgccggtatctgccggcgattgttagagaagctatcaaacgcaagctccggacgctgattcttgcccccaccagagtggtcgccagcgagatggctgaagccctgaagggcatgcctatccgctaccaaacaaccgctgtgaaatccgagcatacagggaaggagatcgttgacctcatgtgccacgccaccttcacgatgcggctgctgagccccgtgagagtccctaattataacatgattatcatggatgaagcgcattttacagacccctcttccattgccgctcggggctacatcagcacccgcgtgggaatgggcgaggccgctgccattttcatgaccgccacacctccggggtctgtggaggcttttccccagagcaatgcggtcatccaggatgaggaaagagacatccctgagcggtcctggaactctggatatgagtggattaccgatttccccggcaaaacagtttggtttgtgcctagcatcaagtccgggaatgacattgccaactgtctccgcaaaaatggaaagagagtgatccagctttctcggaagaccttcgatacggaataccagaagacaaagaacaacgactgggactacgtcgtgaccacagatattagcgagatgggcgctaatttcagagccgaccgcgttatcgatccccggagatgcctgaaaccggtgattctgaaggacgggcctgaacgcgtcatcctcgccggccccatgcccgtgaccgttgcttccgccgcgcagcggagaggacgcatcggccggaaccacaataaagagggggatcagtatatttacatgggacagcctctgaacaatgacgaggatcatgctcactggacggaagccaagatgcttctggacaacatcaatacccccgagggcattatccctgccctctttgaaccggagagagaaaagagcgctgccattgatggggagtatcgcctgagaggagaggcgcggaaaacattcgtggaactgatgcgcagaggcgacctccccgtctggctttcttacaaggtggcctccgaggggtttcaatatagcgatcggcgctggtgcttcgacggcgaaagaaacaatcaggtcctggaggaaaacatggatgtggagatctggaccaaagagggagaacggaagaaactgagacctcgctggctcgacgctcggacatactccgaccccctggcccttagagagtttaaggagttcgctgccggccgccggtctgttagcggggatctgatcctcgagattggaaaactgcctcagcacctgacccagagagctcaaaatgccctcgacaaccttgtgatgctgcataattccgaacagggcgggcgggcgtatcgccacgccatggaggagctgcccgatacaatcgaaaccctcatgctgcttgctctgattgccgtgctcacgggaggcgtcacactgtttttcctgtctggcagagggctcggaaagaccagcatcggccttctgtgtgttatggcttccagcgtgctgctctggatggcctctgtggagccgcattggattgccgcttccatcatcctggaatttttccttatggtcctgctcattcctgagcccgaccggcagcgcacccctcaggataaccaactggcgtacgtggttatcgggctgctctttatgattcttacagtggccgctaatgagatgggactgctggaaaccacaaagaaagacctcggcatcgggcacgtcgccgtggagaaccaccatcacgccgctatgctggatgtcgaccttcatcccgccagcgcgtggacgctgtacgccgtggctaccacaattatcacccctatgatgagacacacaattgaaaacaccacggccaatatctctctcaccgctatcgccaaccaggcggccattctgatgggactggataagggctggcccatctccaaaatggacattggcgttccgctccttgctctggggtgctatagccaggtgaatcctctgacactcaccgccgctgtcctgatgcttgtggcccattacgctatcattggacccggcctgcaagccaaggcgacacgggaggcccagaaacgcaccgctgccgggatcatgaagaaccccacggttgatggaatcgtggctattgacctcgatcctgtcgtgtatgacgccaagttcgaaaaacagctgggccagatcatgctgctcattctttgtacatctcaaatcctgctgatgagaaccacatgggccctctgcgagagcattaccctggcgaccgggccgcttacaacgctgtgggagggatcccccggcaagttttggaataccacaatcgctgtgtctatggccaacatcttccggggcagctacctcgctggggccggactggccttctccctgatgaaaagcctcggcgggggacgcagaggcaccggggctcagggagaaacacttggcgagaagtggaaacggcagctgaatcagctgtccaagtctgaatttaacacctataagagaagcggcattatggaggttgaccgctccgaagccaaagaggggctcaagcggggagagacgacaaaacacgcggtctctagaggcaccgccaagctgcgctggttcgtggaacggaatcttgtgaaacctgaggggaaggtcatcgatctgggatgtggcagagggggatggagctactattgcgctggcctcaagaaagttaccgaagtgaagggctacacaaaagggggacccggccacgaggaacctattcccatggccacctacgggtggaacctggtgaagctgcattccggaaaagacgtctttttcatccctccggagaagtgtgatacactcctttgcgacattggcgagtctagccccaatcctacgatcgaagaggggcgcaccctgcgggtgctgaaaatggttgaaccctggctcagaggaaaccaattttgtattaagatcctgaatccttatatgccctccgtggtcgagacacttgagcagatgcagcgcaagcacggcggcatgctggtgcggaacccgctcagcagaaattctacccatgaaatgtactgggtttcctgcgggacaggaaacatcgtgagcgctgtcaatatgacctctcgcatgctgctgaaccggttcacgatggcccacagaaaacctacctatgagcgcgatgtggacctcggcgcggggacaagacacgtggccgtcgaacccgaggttgctaacctggatattatcggacagcggattgaaaatatcaagcatgagcacaaatccacctggcattacgacgaggataacccctataagacatgggcctaccacggcagctatgaagtgaaaccttctgggtccgctagctccatggtgaatggagtcgtgaaacttctgaccaagccctgggacgttattcctatggtgacacaaatcgccatgaccgatacgacaccgtttggccagcagcgcgtcttcaaagagaaggtggacaccagaacccccaaagctaagcggggcacagcccaaatcatggaagttacggcgaaatggctctgggggtttctgagcagaaacaagaagcctcggatttgtacccgcgaggagttcacaagaaaagtgcggtctaatgccgctatcggagccgtctttgtggacgagaaccagtggaatagcgctaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagcgaaggggtccagagctatttggtacatgtggctgggcgcccggttcctggagttcgaagccctcggatttatgaatgaggatcactggttctctcgcgaaaacagcctgtccggcgtggagggggagggacttcataaactgggctatatcctcagagacatttctaagatccccgggggaaatatgtacgctgatgacacagccggctgggatacccggatcacagaagacgatctgcagaacgaggctcgcattaccgacatcatggaacctgagcacgcccttctggcgaaaagcatttttaagctcacgtatcaaaataaagtcgtgagagttcagcggcccgccaagaacgggaccgtgatggatgtcatctcccgcagagaccagcggggctctggacaggtgggcacatacgggctgaataccttcacaaacatggaagctcaactgattagacagatggagagcgagggaatcttttccccgagcgaactcgagacccctaacctggccgaacgcgtgcttgattggctggagaagtatggcgttgaacggctcaaaagaatggctatctctggggacgactgtgtggtcaagcccattgatgaccgcttcgccacggcgctgacagcccttaatgatatgggaaaagtgcggaaggacatccctcagtgggagccctccaaaggctggaacgattggcagcaagttcctttttgcagccatcacttccaccagctgattatgaaggacgggagagagatcgtggtcccctgtcgcaatcaggatgaactcgtgggccgggctagagtctctcagggagccggctggtccctgcgcgagaccgcttgcctgggaaagagctacgcccaaatgtggcagctcatgtattttcatcggagagacctgcgccttgctgccaacgcgatttgttccgccgtgccggttgattggatccctacatctcggaccacgtggagcattcacgctcatcaccagtggatgaccacagaagacatgctgtccgtgtggaatagagtctggatcgaggaaaacccctggatggaggataaaacccatatcagctcttggggagacgtgccctacctcggcaagcgggaggaccaatggtgcgggtccctgattggacttacagccagagccacctgggctacaaatatccaggttgccattaaccaggtgcgccggctgatcggcaatgaaaactacctcgattatatgaccagcatgaaaagattcaagaatgagtctgaccctgaaggggcgctgtggtga

SEQ ID NO: 18881 - RNA, 9879 nt, synthetic construct
  misc_feature 1..9879: note = derived and/or modified CDS sequence (opt5) from DENV-1__FJ024456__SS-prME
  source 1..9879: mol_type = other RNA
agcgtgaccatgctgctcatgctgatgcccaccgcccttgctttccacctgacgaccagaggcggggaacctcatatgatcgtcacaaagcaggaacggggaaaatccctcctgtttaagacctctgccggcgttaacatgtgcatccttatcgccatggacctgggggaactctgtgaagatacaatgacctacaaatgcccccgcattacagaggctgaacccgacgatgtggactgttggtgcaatgccaccgatacgtgggtgacctatggaacatgtagccaaaccggcgagcaccggcgggacaagcgctccgttgccctggctcctcatgtggggctgggactcgagacaagaaccgaaacgtggatgtctagcgagggcgcctggaaacagatccagcgggttgaaacatgggctctgcgccaccccggcttcaccgtgattgccctttttctggcgcatgccatcgggacatccatcacccagaagggaattatcttcattctcctgatgcttgtcaccccttctatggctatgagatgcgtgggcatcgggagccgggattttgttgagggactgtccggcgccacatgggtggacgtcgtgctcgagcacgggagctgtgtgacgaccatggctaaggataaacccacactggacattgaactgctcaagaccgaggtcacaaaccctgccgttctgcgcaaactttgcatcgaagcgaagatttctaataccacgacagattccagatgtccgacccaaggagaggccaccctgatggaagaacaagacgctaacttcgtgtgccggcgcacatttgtggatagaggctggggcaatgggtgtggactcttcggcaaagggagcctgattacctgcgccaagtttaagtgcgtcacaaaacttgagggaaagatcgtgcagtacgaaaacctgaaatattctgttattgtgacggtccacaccggcgaccagcatcaagtggggaatgagtccacagaacacggaaccacagctaccatcacgccccaggcccctaccagcgagattcagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaatccagacctccggaacaaccacaatttttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaatccctttctccacacaagatgaaaagggggttattcagaacggacggctgatcaccgctaatcccattgtgacagacaaagagaagcctgtcaacatcgaagccgagccgccctttggcgagagctatattgtgatcggggtgggagaaaaagcccttaagctctcttggttcaagaaaggcagctccatcgggaagatgtttgaggctacggccagaggcgctcgccggatggccattctgggagataccgcgtgggacttcggctctatcgggggagtttttacaagcgtcggcaaactggtgcatcagattttcgggaccgcctacggagtgctcttttccggcgtcagctggacaatgaagatcgggattggcgtgctgcttacctggctgggactcaattctagatccacgagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgatcggcaaggcctgggaggagggggtgtgcggcattagaagcgctacacgcctcgaaaacatcatgtggaaacagatttccaacgagctgaatcatatccttctggaaaacgacatgaagttcaccgttgtggtcggagatgtggtgggcattctcgcccaggggaaaaagatgatccggccgcaacccatggagcacaaatactcttggaaaagctggggaaaggctaagatcattggcgccgacgtccagaatacgacatttatcattgatgggcctaacacccccgaatgtcctgacgatcagagagcctggaatatctgggaggttgaggactatggattcggcatttttaccacaaacatctggctgaagctgcgcgattcctacacccaggcttgcgaccaccggcttatgagcgcggccatcaaagattctaaggctgtgcatgccgacatgggctattggattgaatccgagaaaaatgaaacgtggaagctcgccagagctagcttcatcgaggtgaagacatgtatttggcccaaatctcacaccctgtggtccaacggggtcctggaaagcgagatggtgatcccgaagatttacggaggccctatctctcaacataattatcgccccgggtacttcacacagaccgccggaccttggcacctcggcaaactggagcttgattttgacctgtgcgaagggacaaccgttgtggtcgatgagcactgcggaaaccggggccccagcctcagaacgaccacagtgaccggcaagatcattcatgaatggtgttgccggtcctgtacactgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgaccgggacgctggctgtgttccttctgctcatcatgggacagctgacatggaacgatctgattcggctttgcatcatggtcggcgccaatgcctctgacagaatgggcatggggaccacatatctggctctcatggccacctttaaaatgcgccctatgttcgcggtgggactgctctttagacggctgaccagccgcgaggtgcttctgctcacaatcggcctgtccctggtcgcttctgttgaacttcccaacagcctggaggaactcggggatggactggccatgggcattatgatcctcaagctgcttacggacttccaatcccaccagctgtgggccaccctcctgagcctgacatttattaaaaccacactttctctgcattacgcttggaagaccatggccatggtgctctccatcgtgagcctgttccccctctgtctgtctacgacatcccagaagaccacctggcttcctgtcctgctggggagcctcggatgcaaaccgctgacaatgtttcttattgctgagaataagatctggggcagaaaatcttggcccctgaacgaaggcatcatggccgtgggggttgtgtccattctcctgagctccctcctgaagaacgatgtccctcttgcgggacccctgatcgccggcgggatgctgattgcttgttatgtgatcagcggatctagcgccgacctctccctggagaaagctgccgaggtttcttgggaagaggaagccgagcacagcggcgcttcccataatattcttgtggaagtccaggatgacgggaccatgaagatcaaagatgaggagcgggacgatacactgacgatcctcctgaaggcgaccctcctggccgtgtctggagtctaccctcttagcattcccgctacactgttcgtgtggtatttttggcaaaagaaaaagcagcgctccggcgttctgtgggacaccccttctcccccggaagtggagagagccgtcctcgatgacggcatctaccggattatgcagcgcgggctgcttggaagaagccaggtgggcgttggggtgttccaagaaaacgtcttccacacaatgtggcacgtgacccggggagccgtgctgatgtatcagggcaaacgcctcgagccttcctgggctagcgttaagaaagacctgatctcttacgggggaggctggagactccagggctcctggaatacgggggaggaagtccaggtgattgccgtggagcccggaaagaaccctaagaatgtccaaaccgcgcccggcacatttaaaaccccggaaggggaggtgggagctatcgccctggatttcaagcctggcacaagcgggtctcccattgttaaccgggaaggaaaaatcgtgggcctttacggcaatggggtcgtgaccacatccggaacgtatgttagcgccatcgctcaggccaaggcgtcccaggagggccctctgcccgagattgaagacgaggtgtttagaaaacgcaacctgaccatcatggatctccatcccgggtctggaaagacacggagatacctgcctgctattgtccgcgaagccatcaagcggaaacttagaaccctgattctcgccccgacccgcgtggttgctagcgagatggccgaagctctgaagggcatgcccatccggtatcaaacaacggccgtgaaatccgagcacaccgggaaggagatcgtcgacctgatgtgccatgcgacattcaccatgagactccttagccctgtgcgcgtgcccaattacaacatgattatcatggatgaagcccactttacagacccttcttccattgctgcccggggctatatcagcaccagagtcggaatgggcgaggctgccgccattttcatgacggctacaccccctgggtctgttgaagcgtttccgcagagcaatgccgtgatccaggatgaggaacgggacatccccgagcgctcctggaactctggatacgagtggattaccgatttccctggcaaaaccgtgtggtttgtccccagcatcaagtccgggaatgacattgctaactgtctgagaaagaatggaaaacgggtgatccagctgtctcgcaagacattcgataccgaatatcagaagacaaagaacaacgactgggactacgttgtgaccacggatattagcgagatgggcgccaattttagagccgaccgggtcatcgatcctagacgctgcctcaaacccgtgattctgaaggacgggccggaacgggttatccttgctggccctatgcccgtgacagtcgcctccgcggctcagagacgcggacggatcggcagaaaccataataaggagggggatcagtacatttatatgggacagcccctgaacaatgacgaggatcacgcccactggaccgaagccaaaatgctcctggacaacatcaatacacctgagggcattatccccgctctgttcgaacctgagcgcgaaaagagcgccgcgattgatggggagtaccggctcagaggagaggcccgcaaaaccttcgtggaacttatgagacggggcgacctgccggtctggctgtcttataaggtggcttccgaggggtttcaatacagcgatcgcagatggtgcttcgacggcgaacggaacaatcaggttctcgaggaaaacatggatgtggagatctggacgaaagagggagaacgcaagaaactgagaccccggtggcttgacgccagaacctattccgaccctctggctctccgcgagtttaaggagttcgccgctggccggagatctgtgagcggggatctgatcctggagattggaaagctcccccagcatcttacacagcgcgcccaaaatgcgctggacaacctggtcatgctccacaattccgaacagggcgggcgggcctacagacatgctatggaggagctgcctgataccatcgaaacacttatgctgctcgccctgattgctgttctgaccggaggcgtgacactctttttcctttctggccgggggctgggaaaaaccagcatcggcctgctctgtgtgatggcctccagcgtcctgctttggatggcctctgtggagccccactggattgctgcgtccatcatcctggaatttttcctcatggttctgctgattccggagcctgaccgccagagaacgccccaggataaccaactcgcctatgtggtcatcgggcttctgtttatgattctgacagtggctgccaatgagatgggactcctggaaaccaccaagaaagaccttggcatcgggcacgtcgccgtggagaaccatcaccatgctacaatgctggatgttgacctccaccctgccagcgcgtggaccctgtacgccgtggctacaacgattatcacccccatgatgcggcatacaattgaaaacaccacagccaatatctctctgaccgctatcgccaaccaggcggccattctcatgggacttgataagggctggcctatctccaaaatggacattggcgtccccctgctggctctcgggtgctacagccaggtgaatccgctgacgcttaccgccgctgttctgatgctcgtggcccactatgctatcattggacctggcctgcaagccaaggcgacacgcgaggcccagaagagaaccgctgccgggatcatgaaaaaccccacagtcgatggaatcgtggctattgacctggatcccgtggtttacgacgccaagttcgaaaaacagctcggccagatcatgcttctgattctgtgtacctctcaaatcctcctgatgcggacgacatgggccctttgcgagagcattaccctggcgacagggcctctcaccaccctgtgggagggatccccgggcaagttttggaatacaacgatcgctgtctctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatttacaagagaagcggcatcatggaggtggaccggtccgaagccaaagaggggcttaagagaggagagaccacacgccacgcggtgtctcggggcaccgccaaactgagatggttcgtcgaacgcaatctcgttaagcccgaggggaaggtgattgatctgggatgtggcagagggggatggagctattactgcgctggcctgaaaaaggtgacggaagtcaaaggctatacaaaagggggacctggcatggaggaacccatccctatggccaccaacgggtggaatctcgtgaaacttcattccggaaaggacgtctttttcacaccccctgagaaatgtgatacactgctgtgcgacattggcgagtctagcccgaaccccaccatcgaagaggggagaacactccgcgtgctgaagatggtcgaaccttggcttcggggaaatcaattttgtattaagatcctgaacccctacatgccttccgtggttgagacgctcgagcagatgcagagaaaacacggcggcatgctggtgcgcaatcccctgagccggaactctacccatgaaatgtactgggtctcctgcgggacaggaaatatcgtgagcgctgtgaacatgacctctagaatgctcctgaaccgcttcacaatggcccaccggaagccgacctatgagagagatgtcgaccttggcgcggggacgcgccacgttgccgtggaacctgaggtggctaatctggatattatcggacagagaattgaaaacatcaaacatgagcacaagtccacctggcattacgacgaggataatccctataaaacatgggcctaccacggcagctatgaagtcaagccctctgggtccgctagctccatggtgaacggagttgtgaagctcctgaccaaaccttgggacgtcattcccatggtgacacaaatcgccatgaccgatacaaccccttttggccagcagcgggttttcaaggagaaagtggacacgcgcacaccgaaggctaaaagaggcaccgcccaaatcatggaagtcaccgcgcggtggctttgggggtttctgagcagaaataagaagccccggatttgtacacgcgaggagttcacgagaaaagtgcggtctaacgccgctatcggagccgtttttgtggacgagaatcagtggaacagcgctaaggaggccgtcgaagatgagcgcttctgggacctcgtgcagaaagaaagagagctgcataagcagggcaaatgcgcgacctgcgtctacaatatgatggggaagcgggaaaagaaactgggagagtttggcaaggcgaaagggtcccgcgctatttggtatatgtggctcggcgccagattcctggagtttgaagcccttggattcatgaacgaggatcactggttctctcgggaaaatagcctgtccggcgtggagggggagggactccacaagctgggctacatccttcgcgacatttctaaaatccctgggggaaacatgtacgctgatgacacagccggctgggataccagaatcacagaagacgatctgcaaaatgaggctaagattaccgacatcatggaacccgagcatgccctcctggcgacaagcatttttaaactgacctatcagaacaaggttgtgcgggtccagcgccctgccaagaatgggacggtgatggatgtgatctccagacgggaccagcgcggctctggacaagttggcacctacgggctcaacacattcaccaacatggaagctcagctgattagacagatggagagcgagggaatctttcttccctccgaactggagacaccgaatctcgccgaacgggtgctggattggcttgagaaacacggcgtcgaaagactgaagcgcatggctatcagcggggacgactgtgtggttaaacctattgatgaccggttcgccaccgcgctcacggccctgaacgatatgggaaaggtgagaaaagacatcccccagtgggagccttctaagggctggaatgattggcaacaggtccccttttgctcccatcacttccaccagctgattatgaaggacgggcgcgagatcgtggtcccttgtcggaaccaggatgaactcgtgggcagagctcgcgttagccaaggagccggctggtctctgcgggagacagcttgccttgggaaatcctatgcccagatgtggcagctgatgtactttcatagacgcgacctccggctggctgccaatgcgatttgtagcgccgtgcccgtcgattgggtgccgacctccagaacaacctggtctatccacgctcatcaccaatggatgacgaccgaagacatgcttagcgtttggaaccgcgtgtggattgaggaaaatccttggatggaggataagacacatgtctccagctggggagacgtgccctatctgggcaaacgggaggaccagtggtgcgggtctctcatcggactgaccgccagagccacatgggcttccaacatccaggtggccattaatcaggttcggagactgatcggcaacgaaaattacctcgattatatgaccagcatgaagcgcttcaaaaacgagggggaccccgaaggcgcgctgtggtga

SEQ ID NO: 18882 - RNA, 9879 nt, synthetic construct
  misc_feature 1..9879: note = derived and/or modified CDS sequence (opt5) from DENV-1__FJ024457__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtgctcacgggaggcgtcacactgtttttcctgtctggcagagggctcggaaagaccagcatcggccttctgtgtgttatggcctccagcgtgctgctctggatggcctctgtggagccccattggattgctgcgtccatcatcctggaatttttccttatggtcctgctcattccggagcctgaccggcagcgcacaccccaggataaccaactggcctacgtggttatcgggctgctctttatgattcttacagtggctgccaatgagatgggactgctggaaaccacaaagaaagacctcggcatcgggcacgtcgccgtggagaaccaccatcacgctgccatgctggatgtcgaccttcatcctgcgagcgcctggacgctgtacgctgtggccaccacaattatcacccccatgatgagacacacaattgaaaacaccacggctaatatctctctcaccgccatcgcgaaccaggccgctattctgatgggactggataagggctggcctatctccaaaatggacattggcgttcccctccttgccctggggtgctatagccaggtgaatccgctgacactcaccgctgccgtcctgatgcttgtggctcattacgccatcattggacctggcctgcaagcgaaggccacacgggaggctcagaaacgcaccgccgctgggatcatgaagaaccccacggttgatggaatcgtggccattgacctcgatcccgtcgtgtatgacgccaagttcgaaaaacagctgggccagatcatgctgctcattctttgtacatctcaaatcctgctgatgagaaccacatgggcgctctgcgagagcattaccctggctaccgggcctcttacaacgctgtgggagggatccccgggcaagttttggaataccacaatcgccgtgtctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgtggcagagggggatggagctactattgcgccggcctcaagaaagttaccgaagtgaagggctacacaaaagggggacctggccacgaggaacccattcctatggctacctacgggtggaacctggtgaagctgcattccggaaaagacgtctttttcattccccctgagaagtgtgatacactcctttgcgacattggcgagtctagcccgaatcccacgatcgaagaggggcgcaccctgcgggtgctgaaaatggttgaaccttggctcagaggaaaccaattttgtattaagatcctgaatccctatatgccttccgtggtcgagacacttgagcagatgcagcgcaagcacggcggcatgctggtgcggaaccccctcagcagaaattctacccatgaaatgtactgggtttcctgcgggacaggaaacatcgtgagcgccgtcaatatgacctctcgcatgctgctgaaccggttcacgatggcgcacagaaaaccgacctatgagcgcgatgtggacctcggcgccgggacaagacacgtggctgtcgaacctgaggttgccaacctggatattatcggacagcggattgaaaatatcaagcatgagcacaaatccacctggcattacgacgaggataacccctataagacatgggcttaccacggcagctatgaagtgaaaccctctgggtccgccagctccatggtgaatggagtcgtgaaacttctgaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctctgggggtttctgagcagaaacaagaagccccggatttgtacccgcgaggagttcacaagaaaagtgcggtctaatgctgccatcggagctgtctttgtggacgagaaccagtggaatagcgccaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtggagggggagggacttcataaactgggctatatcctcagagacatttctaagatccctgggggaaatatgtacgccgatgacacagctggctgggatacccggatcacagaagacgatctgcagaacgaggcccgcattaccgacatcatggaacccgagcacgcgcttctggccagaagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgatcctggctgaacgggtgcttgattggctggagaagtatggcgttgaaagactcaagcgcatggccatttctggggacgactgtgtggtcaaacctatcgatgaccggttcgcgacggccctgacagctcttaacgatatgggaaaggtgagaaaagacattccccagtgggagccttccaagggctggaatgattggcagcaagttcccttttgcagccatcacttccaccagctgatcatgaaagacgggcgcgagattgtggtcccttgtcggaaccaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaatgccatctgttccgctgtgcccgttgattggattccgacatctagaaccacgtggagcatccacgcccatcaccagtggatgaccacagaagacatgctgtccgtgtggaaccgggtctggatcgaggaaaatccttggatggaggataagacccatattagctcttggggagacgtgccctacctcggcaaaagagaggaccaatggtgcgggtccctgatcggacttacagcccgcgctacctgggccacaaacattcaggttgcgatcaatcaggtgcggagactgattggcaacgaaaattacctcgattatatgaccagcatgaagcgcttcaaaaacgagtctgaccccgaaggggctctgtggtga

SEQ ID NO: 18883 - RNA, 9879 nt, synthetic construct
  misc_feature 1..9879: note = derived and/or modified CDS sequence (opt5) from DENV-1__FJ205881__SS-prME
  source 1..9879: mol_type = other RNA
agcgtgaccatgctgcttctgcttatgcccacagccctggctttccacctgacgaccagaggcggggaacctcatatgatcgtgtccaagcaggaacgggggaaatctctgctttttaagaccagcgccggcgttaacatgtgcaccctgatcgcgatggacctcggggaactgtgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctcggactggagaccagaacggaaacatggatgagctccgagggcgcttggaaacagattcagcgggttgaaacctgggcccttcgccaccccggcttcacagtgatcgctctgtttctcgcccatgcgattgggacctctatcacccagaagggaatcattttcatcctgcttatgctggtcacacctagcatggccatgagatgcgtgggcattgggtcccgggattttgttgagggactcagcggcgctacgtgggtggacgtcgtgctggagcacgggtcttgtgtgaccacaatggccaaggataaacccaccctggacatcgaactcctgaagacagaggtcaccaaccctgctgttcttcgcaaactgtgcattgaagccaagatctccaatacgacaaccgatagcagatgtccgacccaaggagaggcgacactcgtggaagaacaagacgccaacttcgtgtgccggcgcacctttgtcgatagaggctggggcaatgggtgtggactgttcggcaaagggtctcttattacatgcgctaagtttaagtgcgtgacgaaactggagggaaagatcgttcagtacgaaaacctcaaatattccgtgatcgtcaccgtgcacacaggcgaccagcatcaagttgggaatgagagcaccgaacacggaacaaccgccacgattacaccccaagctcctaccaccgagatccagctgacagactacggcgccctgaccctcgattgttctccccggacgggcctggacttcaacgaaatggtgcttctgacaatgaaggagaaatcctggctcgtccataagcagtggtttctggatcttcctctgccctggaccagcggggcctccacatctcaagagacctggaatcgccaggacctcctggtgaccttcaaaacagctcacgcgaagaagcaggaagtcgtggttctgggaagccaagagggcgccatgcacacggctctcaccggggccacagaaattcagacctccggaacaaccacgatctttgccggccatctgaaatgcagacttaagatggataaactgacactcaaggggatgagctatgtgatgtgtaccggctctttcaaactggagaaggaactggctgagacccagcacggaacagtccttgtgcagattaagtacgagggcaccgacgccccgtgcaaaatccctttctccacacaagatgaaaagggggttacgcagaacggacggctcatcaccgcgaatcccattgtgacagacaaagagaagcctgtcaacatcgaagctgagccgccctttggcgagagctatattgtgatcggggccggagaaaaagccctgaagctgtcttggttcaagaaaggcagctccattgggaagatgtttgaggctaccgccagaggcgctcgccggatggccatcctcggagatacagcgtgggacttcggctctatcgggggagtgtttaccagcgttggcaaactggtccatcagattttcgggacggcctacggagtgctcttttccggcgtgagctggaccatgaagatcgggattggcgtcctgctcacatggctgggactcaattctagatccaccagcctttctatgacatgtatcgctgtgggcctcgttaccctgtacctgggggtgatggtccaggccgattccggatgcgtgattaactggaaaggccgcgaactcaagtgtgggagcggaatcttcgttacaaatgaggtgcacacctggacggaacaatataagtttcaggctgactcccctaaacggctgtctgccgcgattggcaaggcctgggaggagggggtctgcggcatcagaagcgctacacgccttgaaaacatcatgtggaaacagatttccaacgagctgaatcatatcctcctggaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggcttaagctccgcgattcctatacccaggtctgcgaccaccggctgatgagcgcggccattaaagattctaaggctgttcacgccgacatgggctactggatcgaatccgagaaaaatgaaacatggaagctggccagagctagcttcatcgaggtgaagacctgtatttggcccaaatctcatacactctggtccaacggggtgctggaaagcgagatgatcattccgaagatctatggaggccctatttctcaacacaattaccgccccgggtacttcacccagacggccggaccttggcatcttggcaaactggagctcgattttgacctgtgcgaagggaccacagtcgtggttgatgagcactgcggaaaccggggccccagcctgagaaccacaaccgtgacgggcaagatcatccacgaatggtgttgccggtcctgtacacttcctcccctccgcttcagaggggaggacggatgctggtatggcatggagattcggccggtcaaagaaaaggaggaaaatctggtcaagagcatggtttctgcggggtccggagaggtggacagcttttccctgggcctcctgtgtatctctattatgatcgaagaggtcatgagaagccgctggtcccggaaaatgcttatgaccgggacactggctgtgttctttctcctgattatgggacagctgacctggaacgatcttatcagactgtgcattatggttggcgccaatgcctctgaccgcatgggcatggggaccacatacctcgctctgatggccacgttcaagatgagacctatgtttgcggtgggactcctgttccggcgccttaccagcagagaggtcctgctcctgacaatcggcctgtcccttgtggcttctgtggaactgcccaacagcctcgaggaactgggggatggactcgccatgggcatcatgattctgaaacttctgaccgactttcaatcccatcagctctgggccacactgctgagccttaccttcatcaagacgacattttctctgcactatgcttggaaaaccatggccatggtcctctccattgttagcctgttccccctctgtctgtctaccacatcccagaagaccacatggcttcctgtgctgctggggagcctcggatgcaagccgctgacgatgtttcttatcgctgagaataaaatttggggccggcgctcttggcccctgaacgaaggcatcatggccgtggggatcgtctccattctcctgagctccctcctgaagaacgatgtgcctcttgcgggacccctgatcgccggcgggatgctgattgcttgttacgttatcagcggatctagcgccgacctctccctggagaaagctgccgaggtgtcttgggaagaggaagccgagcatagcggcgcttcccacaatattcttgtcgaagtgcaggatgacgggaccatgaagatcaaagatgaggagagagacgatacactgaccatcctcctgaaggcgacactcctggccgtttctggagtgtatcctcttagcattcccgctaccctgttcgtctggtacttctggcagaagaagaagcagcggtccggcgtgctgtgggacacgccttctcccccggaagtcgagcgcgccgtgctcgatgacggcatctatagaattatgcagcgggggctgcttggacgcagccaggttggcgtgggggtctttcaagaaaacgtgttccataccatgtggcacgttacaagaggagccgtgctgatgtaccagggcaaacggctcgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcacctttaagacaccggaaggggaggtgggagctatcgccctggatttcaagcctggcacgagcgggtctcccattgtgaaccgcgaaggaaaaatcgtcggcctttatggcaatggggtggttaccacatccggaacctacgtgagcgccatcgctcaggccaagacctcccaggagggccctctgcccgagattgaagacgaggtctttcggaaaagaaacctgacaatcatggatctccaccccgggtctggaaagacgcgccggtatctgcctgcgattgtgagagaagctatcaaacgcaaacttcggaccctgattctcgccccgacaagagttgtggccagcgagatggctgaagccctgaagggcatgcccatccgctaccaaaccacagctgtcaaatccgagcataccgggaaggagatcgtggacctgatgtgccacgccacgttcacaatgcggctccttagccctgttagagtgcccaattataacatgattatcatggatgaagcgcattttaccgacccttcttccattgccgctcggggctacatcagcacccgcgtcggaatgggcgaggccgctgccattttcatgacagccacaccccctgggtctgtggaggcttttccgcagagcaatgcggtgatccaggatgaggaaagagacatccccgagcggtcctggaactctggatatgagtggattacagatttccctggcaaaaccgtctggtttgttcccagcatcaagtccgggaatgacattgccaactgtctgcgcaaaaatggaaagagagtgatccagctgtctcggaagacgttcgatacagaataccagaagaccaagaacaacgactgggactacgtggtcacaaccgatattagcgagatgggcgctaatttcagagccgaccgcgtgatcgatcctcggagatgcctcaaacccgttattctgaaggacgggccggaacgcgtgatccttgccggccctatgcccgtcacggtggcttccgccgcgcagcggagaggacgcatcggccggaaccacaataaagagggggatcagtatatttacatgggacagcccctgaacaatgacgaggatcatgctcactggaccgaagccaagatgctcctggacaacatcaatacacctgagggcattatccccgccctgtttgaacctgagagagaaaagagcgctgccattgatggggagtatcgcctcagaggagaggcgcggaaaaccttcgttgaacttatgcgcagaggcgacctgccggtgtggctgtcttacaaggtcgcctccgaggggtttcaatatagcgatcggcgctggtgcttcgacggcgaaagaaacaatcaggtgctcgaggaaaacatggatgtcgagatctggacaaaagagggagaacggaagaaactgagaccccgctggcttgacgctcggacctactccgaccctctggccctcagagagtttaaggagttcgctgccggccgccggtctgtgagcggggatctgatcctggagattggaaaactcccccagcaccttacacagagagctcaaaatgccctggacaacctggttatgctccataattccgaacagggcgggcgggcgtatcgccacgccatggaggagctgcctgataccatcgaaacgcttatgctgctcgctctgattgccgtgctgacaggaggcgtgaccctctttttcctttctggcagagggctgggaaagaccagcatcggcctgctctgtgtcatggcttccagcgttctgctttggatggcctctgtggagccccattggattgccgcttccatcatcctggaatttttcctcatggtgctgctgattccggagcctgaccggcagcgcacaccccaggataaccaactcgcgtacgtcgtgatcgggcttctgtttatgattctgaccgttgccgctaatgagatgggactcctggaaacaacgaagaaagaccttggcatcgggcacgtggccgtcgagaaccaccatcacgccgctatgctggatgtggacctccatcctgccagcgcgtggaccctgtacgccgtcgctacaaccattatcacacccatgatgagacacaccattgaaaacacgaccgccaatatctctctgacagctatcgccaaccaggcggccattctcatgggacttgataagggctggcctatctccaaaatggacattggcgtgcccctgctggctctcgggtgctatagccaggttaatccgctgacccttacagccgctgtgctgatgctcgtcgcccattacgctatcattggacctggcctgcaagccaaggcgacccgggaggcccagaaacgcacggctgccgggatcatgaagaaccccacagtggatggaatcgttgctattgacctggatcccgtggtctatgacgccaagttcgaaaaacagctcggccagatcatgcttctgattctgtgtacctctcaaatcctcctgatgagaacaacctgggccctttgcgagagcattaccctggcgacagggcctctcacgaccctgtgggagggatccccgggcaagttttggaatacaaccatcgctgtgtctatggccaacatcttccggggcagctacctggctggggccggactcgccttctcccttatgaaaagcctgggcgggggacgcagaggcacaggggctcagggagaaaccctgggcgagaagtggaaacggcagctcaatcagctgtccaagtctgaatttaacacgtataagagaagcggcattatggaggtggaccgctccgaagccaaagaggggcttaagcggggagagacaaccaaacacgcggtttctagaggcaccgccaagctgcgctggttcgtcgaacggaatctcgtgaaacccgaggggaaggtgatcgatctgggatgtggcagagggggatggagctactattgcgctggcctgaagaaagtcacagaagttaagggctacaccaaagggggacctggccacgaggaacccattcctatggccacatacgggtggaacctcgtgaaacttcattccggaaaagacgtgtttttcattccccctgagaagtgtgatacgctgctgtgcgacattggcgagtctagcccgaatcccaccatcgaagaggggcgcacactccgggtcctgaaaatggtggaaccttggcttagaggaaaccaattttgtattaagatcctgaatccctatatgccttccgttgtggagaccctcgagcagatgcagcgcaagcacggcggcatgctggtccggaaccccctgagcagaaattctacacatgaaatgtactgggtgtcctgcgggaccggaaacatcgttagcgctgtgaatatgacgtctcgcatgctcctgaaccggttcaccatggcccacagaaaaccgacatatgagcgcgatgtcgaccttggcgcggggaccagacacgtggccgtggaacctgaggtcgctaacctggatattatcggacagcggattgaaaatatcaagcatgagcacaaatccacatggcattacgacgaggataacccctataagacctgggcctaccacggcagctatgaagttaaaccctctgggtccgctagctccatggtgaatggagtggtcaagctcctgacaaagccttgggacgtgattcccatggttacccaaatcgccatgacggatacaaccccttttggccagcagcgcgtgttcaaagagaaggtcgacaccagaacaccgaaagctaagcggggcacggcccaaatcatggaagtgaccgcgaaatggctttgggggtttctgagcagaaacaagaagccccggatttgtacacgcgaggagttcaccagaaaagttcggtctaatgccgctatcggagccgtgtttgtcgacgagaaccagtggaatagcgctaaggaggccgtggaagatgagcgcttctgggacctcgttcatagagaacgggagctgcacaaacagggcaagtgcgccacatgcgtgtacaacatgatggggaaacgcgaaaagaagctgggagagtttggcaaagcgaaggggtccagagctatttggtacatgtggctcggcgcccggttcctggagttcgaagcccttggatttatgaatgaggatcactggttctctcgcgaaaacagcctgtccggcgtcgagggggagggactccataaactgggctatatccttagagacatttctaagatccctgggggaaatatgtacgctgatgacaccgccggctgggatacacggatcaccgaagacgatctgcagaacgaggctcgcattacggacatcatggaacccgagcacgccctcctggcgaaaagcatttttaagctgacctatcaaaataaagtggtcagagtgcagcggcctgccaagaacgggacagttatggatgtgatctcccgcagagaccagcggggctctggacaggtcggcacctacgggctcaatacattcaccaacatggaagctcaactgattagacagatggagagcgagggaatcttttcccccagcgaacttgagacgccgaacctggccgaacgcgtgctcgattggctggagaagtatggcgtggaacggcttaaaagaatggctatctctggggacgactgtgttgtgaagcctattgatgaccgcttcgccacagcgctgaccgccctcaatgatatgggaaaagtccggaaggacatcccccagtgggagccttccaaaggctggaacgattggcagcaagtgcccttttgcagccatcacttccaccagctgattatgaaggacgggagagagatcgttgtgccttgtcgcaatcaggatgaactggtcggccgggctagagtgtctcagggagccggctggtccctccgcgagacagcttgcctgggaaagagctacgcccaaatgtggcagcttatgtattttcatcggagagacctgcgcctcgctgccaacgcgatttgttccgccgtccccgtggattggatcccgacctctcggacgacctggagcattcacgctcatcaccagtggatgacaaccgaagacatgctgtccgtttggaatagagtgtggatcgaggaaaacccttggatggaggataaaacacatatcagctcttggggagacgtcccctaccttggcaagcgggaggaccaatggtgcgggtccctgattggactcaccgccagagccacatgggctaccaatatccaggtggccattaaccaggttcgccggctgatcggcaatgaaaactacctggattatatgacgagcatgaaaagattcaagaatgagtctgaccccgaaggggcgctctggtga

SEQ ID NO: 18884 - RNA, 9879 nt, synthetic construct
  misc_feature 1..9879: note = derived and/or modified CDS sequence (opt5) from DENV-1__FJ205882__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgttccccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagcccccctttggcgagtcttatattgtgatcggggccggagaaaaagctcttaagctcagctggttcaagaaaggctcctctattgggaagatgtttgaggccaccgctagaggcgcccgccggatggcgatcctgggagatacagcctgggacttcggcagcatcgggggagtttttacctccgtcggcaaactggtgcatcagattttcgggacagcttacggagtgctctttagcggcgtctcttggaccatgaagatcgggattggcgtgctgcttacgtggctgggactcaattccagaagcacctctctgtccatgacatgtatcgccgttggcctggtgaccctttacctcggggtcatggtgcaggctgatagcggatgcgttattaactggaaaggccgcgaactgaagtgtgggtccggaatcttcgtgacaaatgaggtccacacctggacagaacaatataagtttcaggccgactctcctaaacggctgagcgcggccattggcaaggcttgggacgagggggtgtgcggcatcagatccgccacccgcctcgagaacatcatgtggaaacagatttctaacgaactgaatcatatccttctggagaacgatatgaagttcacggttgtggtcggagacgtggctggcattctcgcccaggggaaaaagatgatccggccgcaacccatggaatacaaatatagctggaagtcctggggaaaggccaaaattatcggcgctgatgtgcagaatacaacctttatcattgacgggcctaacacccccgagtgtcctgatgaccagagagcgtggaatatctggaaggtcgaagatcacggattcggcatttttcccacaaacatctggctgaaactgcgcgacagctacacccaggtttgcgatcaccggcttatgtctgccgctattaaggactccaaagccgtgcatgccgatatgggctattggatcgagagcgagaagaatgaaacgtggaagctcgctagagcctctttcatcgaggtgaaaacatgtatttggccgaagtcccacaccctgtggagcaacggggtcctggaatctgagatgatcattcctaaaatctacggaggccccattagccaacataattatcgccctgggtacttcacacagaccgcgggaccctggcacctcggcaagctggaacttgactttaacctgtgcgaggggacaaccgtggttgtggatgagcactgcggaaatcggggcccttccctcagaacgaccacagtcaccggcaaaatcatccatgaatggtgttgccggagctgtacactgcccccgctgcgcttcaagggggaggacggatgctggtacggcatggaaattagacctgtgaaggagaaagaggaaaaccttgttaagtctatggtgtccgctgggagcggagaggtcgactccttttctctcggcctgctgtgtatcagcattatgatcgaagaggtgatgcggtccagatggtctcgcaaaatgctcatgaccgggacgctggccgttttctttcttctgattatgggacagctcacatggaatgatctgatccggctgtgcattatggtgggcgccaacgctagcgacagaatgggcatggggaccacatatcttgccctgatggcgaccttcaagatgcgccccatgctcgctgtcggactgctctttagacggctgacctcccgcgaagtgcttctgctcacaatcggcctgtctctggtggccagcgtcgagcttcccaattccctggaggaactcggggatggactggccatgggcatcatgattctcaaactgcttacggacttccaaagccaccagctgtgggctaccctcctgtctctgacatttatcaagaccacatactcccttcattatgcctggaagaccatggctatggttctgagcattgtgtctctcttccctctgtgtctctccacgacaagccagaaaaccacctggctgccggtgcttctggggtctctgggatgcaagcccctcacaatgtttctgatcgccgagaacaaaatttggggcagaaagtcctggcctcttaacgaaggcatcatggcggtcgggatcgtgagcattctgctctccagcctgctcaaaaatgatgttcccctggccggacctcttatcgctggcgggatgctgattgcctgttacgtgatctctggaagctccgctgacctgtctctcgagaaggccgccgaagtcagctgggaggaggaagctgagcactccggcgcgtctcataacattctggtggaagttcaggatgacgggaccatgaaaatcaaggatgaggaacgggacgatacacttacgatcctgctcaaggccaccctgctcgctgtgagcggagtctatcccctgtccattcctgccacacttttcgtgtggtacttttggcaaaaaaagaaacagcgctctggcgtcctgtgggacacccccagcccgcctgaggtggagagagccgttctggatgacggcatctatcggattatgcagcgcgggctcctgggaagatcccaggtgggcgtcggggtgttccaagaaaatgttttccacacaatgtggcacgtgacccggggagctgtccttatgtaccagggcaagcgcctggagcccagctgggcctctgtgaaaaaggacctcatctcctacgggggaggctggagactgcagggcagctggaacacgggggaagaggtgcaggttattgcggtcgagcctggaaagaatcccaaaaacgtgcaaaccgctccgggcacatttaagacctctgaaggggaggtgggagccatcgccctcgatttcaaacctggcacatccgggagccccattgtcaatcgggaaggaaagatcgtgggcctgtatggcaacggggttgtgaccacatccggaacgtacgtctctgctatcgcccaggcgaaagctagccaggagggccctcttcccgaaattgagaatgaggtgtttagaaagcgcaacctgaccatcatggacctgcatcccgggtccggaaagacacggagatatctccctgccattgttcgcgaagccatcaaacggaagctgagaacccttattctggctccgacccgcgtggtcgccagcgagatggctgaagccctcaaaggcatgcccatccggtaccaaacaacggcggtgaagtctgagcacaccgggaaagaaatcgttgatctgatgtgccatgccacattcaccatgagactgctctcccctgtgcgcgtccccaattataacatgattatcatggacgaggctcactttacagatcctagctctattgccgctcggggctacatcagcaccagagtgggaatgggcgaggccgccgctattttcatgacggcgacaccccctgggtccgtggaagcctttccgcagtctaatgctgtcatccaggacgaggaacgggatatccccgagcgcagctggaactccggatatgaatggattaccgacttccctggcaagaccgtttggtttgtgccctctatcaagagcgggaatgatattgccaactgtcttagaaaaaacggaaagcgggtgatccagctgtcccgcaaaacattcgacaccgagtaccaaaagacaaaaaataacgattgggactacgtcgtgaccacggacattagcgagatgggcgccaattttagagctgatcgggttatcgaccctagacgctgcctgaagcccgtgattctcaaggatgggccggaacgggtcatcctggccggccctatgcccgtgacagttgcgtctgctgcccagagacgcggacggatcggcagaaaccataataaagagggggaccagtatatttacatgggacagccccttaacaatgatgaagaccacgcccactggaccgaggctaagatgctgctcgataacatcaatacacctgagggcattatccccgccctgttcgaacctgagcgcgaaaaatccgcggccattgacggggagtatcggctgagaggagaagctcgcaagaccttcgtggagctcatgagacggggcgatcttccggtctggctgagctacaaagtggcctccgaggggtttcaatattctgaccgcagatggtgcttcgatggcgaacggaacaatcaggtcctggaggaaaacatggacgtggagatctggacgaaggaaggagagcgcaaaaagctcagaccccggtggctggatgctagaacctacagcgaccctcttgccctgcgcgagtttaaggaattcgctgccggccggaaatccgtttctggggacctcatcctggagattggaaagctgccccagcatctcacacagagagcgcaaaatgcccttgataacctggtgatgctgcacaatagcgaacagggcgggcgcgcttatcggcatgccatggaggaactccctgacaccatcgagacactgatgcttctggctctcattgccgtgctgaccggaggcgtcacactgtttttcctctccggcagagggcttggaaaaaccagcatcggcctgctgtgtgttatggcctcttccgtgctcctgtggatggctagcgtggagccccactggattgcggcctctatcatccttgaatttttcctgatggtcctcctgattccggagcctgatcggcagcgcacgccccaggacaaccaactggcttacgtggttatcgggctcctttttatgattctgacagtggccgccaacgaaatgggactgctcgagaccaccaagaaagatctgggcatcgggcacgtcgctgtggagaatcatcaccatgccgcgatgcttgacgtcgatctgcaccctgcctccgcttggacactctacgccgtggctaccacaattatcacgcccatgatgagacataccattgaaaacacaaccgccaatatcagcctgacagcgatcgccaaccaggctgccattctgatgggactcgacaagggctggcctatctctaagatggatattggcgttccccttctggctctggggtgctatagccaggtgaatccgctcaccctgacggccgctgtccttatgctggtggcccactacgcgatcattggacctggcctccaagccaaagctacccgggaggcccagaagcgcacagctgccgggatcatgaaaaaccccaccgttgacggaatcgtggccattgatctggaccccgtcgtgtatgatgcgaagttcgaaaaacagctgggccagatcatgctccttattctgtgtacatcccaaatcctgctcatgagaaccacgtgggctctgtgcgagtctattacacttgccaccgggcctctgacaaccctctgggaaggaagcccgggcaagttttggaataccacaatcgctgtgtccatggccaacatcttccggggcagctacctggccggggctggactggccttttccctcatgaagtctcttggcgggggacgcagaggcacgggggcgcagggagagaccctgggcgagaaatggaagcggcagctgaatcagctcagcaaatccgaattcaacacatataagcgctctggcattatggaggttgacagaagcgaagccaaagaggggctgaagcggggagaaaccacaaagcacgctgtctccagaggcaccgccaaacttcgctggttcgtggagcggaatctggtgaagcccgaggggaaagtcatcgacctcggatgtggcagagggggatggtcttactattgcgctggcctgaagaaagttacggaagtgaagggctacacaaaagggggacctggccatgaggaacccattcctatggccacctacgggtggaacctggtgaagctccacagcggaaaggatgtctttttcatcccccctgagaaatgtgacacccttctgtgcgatattggcgaatccagcccgaatcccacaatcgaggaggggcgcaccctgcgggtgctcaagatggttgaaccttggctgagaggaaaccaattttgtattaaaatccttaatccctatatgccttctgtggtcgagacactggaacagatgcagcgcaagcatggcggcatgctcgtgcggaaccccctgtccagaaatagcacgcacgagatgtactgggtttcttgcgggaccggaaacatcgtgtccgcggtcaacatgacaagccgcatgctgctcaatcggttcaccatggcccacagaaaaccgacatatgagcgcgacgtggatctgggcgctgggacccggcatgtggccgtcgaacctgaggttgctaaccttgacattatcggacagagaattgaaaatatcaagcacgagcataagtctacgtggcactacgatgaagacaacccctataaaacctgggcctaccatggctcctatgaggtgaagcccagcgggtccgctagctctatggtgaatggagtcgtgaaactgctcacaaagccttgggatgttattcccatggtgacccaaatcgccatgacagacaccacaccttttggccagcagcgcgtcttcaaagagaaggtggataccagaacgccgaaggcgaaacggggcacagcccaaatcatggaagttaccgctaagtggctgtgggggtttcttagccgcaacaaaaagcccagaatttgtacccgggaggaattcacaagaaaagtgcggtccaatgccgctatcggagccgtctttgtggacgagaaccagtggaattctgccaaggaagcggttgaggacgagcgcttctgggatctggtgcacagagaacgggagctccacaagcagggcaaatgcgctacgtgcgtctacaacatgatggggaagcgcgaaaaaaagctgggagagtttggcaaagccaaggggagcagagccatttggtacatgtggctgggcgctcggttcctcgaatttgaggccctgggattcatgaatgaggaccattggttctcccgcgaaaactctcttagcggcgtggagggggaaggactgcacaaactcggctatatcctgagagatatttccaagatccctgggggaaatatgtacgctgacgataccgccggctgggacacacggatcaccgaggatgaccttcagaacgaggcgaagattacagatatcatggaacccgagcatgccctgctcgctaaatctatttttaagctgacctatcaaaataaagtcgtgcgcgttcagagacctgccaagaacgggacagtgatggacgtcatcagccggcgcgatcagagaggctccggacaggtgggcacctacgggctgaacacgttcaccaatatggaagctcaactcattcggcagatggagagcgaaggaatcttttctccctccgagctggagacaccgaaccttgccggccgcgtgctggactggctcgaaaaacacggggttgagagactgaagcggatggcgatcagcggagatgactgtgtggtcaagcctattgacgatagattcgccaccgctcttacagccctgaatgacatgggcaaagtgcgcaaggatatcccccagtgggaaccttctaaagggtggaacgactggcagcaagttcccttttgctcccaccatttccaccagctcattatgaaggatggccgggagatcgtggtcccttgtagaaatcaggacgaactggtgggacgcgctcgggtcagccagggcgccgggtggtccctgagagagaccgcttgcctcggaaaatcttatgcccaaatgtggcagctgatgtactttcatcgccgggatcttagactggcggccaacgctatttgtagcgccgtgcccgttgactgggtgccgacgtcccgcacaacctggagcatccacgcccatcaccagtggatgacaaccgaggatatgctctctgtctggaatcgggtgtggattgaagagaacccttggatggaagacaagacgcacatctccagctggggcgatgttccctatctggggaagagagaggaccaatggtgcggatctcttatcggcctgaccgctcgcgccacatgggcgaccaatattcaggtggctatcaaccaggtccggagactcattgggaatgaaaactacctggactacatgacaagcatgaaacggttcaagaatgagtccgatcccgagggcgccctgtggtga

SEQ ID NO: 18885 - RNA, 9879 nt, synthetic construct
  misc_feature 1..9879: note = derived and/or modified CDS sequence (opt5) from DENV-1__FJ390388__SS-prME
  source 1..9879: mol_type = other RNA
agcgtgaccatgctgctcatgctgatgcccacggcccttgctttccacctgacgacccggggcggggagcctcatatgattgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttatgacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagttcaccgtggttgtgggagatgtcgccggcattctcgctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaagctgcgcgattcctacacccaggtctgcgaccaccggcttatgagcgcggccattaaagattctaaggctgttcatgccgacatgggctattggatcgaatccgagaaaaatgaaacatggaagctcgccagagctagcttcatcgaggtgaagacctgtatttggcccaaatctcacacactgtggtccaacggggtgctggaaagcgagatgatcattccgaagatctacggaggccctatttctcaacataattatcgccccgggtacttcacccagacggccggaccttggcacctcggcaaactggagcttgattttgacctgtgcgaagggaccacagtcgtggttgatgagcactgcggaaaccggggccccagcctcagaaccacaaccgtgacgggcaagatcatccatgaatggtgttgccggtcctgtacactgcctcccctgcgcttcagaggggaggacggatgctggtacggcatggagattcggccggtcaaagaaaaggaggaaaatcttgtcaagagcatggtttctgcggggtccggagaggtggacagcttttccctcggcctgctgtgtatctctattatgatcgaagaggtcatgagaagccgctggtcccggaaaatgctcatgaccgggacactggctgtgttctttcttctgattgttggacagctcacctggaacgatctgatcagactgtgcattatggtgggcgccaatgcctctgaccgcatgggcatggggaccacatatcttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccaccagctttgggccacactgctcagcctgaccttcatcaagacgacattttctctgcattacgcttggaaaaccatggccatggttctttccgtggtgagcctgttccccctctgtctgtctaccacatcccagaagaccacatggctccctgtcctgcttgggagcctgggatgcaagccgctgacgatgtttctcattgctgagaataaaatctggggccggcgctcttggcccctgaacgaaggcattatggccgtggggatcgtttccatccttctgagctccctcctgaagaacgatgtgcctctcgcgggacccctgattgccggcgggatgcttatcgcttgttatgtcattagcggatctagcgccgacctgtccctggagaaagctgccgaggtgtcttgggaagaggaagccgagcacagcggcgcttcccataatatcctcgttgaagtgcaggatgacgggaccatgaagattaaagatgaggagagagacgatacactgaccatccttctgaaggcgacactcctggccgtctctggagtgtaccctctcagcatccccgctaccctgttcgtctggtatttctggcagaagaagaagcagcggtccggcgtgctttgggacacgccttctcccccggaagttgagcgcgccgtgctggatgacggcatttacagaatcatgcagcgggggctgctcggacgcagccaggtcggcgtgggggtttttcaagaaaacgtgttccacaccatgtggcacgtcacaagaggagccgtgctgatgtatcagggcaaacggcttgagccttcctgggctagcgtgaagaaagacctgatttcttacgggggaggctggagactccagggctcctggaataccggggaggaagttcaggtcatcgccgtggagcccggaaagaaccctaaaaatgtgcaaacagcgcccggcacctttaagacaccggaaggggaggtcggagctattgccctggatttcaagcctggcacgagcgggtctcccatcgtgaaccgcgaacggaaaattgttggactctacggcaatggcgtggtcaccacatccgggacctatgtgagcgccatcgctcaggccaaggcgtcccaggagggacctctgcccgagatcgaagacgaggtttttagaaaacgcaaccttaccattatggatctgcatcccggctctgggaagacacggagatacctgcctgctatcgtgcgcgaagccattaaacggaagctcagaacgctgatccttgccccgacccgcgtcgtggctagcgagatggccgaagctctgaagggaatgcccattcggtatcaaacaaccgccgttaaatccgagcacacaggcaaggagatcgtggacctcatgtgccatgcgaccttcacgatgagactgctgagccctgtccgggtgcccaattacaacatgatcattatggatgaagcccactttacagacccttcttccatcgctgcccgcgggtatattagcaccagagtgggcatgggagaggctgccgccatcttcatgaccgctacaccccctggctctgtcgaagcgtttccgcagagcaatgccgttattcaggatgaggaacgggacatccccgagcgctcctggaactctgggtacgagtggatcaccgatttccctggaaaaacagtgtggtttgtgcccagcattaagtccggcaatgacatcgctaactgtctccgcaaaaatgggaagcgggtcattcagctttctagaaagaccttcgatacggaatatcagaaaaccaagaacaacgactgggactacgtggttaccacagatatcagcgagatgggagccaatttccgcgccgaccgggtgattgatcctagacgctgcctgaaacccgtcatcctgaaggacggcccggaacgggtgattctcgctgggcctatgcccgttaccgtggcctccgcggctcagagacgcggccggatcggaagaaaccataataaagagggcgatcagtacatctatatggggcagcccctgaacaatgacgaggatcacgcccactggacggaagccaagatgcttctggacaacattaatacccctgagggaatcattcccgctctctttgaacctgagcgcgaaaagagcgccgcgatcgatggcgagtacagactgagaggggaagcccgcaaaacattcgtcgaactgatgagacggggagacctcccggtgtggctttcttataaggtcgcttccgagggctttcaatacagcgatcgcagatggtgcttcgacggggaacggaacaatcaggtgctggaggaaaacatggatgttgagatttggaccaaagagggcgaaagaaagaaactgcgcccccggtggctcgacgccagaacatattccgaccctctggctcttagagagtttaaggagttcgccgctggacggagatctgtgagcggcgatctgatcctcgagatcgggaaactgccccagcatctgacccagcgggcccaaaatgcgctcgacaaccttgtgatgctgcacaattccgaacagggaggccgcgcctacagacatgctatggaggagctgcctgatacaattgaaaccctcatgctgcttgccctgatcgctgtcctcacaggcggggttacactgtttttcctgtctgggcggggcctcgggaagaccagcattggacttctgtgtgtgatggcctccagcgtgctgctctggatggcctctgtcgagccccactggatcgctgcgtccattatcctggaatttttccttatggtgctgctcatcccggagcctgaccgccagagaacaccccaggataaccaactggcctatgttgtgattggcctgctctttatgatccttacagtcgctgccaatgagatggggctgctggaaaccacaaagaaagacctcggaattggccacgtggccgtcgagaaccatcaccatgctgccatgctggatgtggaccttcaccctgcgagcgcctggacgctgtacgctgttgccaccacaatcattacccccatgatgcggcatacaatcgaaaacaccacggctaatatttctctcaccgccatcgcgaaccaggccgctatcctgatggggctggataagggatggcctatttccaaaatggacatcggcgtgcccctccttgccctgggctgctacagccaggtcaatccgctgacactcaccgctgccgtgctgatgcttgttgctcactatgccattatcgggcctggactgcaagcgaaggccacacgcgaggctcagaaaagaaccgccgctggcattatgaagaaccccacggtggatgggatcgtcgccatcgacctcgatcccgtggtgtacgacgccaagttcgaaaaacagctgggacagattatgctgctcatcctttgtacatctcaaattctgctgatgcggaccacatgggcgctctgcgagagcatcaccctggctaccggccctcttacaacgctgtgggaggggtccccgggaaagttttggaataccacaattgccgtttctatggctaacatcttccgcggcagctatctcgccggcgccgggctggctttctccctgatgaaaagcctcggaggcgggagacggggaaccggcgcccagggggaaacacttggagagaagtggaaaagacagctgaatcagctgtccaagtctgaatttaacacctacaagcgcagcggcatcatggaggtcgaccggtccgaagcgaaagagggcctcaagagaggggagacgacaaaacacgccgtgtctcgcggaaccgctaagctgcggtggttcgtggaaagaaatcttgtcaaacccgagggcaaggttattgatctggggtgtggacgcggcgggtggagctattactgcgccggactcaagaaagtgaccgaagtgaagggctatacaaaaggcgggcctggacatgaggaacccatccctatggctacctacggctggaacctggtcaagctgcactccgggaaagacgtgtttttcattccccctgagaagtgtgatacactcctttgcgacatcggagagtctagcccgaatcccacgattgaagagggccggaccctgagagttctgaaaatggtggaaccttggctccgcgggaaccaattttgtatcaagattctgaatccctacatgccttccgtcgtggagacacttgagcagatgcagcggaagcatggaggcatgctggttagaaaccccctcagccgcaattctacccacgaaatgtattgggtgtcctgcggcacagggaacatcgtcagcgccgtgaatatgacctctcggatgctgctgaacagattcacgatggcgcaccgcaaaccgacctacgagagagatgtggacctcggagccggcacacggcatgtcgctgttgaacctgaggtggccaacctggatatcattgggcagcgcatcgaaaatattaagcacgagcataaatccacctggcactatgacgaggataacccctacaagacatgggcttatcatggaagctacgaagtgaaaccctctggctccgccagctccatggtcaatggggtggttaaacttctgaccaagccttgggacgtgatccccatggtcacacaaattgctatgaccgatacgacaccttttggacagcagagagtgttcaaagagaaggttgacacccggaccccgaaagccaagagaggcacagcgcaaatcatggaagtgacggccaaatggctctggggctttctgagccggaacaagaagccccgcatctgtaccagagaggagttcacacggaaagtccgctctaatgctgccattggggctgtgtttgttgacgagaaccagtggaatagcgccaaggaggccgtggaagatgagagattctgggaccttgtccaccgggaacgcgagctgcacaaacagggaaagtgcgcgacctgcgtgtataacatgatgggcaaaagagaaaagaagctcggggagtttggaaaagctaagggctcccgggccatctggtacatgtggctgggggcccgcttcctggagttcgaagctctcggctttatgaatgaggatcattggttctctagagaaaacagcctgtccggagtcgagggcgaggggcttcacaaactgggatacattctccgggacatctctaagattcctggcgggaatatgtatgccgatgacacagctggatgggatacccgcatcacagaagacgatctgcagaacgaggccagaatcaccgacattatggaacccgagcatgcgcttctggccaaaagcatctttaagctcacgtaccaaaataaagtggttcgggtgcagcgccctgctaagaacggcaccgtcatggatgtgatttccagacgggaccagagagggtctggccaggtgggaacatatggcctgaataccttcacaaacatggaagcccaactgatccgccagatggagagcgaggggatcttttcccccagcgaactcgagaccccgaacctggctgaacgggttcttgattggctggagaagtacggagtggaaagactcaaacgcatggccatctctggcgacgactgtgtcgtgaagcctatcgatgaccggttcgcgacggccctgacagctcttaatgatatggggaaagttagaaaggacattccccagtgggagccttccaaaggatggaacgattggcagcaagtgcccttttgcagccaccacttccatcagctgatcatgaaggacggccgcgagattgtcgtgccttgtcggaatcaggatgaactcgtcgggagagcccgcgtgtctcagggcgctggatggtccctgcgggagaccgcctgcctgggcaagagctatgctcaaatgtggcagctcatgtactttcacagacgcgacctgcggcttgccgcgaacgccatctgttccgctgttcccgtggattggattccgacatctagaaccacgtggagcatccatgcccaccatcagtggatgaccacagaagacatgctgtccgtctggaatcgggtgtggattgaggaaaacccttggatggaggataaaacccacatcagctcttggggagacgttccctatctcggaaagagagaggaccaatggtgcggctccctgatcgggcttacagcccgcgctacctgggccacaaatattcaggtggcgatcaaccaggtccggagactgattggaaatgaaaactacctcgattacatgaccagcatgaaacgcttcaagaatgagtctgaccccgaaggcgctctgtggtga

SEQ ID NO: 18886 - RNA, 9879 nt, synthetic construct
  misc_feature 1..9879: note = derived and/or modified CDS sequence (opt5) from DENV-1__FJ024464__SS-prME
  source 1..9879: mol_type = other RNA
agcgtgaccatgctgctcatgctgatgcccacagcccttgctttccacctgacgaccagaggcggggaacctcatatgattgtctccaagcaggaacggggaaaatctctcctgtttaagacaagcgccggcgttaacatgtgcacccttattgccatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgtgcgccggatggctatcctgggagatacagcctgggacttcggctctatcgggggagtttttaccagcgtcggcaaactcgtgcatcagattttcgggacggcgtacggagtgctgttttccggcgtcagctggaccatgaagatcgggattggcgtgcttctgacatggctcggactcaattctagatccaccagcctgtctatgacatgtatcgccgttggccttgtgaccctctacctgggggtcatggtgcaggctgattccggatgcgttattaactggaaaggccgcgaactgaagtgtgggagcggaatcttcgtgacaaatgaggtccacacctggacggaacaatataagtttcaggccgactcccctaaacggctctctgctgccattggcaaggcgtgggaggagggggtgtgcggcatcagaagcgccacacgcctggaaaacatcatgtggaaacagatttccaacgagcttaatcatatcctgctcgaaaacgacatgaagttcaccgttgtggtcggagatgtggctggcattctggcccaggggaaaaagatgatccggccgcaacccatggagtacaaatattcttggaaaagctggggaaaggctaagattatcggcgccgacgtgcagaataccacatttatcattgatgggcctaacacccccgaatgtcctgacgatcagagagcctggaatatctgggaggtcgaggactacggattcggcatttttacgacaaacatctggctgaaacttcgcgattcctatacccaggtttgcgaccaccggctcatgagcgctgcgattaaagattctaaggccgtgcacgctgacatgggctactggatcgaatccgagaaaaatgaaacatggaagctggccagagccagcttcatcgaggtgaagacctgtatttggcccaaatctcatacactgtggtccaacggggtcctcgaaagcgagatgatcattccgaagatctatggaggccctatgtctcaacacaattaccgccccgggtacttcacccagacggctggaccttggcatctgggcaaacttgagctggattttgacctctgcgaagggaccacagtggttgtggatgagcactgcggaaaccggggccccagcctgagaaccacaaccgtcacgggcaagattatccacgaatggtgttgccggtcctgtacactgcctccccttcgcttcagaggggaggacggatgctggtatggcatggagatccggccggtgaaagaaaaggaggaaaatctcgttaagagcatggtgtctgccgggtccggagaggtcgacagcttttccctgggcctgctctgtatttctatcatgattgaagaggtgatgagaagccgctggtcccggaaaatgctgatgaccgggacacttgcggttttctttctgctcatcatgggacagctgacctggaacgatctgattagactttgcatcatggtgggcgctaatgcctctgaccgcatgggcatggggaccacatacctggccctcatggctacgttcaagatgagacctatgtttgccgtcggactgctgttccggcgcctgaccagcagagaggtgcttctgctcacaattggcctgtccctggtggcgtctgtcgaacttcccaacagcctggaggaactcggggatggactggctatgggcatcatgatcctcaaactgcttaccgactttcaatcccatcagctgtgggccacactcctgagcctgaccttcattaagacgacattttctcttcactatgcctggaaaaccatggctatggttctgtccatcgtgagcctcttccccctgtgtctctctaccacatcccagaagaccacatggctgcctgtgcttctggggagcctgggatgcaagccgctcacgatgtttctgattgccgagaataaaatctggggccggcgctcttggccccttaacgaaggcattatggctgtcgggatcgtgtccatcctgctcagctccctgctcaagaacgatgttcctctggccggaccccttattgcgggcgggatgctgatcgcctgttacgtgattagcggatctagcgctgacctgtccctcgagaaagccgctgaggtctcttgggaagaggaagccgagcatagcggcgcctcccacaatatcctggtggaagttcaggatgacgggaccatgaagattaaagatgaggagagagacgatacacttaccatcctgctcaaggctacactgctcgcggtgtctggagtctatcctctgagcatccccgccacccttttcgtgtggtacttctggcagaagaagaagcagcggtccggcgtcctgtgggacacgccttctcccccggaagtggagcgcgctgttctggatgacggcatttatagaatcatgcagcgggggctcctgggacgcagccaggtgggcgtcggggtgtttcaagaaaacgttttccataccatgtggcacgtgacaagaggagccgtccttatgtaccagggcaaacggctggagccttcctgggccagcgtgaagaaagacctcatttcttacgggggaggctggagactgcagggctcctggaataccggggaggaagtgcaggttatcgctgtcgagcccggaaagaaccctaaaaatgtgcaaacagcccccggcacctttaagacaccggaaggggaggtgggagcgattgctctcgatttcaagcctggcacgagcgggtctcccatcgtcaaccgcgaaggaaaaattgtgggcctgtatggcaatggggttgtgaccacatccggaacctacgtcagcgccatcgcccaggctaaggcctcccaggagggccctcttcccgagatcgaagacgaggtgtttcggaaaagaaacctgaccattatggatctgcaccccgggtctggaaagacacgccggtatctccctgcgatcgttagagaagctattaaacgcaagctgcggacgcttatcctggccccgaccagagtggtcgccagcgagatggctgaagccctcaagggcatgcccattcgctaccaaacaaccgctgtgaaatccgagcatacagggaaggagatcgttgacctgatgtgccacgccaccttcacgatgcggctgctcagccctgtgagagtccccaattataacatgatcattatggatgaagcgcattttacagacccttcttccatcgccgctcggggctacattagcacccgcgtgggaatgggcgaggccgctgccatcttcatgaccgccacaccccctgggtctgtggaggcttttccgcagagcaatgcggtcattcaggatgaggaaagagacatccccgagcggtcctggaactctggatatgagtggatcaccgatttccctggcaaaacagtttggtttgtgcccagcattaagtccgggaatgacatcgccaactgtcttcgcaaaaatggaaagagagtgattcagctgtctcggaagaccttcgatacggaataccagaagaccaagaacaacgactgggactacgtcgtgaccacagatatcagcgagatgggcgctaatttcagagccgaccgcgttattgatcctcggagatgcctgaaacccgtgatcctcaaggacgggccggaacgcgtcattctggccggccctatgcccgtgaccgttgcttccgccgcgcagcggagaggacgcatcggccggaaccacaataaagagggggatcagtatatctacatgggacagccccttaacaatgacgaggatcatgctcactggacggaagccaagatgctgctcgacaacattaatacccctgagggcatcattcccgccctgtttgaacctgagagagaaaagagcgctgccatcgatggggagtatcgcctgagaggagaggcgcggaaaacattcgtggaactcatgcgcagaggcgaccttccggtctggctgtcttacaaggtggcctccgaggggtttcaatatagcgatcggcgctggtgcttcgacggcgaaagaaacaatcaggtcctggaggaaaacatggatgtggagatttggaccaaagagggagaacggaagaaactcagaccccgctggctggacgctcggacatactccgaccctcttgccctgagagagtttaaggagttcgctgccggccgccggtctgttagcggggatctcatcctggagatcggaaaactgccccagcacctcacccagagagctcaaaatgcccttgacaacctggtgatgctgcataattccgaacagggcgggcgggcgtatcgccacgccatggaggagctccctgatacaattgaaaccctgatgcttctggctctcatcgccgtgctgacgggaggcgtcacactgtttttcctctctggcagagggcttggaaagaccagcattggcctgctgtgtgttatggcttccagcgtgctcctgtggatggcctctgtggagccccattggatcgccgcttccattatccttgaatttttcctgatggtcctcctgatcccggagcctgaccggcagcgcacaccccaggataaccaactggcgtacgtggttattgggctcctttttatgatcctgacagtggccgctaatgagatgggactgctcgaaaccacaaagaaagacctgggcattgggcacgtcgccgtggagaaccaccatcacgccgctatgcttgatgtcgacctgcatcctgccagcgcgtggacgctctacgccgtggctaccacaatcattacccccatgatgagacacacaatcgaaaacaccacggccaatatttctctgaccgctatcgccaaccaggcggccatcctgatgggactcgataagggctggcctatttccaaaatggacatcggcgttccccttctggctctggggtgctatagccaggtgaatccgctcacactgaccgccgctgtccttatgctggtggcccattacgctattatcggacctggcctccaagccaaggcgacacgggaggcccagaaacgcaccgctgccgggattatgaagaaccccacggttgatggaatcgtggctatcgacctggatcccgtcgtgtatgacgccaagttcgaaaaacagctgggccagattatgctccttatcctgtgtacatctcaaattctgctcatgagaaccacatgggccctgtgcgagagcatcacccttgcgaccgggcctctgacaacgctctgggagggatccccgggcaagttttggaataccacaattgctgtgtctatggccaacatcttccggggcagctacctggctggggccggactggccttctccctcatgaaaagccttggcgggggacgcagaggcaccggggctcagggagaaacactgggcgagaagtggaaacggcagctgaatcagctctccaagtctgaatttaacacctataagagaagcggcatcatggaggttgaccgctccgaagccaaagaggggctgaagcggggagagacgacaaaacacgcggtctctagaggcaccgccaaacttcgctggttcgtggaacggaatctggtgaaacccgaggggaaggtcattgatctcggatgtggcagagggggatggagctactattgcgctggcctgaagaaagttaccgaagtgaagggctacacaaaagggggacctggccacgaggaacccatccctatggccacctacgggtggaacctggtgaagctccattccggaaaagacgtctttttcattccccctgagaagtgtgatacacttctgtgcgacatcggcgagtctagcccgaatcccacgattgaagaggggcgcaccctgcgggtgctcaaaatggttgaaccttggctgagaggaaaccaattttgtatcaagattcttaatccctatatgccttccgtggtcgagacactggagcagatgcagcgcaagcacggcggcatgctcgtgcggaaccccctgagcagaaattctacccatgaaatgtactgggtttcctgcgggacaggaaacatcgtgagcgctgtcaatatgacctctcgcatgctgctcaaccggttcacgatggcccacagaaaaccgacctatgagcgcgatgtggacctgggcgcggggacaagacacgtggccgtcgaacctgaggttgctaaccttgatatcattggacagcggatcgaaaatattaagcatgagcacaaatccacctggcattacgacgaggataacccctataagacatgggcctaccacggcagctatgaagtgaaaccctctgggtccgctagctccatggtgaatggagtcgtgaagctgctcaccaagccttgggacgttatccccatggtgacacaaattgccatgaccgatacgacaccttttggccagcagcgcgtcttcaaagagaaggtggacaccagaaccccgaaagctaagcggggcacagcccaaatcatggaagttacggcgaaatggctgtgggggtttcttagcagaaacaagaagccccggatctgtacccgcgaggagttcacaagaaaagtgcggtctaatgccgctattggagccgtctttgtggacgagaaccagtggaatagcgctaaggaggccgttgaagatgagcgcttctgggacctggtgcatagagaacgggagctccacaaacagggcaagtgcgcgacctgcgtctacaacatgatggggaaacgcgaaaagaagctgggagagtttggcaaagcgaaggggtccagagctatctggtacatgtggctgggcgcccggttcctcgagttcgaagccctgggatttatgaatgaggatcactggttctctcgcgaaaacagcctttccggcgtggagggggagggactgcataaactcggctatattctgagagacatctctaagattcctgggggaaatatgtacgctgatgacacagccggctgggatacccggatcacagaagacgatcttcagaacgaggctcgcatcaccgacattatggaacccgagcacgccctgctcgcgaaaagcatctttaagctgacgtatcaaaataaagtcgtgagagttcagcggcctgccaagaacgggaccgtgatggatgtcatttcccgcagagaccagcggggctctggacaggtgggcacatacgggctgaataccttcacaaacatggaagctcaactcatcagacagatggagagcgagggaatcttttcccccagcgaactggagaccccgaaccttgccaagcgcgtgctggattggctcgaaaaatatggcgttgagcggctgaagagaatggctatctctggggacgactgtgtggtcaaacctatcgatgaccgcttcgccacggcgcttacagccctgaatgatatgggaaaggtgcggaaagacattccccagtgggaaccttccaagggctggaacgattggcagcaagttcccttttgcagccatcacttccaccagctcatcatgaaggacgggagagagattgtggtcccttgtcgcaatcaggatgagctggtgggccgggctagagtctctcagggagccggctggtccctgcgcgaaaccgcttgcctcgggaaaagctacgcccaaatgtggcagctgatgtattttcatcggagagaccttcgcctggctgccaacgcgatctgttccgccgtgcccgttgattggattccgacatctcggaccacgtggagcatccacgctcatcaccagtggatgaccacagaggacatgctctccgtgtggaatagagtctggattgaagagaacccttggatggaagataagacccatatcagctcttggggagacgtgccctacctgggcaaacgggaggaccaatggtgcgggtcccttatcggactgacagccagagccacctgggctacaaatattcaggttgccatcaaccaggtgcgccggctcattggcaatgagaactacctggattatatgaccagcatgaagagattcaaaaatgaatctgaccccgagggggcgctgtggtga

SEQ ID NO: 18887 - RNA, 9879 nt, synthetic construct
  misc_feature 1..9879: note = derived and/or modified CDS sequence (opt5) from DENV-1__FJ410191__SS-prME
  source 1..9879: mol_type = other RNA
agcgtgaccatgctgctgatgctgatgcccaccgcccttgctttccacctgacgaccagaggaggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaagacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggacatcttacgtgatgtgtaccggctccttcaagctggagaaagaagtcgccgagacccagcatggaacagtgctcgttcagatcaagtatgagggcaccgacgcgccgtgcaaaattccttttagcacacaggatgaaaagggggtgacgcaaaacggaagactgatcaccgctaatcccatcgtcacagacaaagagaagcctgtgaacattgaagccgagccgcccttcggcgagtcttacatcgtgattggggccggagaaaaggctctgaaacttagctggtttaagaaaggctcctctatcgggaagatgttcgaggccaccgctcggggcgccagacgcatggcgattctcggagatacagcctgggactttggcagcatcgggggagttttcacctccgtcggcaaactggtgcaccagatctttgggacggcttatggagtgctgttcagcggcgtctcttggaccatgaagattgggatcggcgtgctcctgacatggcttggactcaattcccggagcacctctctctccatgacatgtattgccgttggcctggtgaccctgtaccttggggtcatggtgcaggctgatagcggatgcgttatcaactggaagggcagagaactcaaatgtgggtccggaatttttgtgacaaatgaggtccatacctggacggaacagtacaagttccaagccgactctcctaaacgcctgagcgcggccatcggcaaggcttgggaggagggggtgtgcggcattcggtccgccacaagactggaaaacatcatgtggaaacagatctctaacgagctcaatcacattctgcttgaaaacgacatgaagtttaccgttgtggtcggagatgtggctggcatcctggcccaggggaaaaagatgattcgcccgcagcccatggagtataagtacagctggaaatcctggggaaaggccaaaatcattggcgctgacgtgcaaaataccacattcatcatcgatgggcctaacacccccgaatgtcctgacgatcagcgggcgtggaatatttgggaggtcgaggactatggatttggcatcttcacgacaaacatttggctcaagctgagagatagctacacccaggtttgcgaccaccgcctgatgtctgccgctatcaaagattccaaggccgtgcatgccgacatgggctattggattgaaagcgagaagaatgaaacatggaaacttgctcgggcctctttcatcgaggtgaagacctgtatctggcccaaatcccacacactctggagcaacggggtcctggaatctgagatgattatcccgaagatttacggaggccctaccagccagcataattatagacccgggtactttacgcaaaccgcgggaccttggcacctgggcaaactcgagctggatttcgacctttgcgaagggacaaccgtggttgtggatgagcactgcggaaaccgcggcccctccctgcggacaaccacggtcacaggcaagatcattcatgaatggtgttgcagaagctgtaccctccctcccctgcggtttaagggggaggacggatgctggtacggcatggagatccgcccggtgaaagaaaaggaggaaaatctggttaaatctatggtgtccgctgggagcggagaggtcgactccttctctcttggcctcctgtgtatcagcattatgatcgaagaggtgatgagatcccggtggtctagaaagatgctgatgacagggaccctcgccgtctttttcctgcttattatgggacagctgacctggaacgatctcatccgcctgtgcattatggtgggcgccaatgctagcgaccggatgggcatggggacaacgtatctggcccttatggcgacctttaaaatgagacctatgttcgctgtcggactgctctttcgcagactgacatcccgggaggtgctcctgcttaccatcggcctgtctctcgtggccagcgtcgaactgcccaactccctggaggaacttggggatggactggccatgggcattatgatcctcaagctgctcacagacttccagagccaccaactgtgggctacccttctgtctctcacgtttatcaagacaaccttctccctgcattacgcctggaaaaccatggctatggttctgagcattgtgtctctttttcccctgtgtctctccacaaccagccagaagacaacgtggctgcctgtgctcctggggtctcttggatgcaaaccgctgaccatgttcctgatcgccgagaataagatttggggccgcaaatcctggcccctcaacgaaggcatcatggcggtcgggattgtgagcatcctgctttccagcctgctcaagaacgatgttcctctggccggacccctcatcgctggcgggatgctgattgcctgttatgtgatctctggaagctccgctgacctttctctggagaaagccgccgaggtcagctgggaagaggaagctgagcactccggcgcgtctcataatattctggtggaagttcaggatgacgggacaatgaagatcaaggatgaggagagagacgataccctcacaattctgcttaaagccaccctgctcgctgtgagcggagtctaccctctgtccatccccgccacgctgttcgtgtggtatttttggcagaagaaaaagcaacggtctggcgtcctgtgggacacccctagccctcccgaagtggagcgcgccgttcttgatgacggcatctacagaattatgcagcgggggctgctgggacgctcccaggtgggcgtcggggtgttccaggaaaacgtttttcacacaatgtggcacgtgaccagaggagctgtcctcatgtatcaaggcaaacggctggagcccagctgggcctctgtgaagaaggaccttatctcctacgggggaggctggcgcctgcagggcagctggaatacaggggaggaagtgcaggttattgcggtcgagcccggcaagaatcctaagaatgtgcagaccgctcccggcacattcaaaacgtctgaaggggaggtgggagccatcgccctcgattttaagccgggcacctccgggagccctattgtcaacagagaaggaaaaatcgtgggcctgtacggcaatggggttgtgacaacctccggaacctatgtctctgctattgcccaagcgaaggctagccaggagggccccctccctgagatcgaagacgaggtgttccggaagagaaacctgacaatcatggatcttcatcccgggtccggaaaaacgcgccggtacctgcccgccattgttagagaagccatcaagcgcaaactgcggaccctcattctggctcctacaagagtggtcgccagcgagatggctgaagcccttaagggcatgccgatccgctatcagaccacagcggtgaaaggggagcacaccggcaaggagattgttgacctgatgtgccatgccacgtttacaatgcggctcctgtctcccgtgagagtccctaattacaacatgatcatcatggatgaagctcacttcaccgacccctccagcattgccgctcgcggatatatctctacccgggtgggcatgggggaggccgccgctatttttatgacagcgacccctcccggaagcgtggaagccttccctcaatccaatgctgtcatccaggatgaggaaagagacattccggagcggtcttggaacagcggctacgagtggatcacagattttcccgggaagaccgtttggttcgtgccttccatcaaatctggaaatgacattgccaactgtctgcgcaagaatggcaaaagagtgatccagctcagccggaagacgttcgatacagaatatcagaaaaccaagaacaacgactgggactacgtcgtgacaaccgatatttccgagatgggggccaattttcgcgctgacagagttatcgatccccggagatgccttaagcctgtgattctgaaagacggccccgaacgcgtcatcctggccggaccgatgcctgtgacggttgcgagcgctgcccaacggagaggccgcattgggcggaaccataataaggagggagatcagtacatctatatgggccagcccctcaacaatgacgaggatcacgcccactggaccgaagctaaaatgctgcttgacaacatcaatacacccgaggggattatccctgccctgttcgaacccgagagagaaaagtctgcggccattgatggagagtaccgcctccggggcgaggctagaaaaacctttgtggaactgatgcgcagaggggacctgcctgtctggctctcctataaggtggccagcgagggcttccagtactccgatcggcgctggtgctttgacggagaaagaaacaatcaagtccttgaggaaaacatggatgtggagatctggacaaaagagggcgaacggaagaagctgcgcccgagatggctggacgctcggacctattctgaccccctcgccctgagagagttcaaagaatttgctgccgggcgccggagcgtttccggagatcttattctggagatcggcaagctccctcagcatctgacacagagagcgcagaatgccctggacaacctcgtgatgcttcacaattctgaacaagggggacgcgcttaccggcatgccatggaggagctgcccgataccatcgaaacgctgatgctcctggctcttattgccgtgctgacaggcggcgtcaccctcttctttctgagcgggagaggactgggcaaaacctccatcgggctcctttgtgttatggccagctctgctctgctgtggatggcgtccgtggagcctcactggattgccgctagcatcattctcgagttctttctgatggtgcttctgatccccgagccggaccggcagcgcacacctcaggataaccagctcgcctatgtcgtgatcggactgctgttcatgattctcaccgttgccgctaatgagatgggccttctggaaacaacgaagagagacctggggatcggacacgtggccgtcgagaaccatcaccatgcggccatgctcgatgtggacctgcaccccgcttctgcctggaccctttacgctgtcgccacaaccattatcacacctatgatgcggcataccattgaaaacacgaccgcgaatatctccctgacagccattgctaaccaagccgctatcctcatgggcctggataaaggctggcccatcagcaagatggacattggggtgcctctgctcgcccttggatgctactctcaggttaatcccctgaccctgacagctgccgtgctcatgctggtcgcgcactatgccatcattggcccggggcttcaggctaaggccacccgcgaggctcagaaaagaacggccgccggaatcatgaagaaccctacagtggatggcattgttgcgatcgacctggatcccgtggtctacgacgctaaatttgaaaagcagctcgggcagatcatgctgctggtgctctgtaccagccagattcttctgatgcggacaacctgggccctgtgcgagtccatcaccctcgctacaggacccctgacgaccctttgggagggctctcctggcaaattctggaatacaaccattgccgtgagcatggccaacatcttccgcgggtcctatctggctggagccggcctcgcgtttagcctgatgaagtccctcgggggaggcagacgggggacaggagcccaaggcgaaaccctcggcgagaagtggaaacgccagcttaatcagctgtctaagagcgagttcaacacgtacaaaagatccgggattatggaggttgaccggtctgaagctaaggagggactgaaaagaggcgagacaaccaagcacgccgtcagccgcgggaccgctaagctccggtggtttgtggaaagaaatctggtgaaaccggagggaaaggtcatcgatcttggctgtgggcgcggaggctggtcctattactgcgccggcctgaaaaaggttacagaagtgaaagggtataccaagggaggccccgggcatgaggaacctatccccatggcgacatacggatggaacctcgtgaaactgcactctggcaaggacgtcttctttattcctcccgagaagtgtgatacgctgctctgcgacatcggggagagctcccctaatccgaccattgaagagggacggacacttagagtgctgaaaatggttgaaccctggctgcgcggcaaccagttctgtatcaagattctcaatccttacatgcccagcgtggtcgagaccctggagcaaatgcagcggaaacatggcgggatgcttgtgagaaaccctctgtctcgcaattccacacacgaaatgtattgggttagctgcggaaccggcaacatcgtgtctgccgtcaatatgacgtcccggatgctcctgaacagatttaccatggctcaccgcaagcccacatacgagcgggatgtggacctgggggccggaaccagacatgtggctgtcgaaccggaggttgccaacctcgatattatcggccagcgcatcgaaaatattaaacacgagcataagagcacatggcactatgacgaggataacccttacaagacctgggcttatcatgggtcttacgaagtgaaaccctccggaagcgcctccagcatggtgaatggcgtcgtgaagctgcttacaaaaccctgggacgttatccctatggtgacccagattgcgatgacggatacaacccccttcggccaacagagagtctttaaggagaaagtggacacccggacacctaaggccaagcgcgggacggctcagatcatggaagttaccgccaaatggctgtggggattcctctctagaaacaagaaaccgcggatttgtacaagagaggaatttacccggaaggtgcgcagcaatgctgccatcggcgccgtcttcgtggacgagaaccaatggaactccgcgaaagaggctgttgaagatgagagattttgggacctggtgcaccgggaacgcgagcttcacaagcaggggaagtgcgccacatgcgtctataacatgatgggaaaaagagaaaagaaactgggcgagttcgggaaggccaaaggctctcgggctatctggtacatgtggctcggagcccgcttcctggagtttgaagctctgggcttcatgaatgaggatcattggtttagcagagaaaactccctctctggggtggagggagagggcctgcacaaacttgggtacattctgcgggacatcagcaaaattcccggaggcaatatgtatgccgatgacaccgcggggtgggatacacgcatcaccgaagacgatctccagaacgaggccaagattacggacatcatggaacctgagcatgctctgcttgccaagtccatcttcaaactgacctaccagaataaggtcgtgagagttcaacggcccgctaaaaacggcacagtgatggatgtcatttctcgcagagaccagcggggaagcggccaggtggggacctatggactcaatacatttaccaacatcgaagcccagctgattcgccaaatggagtccgaggaaatcttcagcccttctgagctggaaacgcccaacctcgcgggcagagtgctggattggcttgagaagcacggggttgaacggctgaaaagaatggccatttccggagacgactgtgtggtcaagccgatcgatgaccgctttgctacagccctcaccgctctgaatgatatgggcaaggtgcggaaagacatccctcagtgggagcccagcaaggggtggaacgattggcagcaggttcctttctgctctcaccattttcaccaacttattatgaaagacggcagagagatcgtggtcccctgtcgcaatcaggatgaactggtgggacgggccagagtctcccagggcgctgggtggagcctccgcgagacagcctgcctgggaaagtcctacgcgcagatgtggcaactgatgtatttccatcggagagacctccgcctggccgctaacgccatttgttctgccgtgcctgttgattgggtgcccaccagccggacgacctggtccatccacgctcatcaccagtggatgacaaccgaagacatgcttagcgtctggaatagagtgtggattgaggaaaacccgtggatggaggataaaacacacatctcttcctggggcgacgttccttacctggggaagcgcgaggaccagtggtgcggaagcctcattggcctgaccgcccgggcgacatgggctaccaatatccaagtggccatcaaccaggtcagacggcttattgggaatgaaaactatctggattacatgacgtctatgaagagatttaaaaatgagagcgaccccgaaggcgccctctggtga

SEQ ID NO: 18888 - RNA, 9879 nt, synthetic construct
  misc_feature 1..9879: note = derived and/or modified CDS sequence (opt5) from DENV-1__FJ432723__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatcgccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcattatgatcctcaagctgcttacagacttccaatcccaccagctgtgggccaccctcctgagctttacattcattaaaaccacgctgtctcttcattacgcttggaagacaatggccatggttctgtccatcgtgagcctctttcccctgtgtctctctaccacctcccagaagacaacctggctgcctgtgcttctggggagcctgggatgcaaaccgctcacaatgttcctgattgctgagaataagatctggggcagaaaatcttggccccttaacgaaggcatcatggccgtcggggtggtttccattctgctcagctccctgctcaagaacgatgtgcctctggcgggaccccttatcgccggcgggatgctgattgcttgttatgtcatcagcggatctagcgccgacctgtccctcgagaaagctgccgaggtgtcttgggaagaggaagccgagcacagcggcgcttcccataatattctggttgaagtgcaggatgacgggacgatgaagatcaaagatgaggagcgggacgatacccttacaatcctgctcaaggcgaccctgctcgccgtctctggagtgtaccctctgagcattcccgctacactttttgtctggtatttctggcaaaagaaaaagcagcgctccggcgtgctgtgggacaccccttctcccccggaagttgagagagccgtgctggatgacggcatctaccggattatgcagcgcgggctcctgggaagaagccaggtcggcgtgggggttttccaagaaaacgtgtttcacacgatgtggcacgtcacccggggagccgtgcttatgtatcagggcaaacgcctggagccttcctgggctagcgtgaagaaagacctcatctcttacgggggaggctggagactgcagggctcctggaatacaggggaggaagttcaggtcattgccgtggagcccggaaagaaccctaagaatgtgcaaaccgcgcccggcacattcaaaaccccggaaggggaggtcggagctatcgccctcgattttaagcctggcacaagcgggtctcccattgtgaaccgggaaggaaaaatcgttggcctgtacggcaatggggtggtcacgacctccggaacatatgtgagcgccatcgctcaggccaaggcgtcccaggagggccctcttcccgagattgaagacgaggttttcagaaaacgcaacctgaccatcatggatctgcatcccgggtctggaaagacccggagatacctccctgctattgtgcgcgaagccatcaagcggaaactgagaacacttattctggccccgacgcgcgtcgtggctagcgagatggccgaagctctcaagggcatgcccatccggtatcaaaccacagccgttaaatccgagcacaccgggaaggagatcgtggacctgatgtgccatgcgacatttaccatgagactgctcagccctgtccgcgtgcccaattacaacatgattatcatggatgaagcccacttcacggacccttcttccattgctgcccggggctatatcagcacaagagtgggaatgggcgaggctgccgccatttttatgaccgctacaccccctgggtctgtcgaagcgttcccgcagagcaatgccgttatccaggatgaggaacgggacatccccgagcgctcctggaactctggatacgagtggattacagattttcctggcaaaaccgtgtggttcgtgcccagcatcaagtccgggaatgacattgctaactgtcttagaaagaatggaaaacgggtcatccagctgtctcgcaagacatttgataccgaatatcagaagacgaagaacaacgactgggactacgtggttacaaccgatattagcgagatgggcgccaatttcagagccgaccgggtgatcgatcctagacgctgcctgaaacccgtcattctcaaggacgggccggaacgggtgatcctggctggccctatgcccgttacagtggcctccgcggctcagagacgcggacggatcggcagaaaccataataaggagggggatcagtacatttatatgggacagccccttaacaatgacgaggatcacgcccactggaccgaagccaaaatgctgctcgacaacatcaatacgcctgagggcattatccccgctctgttcgaacctgagcgcgaaaagagcgccgcgattgatggggagtaccggctgagaggagaggcccgcaaaacctttgtcgaactcatgagacggggcgaccttccggtgtggctgtcttataaggtcgcttccgaggggttccaatacagcgatcgcagatggtgctttgacggcgaacggaacaatcaggtgctggaggaaaacatggatgttgagatctggacaaaagagggagaacgcaagaaactcagaccccggtggctggacgccagaacctattccgaccctcttgctctgcgcgagttcaaggaatttgccgctggccggagatctgtgagcggggatctcatcctggagattggaaagctgccccagcatctcacacagcgcgcccaaaatgcgcttgacaacctggtgatgctgcacaattccgaacagggcgggcgggcctacagacatgctatggaggagctccctgataccatcgaaacactgatgcttctggccctcattgctgtcctgaccggaggcgttacgctgttctttctctctggccgggggcttggaaaaacaagcatcggcctgctgtgtgtgatggcctccagcgtgctcctgtggatggcctctgtcgagccccactggattgctgcgtccatcatccttgagttctttctgatggtgctcctgattccggagcctgaccgccagagaacaccccaggataaccaactggcctatgttgtgatcgggctccttttcatgattctgaccgtcgctgccaatgagatgggactgctcgaaacaaccaagaaagacctgggcatcgggcacgtggccgtcgagaaccatcaccatgctacaatgcttgatgtggacctgcaccctgccagcgcgtggacgctctacgccgttgctaccacaattatcacccccatgatgcggcatacaattgaaaacaccacggccaatatctctctgaccgctatcgccaaccaggcggccattctgatgggactcgataagggctggcctatctccaaaatggacattggcgtgccccttctggctctggggtgctacagccaggtcaatccgctcacactgaccgccgctgtgcttatgctggttgcccactatgctatcattggacctggcctccaagccaaggcgacacgcgaggcccagaagagaaccgctgccgggatcatgaaaaaccccacggtggatggaatcgtcgctattgacctggatcccgtggtgtacgacgccaagtttgaaaaacagctgggccagatcatgctccttattctgtgtacatctcaaatcctgctcatgcggaccacatgggccctgtgcgagagcattacccttgcgaccgggcctctgacaacgctctgggagggatccccgggcaagttctggaataccacaatcgctgtttctatggccaacatctttcgcggcagctatctggctggggccggactggccttctccctcatgaaaagccttggcgggggaagacggggcaccggggctcagggagaaacactgggcgagaagtggaagcgccagctgaatcagctctccaaatctgagttcaacacctacaagagaagcggcattatggaggtcgaccggtccgaagccaaagaggggctgaagagaggagagacgacacgccacgcggtgtctcggggcaccgccaaacttagatggtttgtggaacgcaatctggtcaagcccgaggggaaggttatcgatctcggatgtggcagagggggatggagctattactgcgctggcctgaaaaaggtgaccgaagtgaaaggctatacaaaagggggacctggccatgaggaacccattcctatggccacctacgggtggaacctggtcaaactccactccggaaaggacgtgttctttacaccccctgagaaatgtgatacgcttctgtgcgacatcggcgagtctagcccgaatcccaccattgaagaggggagaacactgcgcgttctcaagatggtggaaccttggctgcggggaaaccaattctgtatcaagattcttaatccctacatgccttccgtcgtggagaccctggagcagatgcagagaaaacatggcggcatgctcgttcgcaaccccctgagcagaaattctacacacgaaatgtattgggtgtcctgcgggaccggaaacatcgtcagcgctgtgaatatgacgtctagaatgctgctcaaccgctttaccatggcccaccggaagccgacatacgagagagatgtggacctgggcgcggggacccgccatgtcgccgttgaacctgaggtggctaaccttgatatcattggacagagaatcgaaaatattaaacacgagcataagtccacatggcactatgacgaggataacccctacaaaacctgggcctatcatggcagctacgaagtgaagccctctgggtccgctagctccatggtcaatggagtggttaagctgctcacaaaaccttgggacgtgatccccatggtcacccaaattgccatgacggatacaacccctttcggccagcagcgggtgtttaaggagaaagttgacacccgcacaccgaaggctaaaagaggcacggcccaaatcatggaagtgaccgcgaagtggctgtgggggttccttagccggaacaagaaacccagaatctgtacacgggaggaatttacccgcaaggtcagatctaatgccgctattggagccgtgttcgttgacgagaaccagtggaatagcgctaaagaggccgtggaagatgagcggttttgggacctggtccagaaggaacgcgagctccacaaacagggcaagtgcgccacatgcgtgtataacatgatggggaagagagagaaaaagctgggagagttcggcaaagcgaaggggtcccgggctatctggtacatgtggctgggcgcccgctttctcgagttcgaagccctgggattcatgaatgaggatcactggttttctagagaaaacagcctttccggcgtcgagggggagggactgcataaactcggctacattctgcgggacatctctaagattcctgggggaaatatgtatgctgatgacaccgccggctgggatacacgcatcaccgaagacgatcttcaaaacgaggctaaaatcacggacattatggaacccgagcacgccctgctcgcgaccagcatcttcaagctgacataccagaataaggtggttagagtgcagcggcctgccaaaaacgggaccgtcatggatgtgatttcccgcagagaccagcggggctctggacaagtgggcacatatgggctgaatacctttacgaacatggaagctcagctcatccgccagatggagagcgagggaattttcctgcccggcgaacttgagacaccgaacctggccgaaagagttctcgattggctggagaagtacggggtggaacggcttaaaagaatggctatctccggagacgactgtgtcgtgaagcctatcgatgaccgctttgccaccgcgctgacagccctcaatgatatgggcaaagttcggaaggacattccccagtgggagcctagcaaggggtggaacgattggcaacaggtgcccttctgctctcatcactttcaccagctgatcatgaaagacggcagagagattgtcgtgccttgtcgcaatcaggatgaactggtcggacgggctagagtgtcccaaggcgccgggtggagcctccgcgagaccgcttgcctgggaaagtcttatgcccagatgtggcagcttatgtacttccatcggagagacctgcgcctcgctgccaacgcgatctgttccgccgttcccgtggattgggtcccgacgagccggaccacatggtccattcacgctcatcaccaatggatgaccacagaagacatgctgtctgtgtggaatagagtttggatcgaggaaaacccttggatggaggataaaacccatgtgagctcctggggcgacgtcccctatcttgggaagcgcgaggaccagtggtgcggaagcctgattggcctcacagcccgggccacctgggcttctaatatccaggtggccatcaaccaggtgagacggctgattgggaatgaaaactacctggattacatgacgtccatgaaaagatttaagaatgagggcgaccccgaaggagcgctctggtga

SEQ ID NO: 18889 - RNA, 9879 nt, synthetic construct
  misc_feature 1..9879: note = derived and/or modified CDS sequence (opt5) from DENV-1__FJ410192__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctggggagcctgggatgcaagccgctcacgatgtttctgattgctgagaataaaatctggggccggcgctcttggccccttaacgaaggcatcatggccgtggggattgtgtccatcctgctcagctccctgctcaagaacgatgtccctctggcgggaccccttattgccggcgggatgctgatcgcttgttacgtgattagcggatctagcgccgacctgtccctcgagaaagctgccgaggtttcttgggaagaggaagccgagcatagcggcgcttcccacaatatcctggtggaagtccaggatgacgggaccatgaagatcaaagatgaggagagagacgatacacttaccattctgctcaaggcgacactgctcgccgtgtctggagtttatcctctgagcatccccgctacccttttcgtgtggtacttctggcagaagaagaagcagcggtccggcgtcctgtgggacacgccttctcccccggaagtggagcgcgccgtcctggatgacggcatttatagaatcatgcagcgggggctcctgggacgcagccaggtgggcgttggggtgtttcaagaaaacgtcttccataccatgtggcacgtgacaagaggagccgttcttatgtaccagggcaaacggctggagccttcctgggctagcgtgaagaaagacctcatttcttacgggggaggctggagactgcagggctcctggaataccggggaggaagtccaggtgatcgccgtggagcccggaaagaaccctaaaaatgttcaaacagcgcccggcacctttaagacaccggaaggggaggtcggagctattgccctcgatttcaagcctggcacgagcgggtctcccatcgtgaaccgcgaaggaaaaatcgtgggcctgtatggcaatggggtcgtgaccacatccggaacctacgttagcgccattgctcaggccaaggcgtcccaggagggccctcttcccgagatcgaagacgaggtgtttcggaaaagaaacctgaccattatggatctgcaccccgggtctggaaagacacgccggtatctccctgctatcgtcagagaagccattaaacgcaagctgcggacgcttatcctggccccgaccagagtggttgctagcgagatggccgaagctctcaagggcatgcccatccgctaccaaacaaccgccgtgaaatccgagcatacagggaaggagattgtcgacctgatgtgccacgcgaccttcacgatgcggctgctcagccctgtgagagttcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgtgatccaggatgaggaaagagacattcccgagcggtcctggaactctggatatgagtggatcaccgatttccctggcaaaacagtgtggtttgtccccagcattaagtccgggaatgacatcgctaactgtcttcgcaaaaatggaaagagagttattcagctgtctcggaagaccttcgatacggaataccagaagaccaagaacaacgactgggactacgtggtgaccacagatatcagcgagatgggcgccaatttcagagccgaccgcgtcattgatcctcggagatgcctgaaacccgtgatcctcaaggacgggccggaacgcgttatcctggctggccctatgcccgtgaccgtcgcctccgcggctcagcggagaggacgcattggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgcccggacatactccgaccctcttgctctgagagagtttaaggagttcgccgctggccgccggtctgtcagcggggatctcattctggagatcggaaaactgccccagcacctcacccagagagcccaaaatgcgcttgacaacctggtgatgctgcataattccgaacagggcgggcgggcctatcgccacgctatggaggagctccctgatacaattgaaaccctgatgcttctggccctcatcgctgttctgacgggaggcgtgacactgtttttcctctctggcagagggcttggaaagaccagcattggcctgctgtgtgtgatggcctccagcgtcctcctgtggatggcctctgttgagccccattggatcgctgcgtccatcattcttgaatttttcctgatggtgctcctgatcccggagcctgaccggcagcgcacaccccaggataaccaactggcctacgtggtcattgggctcctttttatgatcctgacagtggctgccaatgagatgggactgctcgaaaccacaaagaaagacctgggcattgggcacgttgccgtggagaaccaccatcacgctgccatgcttgatgtcgacctgcatcctgcgagcgcctggacgctctacgctgtggccaccacaatcattacccccatgatgagacacacaatcgaaaacaccacggctaatatctctctgaccgccattgcgaaccaggccgctatcctgatgggactcgataagggctggcctatttccaaaatggacatcggcgtcccccttctggccctggggtgctatagccaggtgaatccgctcacactgaccgctgccgttcttatgctggtggctcattacgccattatcggacctggcctccaagcgaaggccacacgggaggctcagaaacgcaccgccgctgggatcatgaagaaccccacggtcgatggaattgtggccatcgacctggatcccgttgtgtatgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaatcgccgtctctatggctaacattttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcatcatggaggtggaccgctccgaagcgaaagaggggctgaagcggggagagacgacaaaacacgccgtgtctagaggcaccgctaaacttcgctggttcgttgaacggaatctggtcaaacccgaggggaaggtgattgatctcggatgtggcagagggggatggagctactattgcgccggcctgaagaaagtgaccgaagtcaagggctacacaaaagggggacctggccacgaggaacccatccctatggctacctacgggtggaacctggttaagctccattccggaaaagacgtgtttttcattccccctgagaagtgtgatacacttctgtgcgacatcggcgagtctagcccgaatcccacgattgaagaggggcgcaccctgcgggtgctcaaaatggtcgaaccttggctgagaggaaaccaattttgtatcaagatccttaatccctatatgccttccgtggttgagacactggagcagatgcagcgcaagcacggcggcatgctcgtgcggaaccccctgagcagaaattctacccatgaaatgtactgggtctcctgcgggacaggaaacattgtgagcgccgttaatatgacctctcgcatgctgctcaaccggttcacgatggcgcacagaaaaccgacctatgagcgcgatgtggacctgggcgccgggacaagacacgtcgctgtggaacctgaggtggccaaccttgatatcattggacagcggatcgaaaatattaagcatgagcacaaatccacctggcattacgacgaggataacccctataagacatgggcttaccacggcagctatgaagtcaaaccctctgggtccgccagctccatggttaatggagtggtgaagctgctcaccaagccttgggacgtcatccccatggtgacacaaatcgctatgaccgatacgacaccttttggccagcagcgcgttttcaaagagaaggtggacaccagaaccccgaaagccaagcggggcacagcgcaaattatggaagtcacggccaaatggctgtgggggtttcttagcagaaacaagaagccccggatctgtacccgcgaggagttcacaagaaaagtgcggtctaatgctgccattggagctgtttttgtggacgagaaccagtggaatagcgccaaggaggccgtcgaagatgagcgcttctgggacctggtgcatagagaacgggagctccacaaacagggcaagtgcgcgacctgcgtttacaacatgatggggaaacgcgaaaagaagctgggagagtttggcaaagctaaggggtccagagccatctggtacatgtggctgggcgcccggttcctcgagttcgaagctctgggatttatgaatgaggatcactggttctctcgcgaaaacagcctttccggcgtggagggggagggactgcataaactcggctatattctgagagacatctctaagatccctgggggaaatatgtacgccgatgacacagctggctgggatacccggattacagaagacgatcttcagaacgaggcccgcatcaccgacattatggaacccgagcacgcgctgctcgccaaaagcatctttaagctgacgtatcaaaataaagtcgtgagagtccagtcccctgctaagaacgggaccgtgatggatgttatttctcggcgcgaccagagaggcagcggacaggtgggcacatacgggctgaataccttcacaaacatggaagcccaactcatccggcagatggagtccgagggaatctttagcccctctgaactggagaccccgaaccttgctgaaagagtcctggattggctcgagaagtatggcgtggaacgcctgaaacggatggccatttccggggacgactgtgtggttaagcctatcgatgacagattcgcgacggcccttacagctctgaatgatatgggaaaagtgcgcaaggacattccccagtgggagcctagcaaaggctggaacgattggcagcaagtccccttttgctctcatcacttccaccagctcatcatgaaggacgggcgggagattgtggttccttgtagaaatcaggatgaactggtgggccgcgcccgggtctcccagggagctggctggagcctgagagagaccgcctgcctcgggaagtcctacgctcaaatgtggcagctgatgtattttcatcgccgggaccttagactggccgcgaacgccatctgttctgctgtgcccgtcgattggattccgacaagccgcaccacgtggtccatccacgcccatcaccagtggatgaccacagaagacatgctcagcgtgtggaatcgggtttggatcgaggaaaacccttggatggaggataaaacccatatttcttcctggggagacgtgccctacctgggcaagagagaggaccaatggtgcgggagccttatcggactgacagcccgggctacctgggccacaaatattcaggtcgcgatcaaccaggtgagacgcctcattggcaatgaaaactacctggattatatgacctctatgaaacggttcaagaatgagagcgaccccgaaggggctctgtggtga

SEQ ID NO: 18890 - RNA, 9879 nt, synthetic construct
  misc_feature 1..9879: note = derived and/or modified CDS sequence (opt5) from DENV-1__FJ410194__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatgggactggataaaggctggcctatctccaagatggacattggcgttcccctccttgctctggggtgctatagccaggtgaatccgctgaccctcacagccgctgtcctgatgcttgtggcccattacgcgatcattggacctggcctgcaagccaaagctacccgcgaggcccagaagagaacagctgccgggatcatgaaaaaccccaccgttgatggaatcgtggccattgacctcgatcccgtcgtgtatgacgcgaagttcgaaaagcagctgggccagatcatgctgctcattctttgtacgtctcaaatcctgctgatgcggacaacctgggctctctgcgagagcattacactggccaccgggcctcttaccacactgtgggagggatccccgggcaaattttggaatacgaccatcgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcattatggaggttgaccggtccgaagccaaggaggggctcaaaagaggagagaccacgaagcacgctgtctctcgcggcacagccaaactgcggtggttcgtggaaagaaatcttgtgaagcccgaggggaaagtcatcgatctgggatgtggccgcgggggatggagctactattgcgctggcctcaagaaggttaccgaagtgaaaggctacaccaaaggcgggcctgggcacgaggaacccattcctatggccacatacgggtggaacctggtgaaactgccctccggaaaggacgtctttttcatccctccggagaaatgtgataccctcctttgcgacattggcgagtctagccccaatcctacaatcgaagaggggcggacgctgagagtgctgaagatggttgaaccctggctccgcggaaaccaattttgtattaaaatcctgaatccttatatgccctccgtggtcgagacccttgagcagatgcagcggaagcatggcggcatgctggtgagaaacccgctcagccgcaattctacacacgaaatgtactgggtttcctgcgggaccggaaacatcgtgagcgcggtcaatatgacatctcggatgctgctgaacagattcaccatggcccatcgcaagcctacgtatgagagagatgtggacctcggcgctgggacccggcacgtggccgtcgaacccgaggttgctaacctggatattatcggacagcgcattgaaaatatcaaacacgagcataagtccacatggcactacgacgaggataacccctataaaacctgggcctaccatggcagctatgaagtgaagccttctgggtccgctagctccatggtgaatggagtcgtgaaacttctgacaaagccctgggacgttattcctatggtgacccaaatcgccatgacagataccacgccgtttggccagcagagagtcttcaaggagaaagtggacacacggacccccaaggcgaaaagaggcaccgcccaaatcatggaagttacagctaagtggctctgggggtttctgagccggaacaaaaagcctcgcatttgtacgagagaggagttcacccggaaggtgcgctctaatgccgctatcggagccgtctttgtggacgagaaccagtggaatagcgccaaagaggcggttgaagatgagagattctgggaccttgtgcaccgggaacgcgagctgcataagcagggcaaatgcgctacatgcgtctacaacatgatggggaagagagagaaaaagctcggagagtttggcaaggccaaagggtcccgggccatttggtacatgtggctgggcgctcgcttcctggagttcgaagccctcggatttatgaatgaggatcactggttctctagagaaaacagcctgtccggcgtggagggggagggacttcacaagctgggctatatcctccgggacatttctaaaatccccgggggaaatatgtacgctgatgacaccgccggctgggatacacgcatcaccgaagacgatctgcagaacgagcctagaattacagacatcatggaacccgagcatgcgcttctggccaagagcatttttaaactcacctatcaaaataaggtcgtgcgggttcagtccccggctaaaaacgggacggtgatggatgtcatctctcgcagagaccagcggggcagcggacaggtgggcacctacgggctgaatacattcaccaacatggaagcccaactgattagacagatggagtccgagggaatctttagcccttctgaactcgagacacccaacctggctgaacgcgtgcttgattggctggagaagtatggcgttgaacggctcaagagaatggccatctccggggacgactgtgtggtcaaacctattgatgaccgcttcgcgaccgccctgacggctcttaatgatatgggaaaggtgcggaaagacatcccccagtgggagcctagcaagggctggaacgattggcagcaagttcccttttggtctcaccatttccaccagctgattatgaaagacgggagagagatcgtggtcccgtgccgcaatcaggatgaactcgtgggccgggccagagtctcccagggagctggctggagcctgcgcgagacagcctgtctggctaagtcctacgcccaaatgtggcagctcatgtattttcaccggagagacctgcgccttgcggccaacgctatttgctctgccgtgcctgttgattggatccccaccagccggacaacctggtccattcatgcccaccatcagtggatgacgaccgaagacatgctgagcgtgtggaatagagtctggatcgaggaaaacccctggatggaggataagacacacatctcttcctggggagacgtgccttacctcggaaaacgggaggaccaatggtgtggcagcctgattgggcttaccgctagagccacatgggcgaccaatatccaggttgctattaaccaggtgcgccggctgatcggaaatgaaaactacctcgattatatgacatctatgaagagattcaaaaatgagagcgacccggaaggcgccctgtggtga

SEQ ID NO: 18891 - RNA, 9879 nt, synthetic construct
  misc_feature 1..9879: note = derived and/or modified CDS sequence (opt5) from DENV-1__FJ432725__SS-prME
  source 1..9879: mol_type = other RNA
agcgtgaccatgctgctgatgctgatgcccaccgcccttgctttccacctgacgaccagaggaggggaacctcatatgatcgtctccaagcaggaacgggggaaatctctcctgtttaagaccagcgccggcgttaacatgtgcacccttattgcgatggacctgggggaactctgtgaagataccatgacctacaaatgccccagaatcacagaaaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccggagtgaccggcggcgtcacgctcgtttttctgtctgggcggggactgggcaaaacaagcatcgggctcctttgtgtgatggcctccagcgtgctgctgtggatggcttctgtcgagccccattggattgcggcctccatcatcctcgagttctttctgatggtgcttctgattccggagcctgaccgccagagaacaccccaggataaccaactcgcttacgttgtgatcggactgctgttcatgattctcaccgtcgccgccaatgagatgggccttctggaaacaaccaagaaggacctggggatcggacacgtggctgtcgagaaccaccatcacgccgcgatgctcgatgtggacctgcatcctgccagcgcttggacactttacgccgttgctacgaccattatcacacccatgatgcggcacaccattgaaaacacaaccgccaatatctctctgacggcgatcgccaaccaggctgccattctcatgggcctggctaaaggctggcctatctccaagatggatattggggtgcccctgctcgcccttggatgctatagccaggtcaatccgctgaccctgacagctcctgtgctcatgctggttgcccattacgcgatcattggccccgggcttcaagccaaagctacccgcgaggcccagaagagaacagctgccggaatcatgaaaaaccccaccgtggacggcatcgtcgccattgatctggaccctgtggtgtatgatgcgaagtttgaaaagcagctcgggcagatcatgctgctgattctctgtacgtctcaaatccttctgatgcggacaacctgggctctgtgcgagagcattacactcgccaccggaccgctgaccacactttgggagggctcccccggcaaattctggaatacgaccatcgctgtttctatggccaacatctttcgcgggagctacctggccggagctggcctcgccttctccctgatgaaaagcctcgggggcgggagacgggggacaggagcgcagggcgaaaccctcggcgagaaatggaagagacagcttaatcagctgtccaaatctgagttcaacacatataagcgcagcgggattatggaggtcgaccggtccgaagccaaggagggactgaaaagaggcgagaccacgaagcacgctgtgtctcgcgggacagccaaactccggtggtttgtggaaagaaatctggtcaagcctgagggaaaagttatcgaccttggctgtgggcgcggaggctggagctactattgcgctggcctgaagaaggtgaccgaagtgaaagggtacaccaagggaggccccgggcacgaggaacctattcccatggccacatacggatggaacctcgtcaaactgcattccggcaaggatgtgttctttatccctccggagaaatgtgacaccctgctctgcgatattggggagtctagccccaatcctacaatcgaagagggacggacgcttagagttctgaagatggtggaaccctggctgcgcggcaaccaattctgtattaaaatcctcaatccttatatgccctccgtcgtggagaccctggagcagatgcagcggaagcacggcgggatgcttgttagaaacccgctgagccgcaattctacacatgaaatgtactgggtgtcctgcggaaccggcaacatcgtcagcgcggtgaatatgacatctcggatgctcctgaacagatttaccatggcccaccgcaagcctacgtatgagagagacgtggatctgggggctggaccccggcacgtcgccgttgaacccgaggtggctaacctcgacattatcggccagcgcattgaaaatatcaaacatgagcacaagtccacctggcattacgatgaggacaacccttataaaacatgggcctaccacgggagctatgaagtgaagccctctggatccgctagctccatggtcaatggcgtggttaaactgcttaccaagccttgggatgtgattccgatggtcacacaaatcgccatgaccgacacaacccccttcggccagcagagagtgtttaaggagaaagttgatacgcggacacctaaggcgaaaagagggaccgcccaaatcatggaagtgaccgctaagtggctgtggggattcctcagccggaacaaaaagccccgcatttgtacaagagaggaatttacgcggaaggtccgctctaatgccgctatcggcgccgtgttcgttgacgagaaccagtggaatagcgccaaagaggcggtggaagacgagagattttgggatctggggcatcgggaacgcgagcttcacaagcagggaaaatgcgctacctgcgtctccaacatgatgggcaagagagagaaaaagctgggggagttcggcaagcctaaaggatctcggcccatttggtacatgtggctcggcgcccgctttctggagttcgaagccctggggttcatgaatgaggaccactggtttagcagagaaaactccctctctggagtggagggcgaggggctgcataaacttggatacatcctgcgggatattagcaaaatcccgggcgggaatatgtatgctgacgatacagccggctgggacacccgcatcacagaagatgacctccagaacgaggctagaattaccgatatcatggaacctgagcacgccctgcttgcgaagtccattttcaaactgacataccaaaataaggtcgtgcgggttcagcgccccgccaaaaacggaaccgtgatggacgtcatctctagcagagatcagcggggctccggacaggtgggaacgtatggcctcaatacctttacaaacatggaagctcaactgattagacagatggagagcgaggggatcttctctccttccgaactggagacccccaacctcgccgaacgcgtgctggactggcttgagaagtacggagttgaacggctgaagagaatggctatcagcggcgatgactgtgtggtcaaacctattgacgatcgctttgccacagcgctcaccgccctgaatgacatggggaaggtgcggaaagatatcccccagtgggagccgtctaagggctggaacgactggcagcaagttcctttctgctcccatcactttcaccagcttattatgaaagatggaagagagatcgtggtcccctgtcgcaatcaggacgaactggtgggccgggctagagtcagccagggggccggatggtccctccgcgagacggcttgcctgggcaagtcttatgcccaaatgtggcagctgatgtacttccatcggagagatctccgcctggctgccaacgcgatttgtagcgccgtgcccgttgactggatccctacatcccggaccacatggagcattcacgctcatcaccagtggatgaccacggaagatatgctttctgtgtggaatagagtctggatcgaggaaaacccgtggatggaggacaagacccatatctccagctggggagatgtgccctatctgggaaaacgggaggaccaatggtgcggctctctcattgggctgacagccagagccacctgggctacaaatatccaggttgccattaaccaggtgcgccggcttatcggcaatgaaaactacctggactacatgaccagcatgaagagatttaaaaatgagtccgatcctgaaggagcgctctggtga

SEQ ID NO: 18892 - RNA, 9879 nt, synthetic construct
  misc_feature 1..9879: note = derived and/or modified CDS sequence (opt5) from DENV-1__FJ432729__SS-prME
  source 1..9879: mol_type = other RNA
agcgtgaccatgctgctcatgctgatgcccaccgcccttgctttccacctgacgacccggggcggggagcctcatatgatcgtcacaaagcaggaacggggaaagtccctcctgtttaagacctctgccggcgttaacatgtgcacacttattgccatggacctgggggagctctgtgaagataccatgacatacaagtgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgtcattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataaacccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaattgccaccatcacgccccaggctcctaccagcgagattcagctcacagactacggcgccctgaccctggattgttctccccggacaggcctcgacttcaacgaaatggtgctgcttaccatgaaggagaaatcctggctggtccataagcagtggtttctcgatctgcctcttccctggacgagcggggcctccacatctcaagagacctggaatcgccaggacctgctcgtgacattcaaaaccgctcacgcgaagaagcaggaagtcgtggttctgggaagccaagagggcgccatgcacaccgctctgacaggggccacggaaatccagacctccggaacaaccacaatttttgccggccatctcaaatgcagactgaagatggataaacttaccctgaaggggatgagctatgtgatgtgtacgggctctttcaaactcgagaaggaagtcgctgagacacagcacggaaccgtgctggttcagatcaagtacgagggcaccgacgccccgtgcaaaatccctttctccacacaagatgaaaagggggtgacccagaacggacggctgattacagcgaatcccatcgtcacggacaaagagaagcctgtgaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgtccagaatacaacctttattatcgatgggcctaacacccccgaatgtcctgacgatcagagagcctggaatatttgggaggttgaggactatggattcggcatctttacaaccaacatttggctgaagctgcgcgattcccacacacaggtgtgcgaccatcggcttatgagcgctgcgatcaaagattctaaggccgtgcacgctgacatgggctactggatcgaatccgagaaaaatgaaacatggaagctcgccagagccagcttcattgaggtcaagacctgtatctggcccaaatctcatacactgtggtccaacggggtgctggaaagcgagatgattatcccgaagatttatggaggccctatctctcaacacaattaccgccccgggtatttcacccagacagctggaccttggcacctcggcaaactggagcttgattttgacctgtgcgaagggaccacggttgtggtcgatgagcattgcggaaaccggggccccagcctcagaaccacaaccgtgacaggcaagatcattcacgaatggtgttgccggtcctgtaccctgcctcccctgcgcttcaaaggggaggacggatgctggtacggcatggagatcagaccggttaaggaaaaggaggaaaatcttgtgaaaagcatggtctctgccgggtccggagaggtggacagcttttccctcggcctgctgtgtatttctatcatgattgaagaggttatgcggagcagatggtcccgcaagatgctcatgacggggacactggcggtgttccttctgctcatcatgggacagctgacctggaacgatctgattcggctttgcatcatggtcggcgctaatgcctctgacagaatgggcatggggacaacctacctggccctcatggctacctttaaaatgcgccctatgttcgccgtgggactgctctttagacggctgacaagccgcgaggtgcttctgctcacgatcggcctgtccctggtcgcgtctgttgaacttcccaacagcctggaggaactcggggatggactggctatgggcattatgatcctcaagctgcttaccgacttccaatcccatcagctgtgggccacactcctgagcctgacctttattaaaacaaccctttctctgcactatgcctggaagacgatggctatggtgctctccatcgtgagcctgttccccctctgtctgtctacaacctcccagaagaccacatggcttcctgtcctgctggggagcctcggatgcaaaccgctggccatgcttctgattgctgagaataagatctggggcagaaaatcttggcccctcaacgaaggcatcatggccgtgggggttgtgtccattctgctcagctccctgcttaagaacgatgtccctctggcgggacccctgatcgccggcgggatgctcattgcttgttacgtgatcagcggatctagcgccgacctgtcccttgagaaagctgccgaggtttcttgggaagaggaagccgagcatagcggcgcttcccacaatattctggtggaagtccaggatgacgggaccatgaagatcaaagatgaggagcgggacgatacactcacgatcctgctcaaggcgaccctgcttgccgtgtctggagtctatcctctgagcattcccgctacactgtttgtgtggtacttctggcaaaagaaaaagcagcgctccggcgttctctgggacaccccttctcccccggaagtggagagagccgtcctggatgacggcatctatcggattatgcagcgcgggcttctgggaagaagccaggtgggcgttggggtgtttcaagaaaacgtcttccacacaatgtggcatgtgacccggggagccgtgctcatgtaccagggcaaacgcctggagccttcctgggctagcgttaagaaagacctcatctcttatgggggaggctggagactgcagggctcctggaatacgggggaggaagtccaggtgattgccgtggagcccggaaagaaccctaagaatgtccaaaccgcgcccggcacattcaaaaccccggaaggggaggtgggagctatcgcccttgattttaagcctggcacaagcgggtctcccattgttaaccgggaaggaaaaatcgtgggcctgtacggcaatggggtcgtgaccacatccggaacgtacgttagcgccatcgctcaggccaaggcgtcccaggagggccctctgcccgagattgaagacgaggtgttcagaaaacgcaacctcaccatcatggatctgcaccccgggtctggaaagacacggagatatcttcctgctattgtccgcgaagccatcaagcggaaactgagaaccctcattctggccccgacccgcgtggttgctagcgagatggccgaagctctgaagggcatgcccatccggtaccaaacaacggccgtgaaatccgagcataccgggaaggagatcgtcgacctcatgtgccacgcgacatttaccatgagacttctgagccctgtgcgcgtgcccaattataacatgattatcatggatgaagcccatttcacagacccttcttccattgctgcccggggctacatcagcaccagagtcggaatgggcgaggctgccgccatttttatgacggctacaccccctgggtctgttgaagcgttcccgcagagcaatgccgtgatccaggatgaggaacgggacatccccgagcgctcctggaactctggatatgagtggattaccgattttcctggcaaaaccgtgtggttcgtccccagcatcaagtccgggaatgacattgctaactgtctgagaaagaatggaaaacgggtgatccagctctctcgcaagacatttgataccgaataccagaagacgaagaacaacgactgggactatgttgtgaccacggatattagcgagatgggcgccaatttcagagccgaccgggtcatcgatcctagacgctgcctgaaacccgtgattcttaaggacgggccggaacgggttatcctggctggccctatgcccgtgacagtcgcctccgcggctcagagacgcggacggatcggcagaaaccacaataaggagggggatcagtacatttacatgggacagcccctcaacaatgacgaggatcacgcccattggaccgaagccaaaatgctgctggacaacatcaatacacctgagggcattatccccgctctctttgaacctgagcgcgaaaagagcgccgcgattgatggggagtatcggcttagaggagaggcccgcaaaaccttcgtggaactgatgagacggggcgacctgccggtctggctctcttacaaggtggcttccgaggggttccaatatagcgatcgcagatggtgctttgacggcgaacggaacaatcaggttctggaggaaaacatggatgtggagatctggacgaaagagggagaacgcaagaaacttagaccccggtggctggacgccagaacctactccgaccctctcgctctgcgcgagttcaaggaatttgccgctggccggagatctgtgagcggggatctgatcctcgagattggaaaacttccccagcacctgacacagcgcgcccaaaatgcgctggacaacctcgtcatgctgcataattccgaacagggcgggcgggcctatagacacgctatggaggagcttcctgataccatcgaaacactgatgctcctggccctgattgctgttctcaccggaggcgtgacacttttctttctgtctggccgggggctgggaaaaaccagcatcggcctcctgtgtgtgatggcctccagcgtccttctgtggatggcctctgtggagccccactggattgctgcgtccatcatcctcgagttctttctgatggttctgctcattccggagcctgaccgccagagaacgccccaggataaccaacttgcctacgtggtcatcgggctgctgttcatgattctcacagtggctgccaatgagatgggactgcttgaaaccaccaagaaagacctgggcatcgggcatgtcgccgtggagaaccaccatcacgctacaatgctcgatgttgacctgcatcctgccagcgcgtggaccctgtatgccgtggctacaacgattatcacccccatgatgcggcacacaattgaaaacaccacagccaatatctctctcaccgctatcgccaaccaggcggccattcttatgggactggataagggctggcctatctccaaaatggacattggcgtccccctgctcgctctggggtgctacagccaggtgaatccgcttacgctgaccgccgctgttctcatgctggtggcccactacgctatcattggacctggcctgcaagccaaggcgacacgcgaggcccagaagagaaccgctgccgggatcatgaaaaaccccacagtcgatggaatcgtggctattgacctcgatcccgtggtttatgacgccaagtttgaaaaacagcttggccagatcatgctgctgattctctgtacctctcaaatcctgcttatgcggacgacatgggccctgtgcgagagcattaccctcgcgacagggcctctgaccaccctgtgggagggatccccgggcaagttctggaatacaacgatcgctgtctctatggccaacatctttcgcggcagctacctcgctggggccggacttgccttctccctgatgaaaagcctgggcgggggaagacggggcaccggggctcagggagaaacactcggcgagaagtggaagcgccagctgaatcagctttccaaatctgaatttaacatttataagagaagcggcatcatggaggtggaccggtccgaagccaaagaggggctgaagagaggagagaccacacgccatgcggtgtctcggggcaccgccaaactcagatggttcgtcgaacgcaatctggttaagcccgaggggaaggtgattgatctgggatgtggcagagggggatggagctactattgcgctggcctcaaaaaggtgacggaagtcaaaggctacacaaaagggggacctggccacgaggaacccatccctatggccacctatgggtggaaccttgtgaaactgcattccggaaaggacgttttctttacaccccctgagaaatgtgatacactgctctgcgacattggcgagtctagcccgaatcccaccatcgaagaggggagaacactgcgcgtgcttaagatggtcgaaccttggctgcggggaaaccaattctgtattaagatcctcaatccctacatgccttccgtggttgagacgctggagcagatgcagagaaaacacggcggcatgctggtgcgcaaccccctcagcagaaattctacccacgaaatgtactgggtctcctgcgggacaggaaacatcgtgagcgctgtgaatatgacctctagaatgctgcttaaccgctttacaatggcccatcggaagccgacctatgagagagatgtcgacctgggcgcggggacgcgccacgttgccgtggaacctgaggtggctaacctcgatattatcggacagagaattgaaaatatcaaacatgagcacaagtccacctggcattacgacgaggataacccctataaaacatgggcctaccacggcagctatgaagtcaagccctctgggtccgctagctccatggtgaatggagttgtgaagctgcttaccaaaccttgggacgtcattcccatggtgacacaaatcgccatgaccgatacaacccctttcggccagcagcgggtttttaaggagaaagtggacacgcgcacaccgaaggctaaaagaggcaccgcccaaatcatggaagtcaccgcgcggtggctgtgggggttcctcagcagaaacaagaagccccggatttgtacacgcgaggaatttacgagaaaagtgcggtctaatgccgctatcggagccgttttcgtggacgagaaccagtggaatagcgctaaggaggccgtcgaagatgagcgcttttgggacctggtgcagaaagaaagagagctgcacaagcagggcaaatgcgcgacctgcgtctacaacatgatggggaagcgggaaaagaaactcggagagttcggcaaggcgaaagggtcccgcgctatttggtatatgtggctgggcgccagatttcttgagttcgaagccctgggatttatgaatgaggatcattggttctctcgggaaaacagcctctccggcgtggagggggagggactgcacaaacttggctacatcctgcgcgacatttctaaaatccctgggggaaatatgtacgctgatgacacagccggctgggataccagaatcacagaagacgatctccaaaacgaggctcggattaccgacatcatggaacccgagcatgccctgctggcgacaagcattttcaagctcacctatcagaataaagttgtgcgcgtccagagacctgccaagaacgggacggtgatggatgtgatctcccggcgcgaccagagaggctctggacaagttggcacctacgggctgaatacatttaccaacatggaagctcagcttattcggcagatggagagcgagggaatcttcctgccctccgaactcgagacacagaacctggccgaaagagtgcttgattggctggagaagtatggcgtcgaacgcctcaaacggatggctatcagcggggacgactgtgtggttaagccgattgatgacagatttgccaccgcgctgacggccctgaatgatatgggaaaagtgcgcaaggacatccctcaatgggagccctctaaaggctggaacgattggcagcaggtccctttctgctcccaccactttcatcagctcattatgaaggacgggcgggagatcgtggtcccctgtagaaatcaagatgaactggtgggccgcgctcgggttagccagggagccggctggtctcttagagagacagcttgcctggggaagtcctacgcccagatgtggcaactcatgtatttccaccgccgggacctgagacttgctgccaacgcgatttgtagcgccgtgcctgtcgattgggtgcccacctcccgcacaacctggtctatccatgctcaccatcagtggatgacgaccgaagacatgctgagcgtttggaatcgggtgtggattgaggaaaacccgtggatggaggataaaacacacgtctccagctggggagacgtgccttacctcggcaagagagaggaccagtggtgcgggtctctgatcggactgaccgcccgggccacatgggcttccaatatccaggtggccattaaccaagttagacgcctcatcggcaatgaaaactatctggattacatgaccagcatgaaacggtttaagaatgagggggaccccgaaggcgcgctttggtga

SEQ ID NO: 18893 - RNA, 9879 nt, synthetic construct
  misc_feature 1..9879: note = derived and/or modified CDS sequence (opt5) from DENV-1__FJ432730__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaatgaccacaattttcgctggccatctgaagtgcagactcaaaatggataagctgacccttaaagggatgtcttatgtgatgtgtacgggctccttcaagctggagaaggaagtcgccgagacacagcacggaaccgtgctcgttcagatcaaatacgagggcaccgacgcgccgtgcaagattccttttagcacacaggatgaaaaaggggtgacccaaaacggacggctgatcacagctaatcccatcgtcacggacaaggagaaacctgtgaacattgaagccgagccgcccttcggcgagtcttatatcgtgattggggccggagaaaaggctctgaaacttagctggtttaaaaagggctcctctatcgggaaaatgttcgaggccaccgctagaggcgcccgccggatggcgattctcggagatacagcctgggactttggcagcatcgggggagttttcacctccgtcggcaagctggtgcatcagatctttgggacagcttacggagtgctgttcagcggcgtctcttggaccatgaaaattgggatcggcgtgctcctgacgtggcttggactcaattccagaagcacctctctctccatgacatgtattgccgttggcctggtgaccctgtaccttggggtcatggtgcaggctgatagcggatgcgttatcaactggaagggccgcgaactcaagtgtgggtccggaatttttgtgacaaatgaggtccacacctggacagaacagtataaattccaagccgactctcctaagcggctgagcgcggccatcggcaaggcttgggaggagggggtgtgcggcattagatccgccacccgcctggaaaacatcatgtggaagcagatctctaacgagctcaatcatattctgcttgaaaacgacatgaaatttacggttgtggtcggagatgtggctggcatcctggcccaggggaagaaaatgattcggccgcagcccatggagtacaagtatagctggaagtcctggggaaaagccaagatcattggcgctgacgtgcaaaatacaaccttcatcatcgatgggcctaacacccccgaatgtcctgacgatcagagagcgtggaatatttgggaggtcgaggactacggatttggcatcttcacaaccaacatttggctcaaactgcgcgatagctatacgcaggtttgcgaccaccggctgatgtctgccgctatcaaggattccaaagccgtgcacgccgacatgggctactggattgaaagcgagaagaatgaaacatggaaacttgctagagcctctttcatcgaggtgaaaacctgtatctggcccaagtcccatacactctggagcaacggggtcctggaatctgagatgattatcccgaaaatttatggaggccctatcagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaattatccacgaatggtgttgccggagctgtaccctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacggggacactcgccgtctttttcctgcttatcatgggacagctgacctggaacgatctcattcggctgtgcatcatggtgggcgccaatgctagcgacagaatgggcatggggacaacctacctggcccttatggcgacctttaagatgcgccctatgttcgctgtcggactgctctttagacggctgacatcccgcgaggtgctcctgcttacgattggcctgtctctcgtggccagcgtcgaactgcccaactccctggaggaacttggggatggactggccatgggcatcatgatcctcaaactgctcaccgacttccagagccatcaactgtgggctacacttctgtctctcacctttattaagacaaccttctccctgcactatgcctggaagacgatggctatggttctgagcatcgtgtctctttttcccctgtgtctctccacaaccagccagaaaaccacatggctgcctgtgctcctggggtctcttggatgcaagccgctgaccatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacaatgaaaattaaggatgaggagcgggacgatacgctcaccatcctgcttaaggccacactgctcgctgtgagcggagtctatcctctgtccatccccgccaccctcttcgtgtggtacttttggcagaaaaagaaacaacgctctggcgtcctgtgggacacaccttcccctcccgaagtggagagagccgttcttgatgacggcatttatcggatcatgcagcgcgggctgctgggaagatcccaggtgggcgtcggggtgttccaggaaaacgtttttcataccatgtggcacgtgacgcggggagctgtcctcatgtaccaaggcaagcgcctggagcccagctgggcctctgtgaaaaaggaccttatttcctacgggggaggctggagactgcagggcagctggaataccggggaggaagtgcaggttatcgcggtcgagcccggaaagaaccctaaaaatgtgcagacagctcccggcaccttcaagacatctgaaggggaggtgggagccattgccctcgattttaaaccgggcacctccgggagccctatcgtcaaccgggaaggaaagattgtgggcctgtatggcaatggggttgtgacaacgtccggaacctacgtctctgctatcgcccaagcgaaagctagccaggagggccccctccctgagatcgaagacgaggtgttcagaaagcgcaacctgacaattatggatcttcaccccgggtccggaaagacccggagatatctgcccgccatcgttcgcgaagccattaaacggaagctgagaaccctcatcctggctcctacacgcgtggtcgccagcgagatggctgaagcccttaaaggcatgccgattcggtaccagacgaccgcggtgaagtctgagcatacagggaaagagatcgttgacctgatgtgccacgccacctttacaatgagactcctgtcccccgtgcgcgtccctaattataacatgatcattatggatgaagctcatttcaccgaccccagctctatcgccgctcggggctacattagcacgagagtgggaatgggcgaggccgccgctatctttatgacagcgacccctcccgggtccgtggaagccttccctcaatctaatgctgtcattcaggatgaggaacgggacatcccggagcgcagctggaactccggatatgagtggatcaccgattttcccggcaagacagtttggttcgtgccttctattaagagcgggaatgacatcgccaactgtctgcgcaagaatggaaagcgggtgattcagctctcccgcaaaaccttcgatacagaataccagaagaccaaaaacaacgactgggactacgtcgtgacgacagatatcagcgagatgggcgccaattttagagctgaccgggttattgatcccagacgctgccttaagcctgtgatcctgaaggacgggcccgaacgggtcattctggccggcccgatgcctgtgaccgttgcgtctgctgcccaaagacgcggacggatcggcagaaaccacaataaagagggggatcagtatatctacatgggacagcccctcaacaatgacgaggatcatgcccactggacagaagctaagatgctgcttgacaacattaatacccccgagggcatcattcctgccctgttcgaacccgagcgcgaaaaatccgcggccatcgatggggagtatcggctcagaggagaggctcgcaagacgtttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggaccaaggagggagaacgcaaaaagctgagaccgcggtggctggacgctagaacatacagcgaccccctcgccctgcgcgagttcaaggaatttgctgccggccggagatccgtttctggggatcttatcctggagatcggaaaactccctcagcacctgacccagcgcgcgcagaatgccctggacaacctcgtgatgcttcataatagcgaacaaggcgggcgggcttatagacacgccatggaggagctgcccgatacaattgaaaccctgatgctcctggctcttatcgccgtgctgacaggaggcgtcaccctcttctttctgtccggccgggggctgggaaagacgagcattggcctcctttgtgttatggcctcttccgtgctgctgtggatggctagcgtggagcctcattggatcgcggcctctattatcctcgagttctttctgatggtccttctgatccccgagccggaccgccagagaacacctcaggataaccagctcgcttacgtggttattgggctgctgttcatgatcctcaccgtggccgccaatgagatgggacttctggaaaccaccaagaaggacctgggcattgggcacgtcgctgtggagaaccaccatcacgccgcgatgctcgatgtcgacctgcatcccgcctccgcttggaccctttacgccgtggctacaacgatcattacccctatgatgcggcacacaatcgaaaacaccacagccaatattagcctgaccgcgatcgccaaccaagctgccatcctcatgggactggataaaggctggcccatttctaagatggacatcggcgttcctctgctcgctcttgggtgctatagccaggtgaatcccctgacgctgaccgccgctgtcctcatgctggtggcccattacgcgattatcggaccgggccttcaggccaaggctacacgcgaggcccagaagagaaccgctgccgggattatgaagaaccctacagttgatggaatcgtggccatcgacctggatcccgtcgtgtatgacgcgaaatttgaaaagcagctcggccagattatgctgctgatcctctgtacctcccagattcttctgatgcggacgacatgggctctgtgcgagtctatcaccctcgccacagggcccctgaccaccctttgggagggaagccctggcaaattctggaatacaacgattgctgtgtccatggccaacatcttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcatcatggaggttgaccggagcgaagccaaggaggggctgaaaagaggagagacaaccaagcacgctgtctcccgcggcacggccaagctccggtggtttgtggaaagaaatctggtgaaaccggaggggaaggtcattgatcttggatgtggccgcgggggatggtcttactattgcgctggcctgaaaaaggttacagaagtgaaaggctacaccaaagggggacccggccacgaggaacctatccccatggccacctacgggtggaacctcgtgaaactgcatagcggaaaggacgtcttctttattcctcccgagaagtgtgatacactgctctgcgacatcggcgagtccagccctaatccgaccattgaagaggggcggacacttagagtgctgaaaatggttgaaccctggctgcgcggaaaccagttctgtatcaagattctcaatccttatatgccctctgtggtcgagacgctggagcaaatgcagcggaaacacggcggcatgcttgtgagaaaccctctgtcccgcaatagcacccatgaaatgtactgggtttcttgcgggacaggaaacatcgtgtccgcggtcaatatgaccagccggatgctcctgaacagatttacaatggcccaccgcaagcccacctatgagcgggatgtggacctgggcgctgggacgagacacgtggccgtcgaaccggaggttgctaacctcgatatcattggacagcgcatcgaaaatattaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttatccctatggtgacacagattgccatgaccgatacaacccccttcggccaacagagagtctttaaggagaaagtggacacgcggacacctaaggcgaagcgcggcaccgcccagatcatggaagttaccgctaaatggctgtgggggttcctcagcagaaacaagaaaccgcggatctgtacaagagaggaatttacgcggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacctgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacacagccggctgggatacccgcatcacagaagacgatctccagaacgaggcgaagatcaccgacattatggaacctgagcacgccctgcttgctaagtctatcttcaaactgacatatcagaataaggtcgtgagagttcaacggcccgccaaaaacgggaccgtgatggatgtcattagccgcagagaccagcggggctccggacaggtgggcacgtacgggctcaatacctttacaaacatggaagctcagctgatccgccaaatggagagcgagggaattttctctccttccgaactggagacccccaacctcgccagacgggtgctggattggcttgaaaagcatggcgttgagagactgaaacgcatggcgatcagcggggacgactgtgtggtcaagccgatcgatgaccggtttgccacagctctcaccgccctgaatgatatgggaaaggtgagaaaagacattcctcagtgggaaccctctaagggctggaacgattggcagcaggttcctttctgctcccaccactttcatcaacttatcatgaaagacgggcgcgagattgtggtcccctgtcggaatcaggatgagctggtgggcagagctcgcgtcagccagggagccggctggtccctccgggaaacggcttgcctggggaagtcttatgcccagatgtggcaactgatgtacttccacagacgcgacctccggctggcggccaacgctatctgtagcgccgtgcctgttgattgggtgcccacatccagaaccacatggagcattcatgcccaccatcagtggatgaccacggaggacatgctttctgtctggaatcgcgtgtggatcgaagagaacccgtggatggaagataaaacccacatttccagctggggagacgttccttatctgggcaagcgggaggaccagtggtgcgggtctctcatcggactgacagctagagccacctgggcgacaaatatccaagtggctattaaccaggtccggagacttatcggcaatgagaactacctggattacatgaccagcatgaagcgctttaaaaatgaatccgaccccgagggggccctctggtga

SEQ ID NO: 18894 - RNA, 9879 nt, synthetic construct
  misc_feature 1..9879: note = derived and/or modified CDS sequence (opt5) from DENV-1__FJ432732__SS-prME
  source 1..9879: mol_type = other RNA
agcgtgaccatgctgctcatgctgatgcccacggcccttgctttccacctgacgaccagaggcggggaacctcatatgatcgtctccaagcaggaacgggggaaatctctcctgtttaagaccagcgccggcgttaacatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaagacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggctctttcaaactcgagaaggaagtggccgagacccagcacggaacagttctggtgcagattaagtacgagggcaccgacgctccgtgcaaaatccctttctccacacaagatgaaaagggggtcacgcagaacggacggctgatcaccgccaatcccattgtgacagacaaagagaagcctgtgaacatcgaagcggagccgccctttggcgagagctatattaccatcggggctggagaaaaagcccttaagctctcttggttcaagaaaggcagctccattgggaagatgtttgaggccacagctagaggcgcccgccggatggctatcctgggagataccgcctgggacttcggctctatcgggggagtttttacgagcgtcggcaaactggtgcatcagattttcgggaccgcgtacggagtgctcttttccggcgtcagctggacaatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacgtggacagaacaatataagtttcaggccgactcccctaaacggctgtctgctgccattggcaaggcgtgggaggagggggtgtgcggcatcagaagcgccacccgcctcgaaaacatcatgtggaaacagatttccaacgagctgaatcatatccttctggaaaacgacatgaagttcaccgttgtggtcggagatgtggctggcatttttgcccaggggaaaaagatgatccggccgcaacccatggagtacaaatattcttggaaaagctggggaaaggctaagattatcggcgccgacgtgcagaatacaaccttcatcattgatgggcctaacacgcccgaatgtcctgacgatcagagagcctggaatatctgggaggtcgaggactacggatttggcattttcacaaccaacatctggctcaagctgcgcgattcctatacacaggtttgcgaccaccggctgatgagcgctgcgattaaagattctaaggccgtgcacgctgacatgggctactggatcgaatccgagaaaaatgaaacctggaaacttgccagagccagcttcatcgaggtgaagacatgtatttggcccaaatctcataccctctggtccaacggggtcctggaaagcgagatgatcattccgaagatctatggaggccctatttctcaacacaattaccgccccgggtactttacgcagaccgctggaccttggcatctgggcaaactcgagctggatttcgacctttgcgaagggacaaccgtggttgtggatgagcactgcggaaaccggggccccagcctgagaacaaccacggtcacaggcaagatcatccacgaatggtgttgccggtcctgtaccctccctcccctgcgctttagaggggaggacggatgctggtatggcatggagattcggccggtgaaagaaaaggaggaaaatctggttaagagcatggtgtctgccgggtccggagaggtcgacagcttctcccttggcctcctgtgtatctctattatgatcgaagaggtgatgagaagccgctggtcccggaaaatgctgatgacagggaccctcgcggtctttttcctgcttattatgggacagctgacctggaacgatctcatcagactgtgcattatggtgggcgctaatgcctctgaccgcatgggcatggggacaacgtacctggcccttatggctacctttaagatgagacctatgttcgccgtcggactgctctttcggcgcctgacaagcagagaggtgctcctgcttaccatcggcctgtccctcgtggcgtctgtcgaactgcccaacagcctggaggaacttggggatggactggctatgggcatcatgattctcaaactgctcacagacttccaatcccatcagctgtgggccacccttctgagcctcacgtttatcaagacaaccttctctctgcactatgcctggaaaaccatggctatggttctgtccattgtgagcctttttcccctgtgtctctctacaacctcccagaagacaacgtggctgcctgtgctcctggggagccttggatgcaagccgctgaccatgttcctgatcgccgagaataaaatttggggccggcgctcttggcccctcaacgaaggcatcatggctgtcgggatcgtgtccattctgcttagctccctgctcaagaacgatgttcctctggccggacccctcatcgcgggcgggatgctgattgcctgttacgtgatcagcggatctagcgctgacctttccctggagaaagccgctgaggtctcttgggaagaggaagccgagcatagcggcgcctcccacaatattctggtggaagttcaggatgacgggacaatgaagatcaaagatgaggagagagacgataccctcacaatcctgcttaaggctaccctgctcgcggtgtctggagtctatcctctgagcattcccgccacactcttcgtgtggtacttttggcagaagaagaagcagcggtccggcgtcctgtgggacaccccttctcccccggaagtggagcgcgctgttcttgatgacggcatctatagaattatgcagcgggggctgctgggacgcagccaggtgggcgtcggggtgttccaagaaaacgtttttcatacaatgtggcacgtgaccagaggagccgtcctcatgtaccagggcaaacggctggagccttcctgggccagcgtgaagaaagaccttatctcttacgggggaggctggagactgcagggctcctggaatacaggggaggaagtgcaggttattgctgtcgagcccggaaagaaccctaaaaatgtgcaaaccgcccccggcacattcaagacgccggaaggggaggtgggagcgatcgctctcgattttaagcctggcaccagcgggtctcccattgtcaaccgcgaaggaaaaatcgtgggcctgtatggcaatggggttgtgacaacctccggaacctacgtcagcgccatcgcccaggctaaggcctcccaggagggccctctccccgagattgaagacgaggtgttccggaaaagaaacctgacaatcatggatcttcaccccgggtctggaaagacgcgccggtatctgcctgcgattgttagagaagctatcaaacgcaagctgcggaccctcattctggccccgacaagagtggtcgccagcgagatggctgaagcccttaagggcatgcccatccgctaccaaaccacagctgtgaaatccgagcataccgggaaggagatcgttgacctgatgtgccacgccacgtttacaatgcggctcctgagccctgtgagagtccccaattataacatgattatcatggatgaagcgcatttcaccgacccttcttccattgccgctcggggctacatcagcacccgcgtgggaatgggcgaggccgctgccatttttatgacagccacaccccctgggtctgtggaggctttcccgcagagcaatgcggtcatccaggatgaggaaagagacatccccgagcggtcctggaactctggatatgagtggattacagattttcctggcaaaaccgtttggttcgtgcccagcatcaagtccgggaatgacattgccaactgtctgcgcaaaaatggaaagagagtgatccagctctctcggaagacgttcgatacagaataccagaaaaccaagaacaacgactgggactacgtcgtgacaaccgatattagcgagatgggcgctaattttagagccgaccgcgttatcgatcctcggagatgccttaaacccgtgattctgaaggacgggccggaacgcgtcatcctggccggccctatgcccgtgacggttgcttccgccgcgcagcggagaggacgcatcggccggaaccacaataaagagggggatcagtatatttacatgggacagcccctcaacaatgacgaggatcatgctcactggaccgaagccaagatgctgcttgacaacatcaatacacctgagggcattatccccgccctgttcgaacctgagagagaaaagagcgctgccattgatggggagtatcgcctcagaggagaggcgcggaaaacctttgtggaactgatgcgcagaggcgacctgccggtctggctctcttacaaggtggcctccgaggggttccaatatagcgatcggcgctggtgctttgacggcgaaagaaacaatcaggtccttgaggaaaacatggatgtggagatctggacaaaagagggagaacggaagaaactgagaccccgctggctggacgctcggacctactccgaccctctcgccctgagagagttcaaggaatttgctgccggccgccggtctgttagcggggatcttatcctggagattggaaaactcccccagcacctgacacagagagctcaaaatgccctggacaacctcgtgatgcttcataattccgaacagggcgggcgggcgtatcgccacgccatggaggagctgcctgataccatcgaaacgctgatgctcctggctcttattgccgtgctgacaggaggcgtcaccctcttctttctgtctggcagagggctgggaaagaccagcatcggcctcctttgtgttatggcttccagcgtgctgctgtggatggcctctgtggagccccattggattgccgcttccatcatcctcgagttctttctgatggtccttctgattccggagcctgaccggcagcgcacaccccaggataaccaactcgcgtacgtggttatcgggctgctgttcatgattctcaccgtggccgctaatgagatgggacttctggaaacaacgaagaaagacctgggcatcgggcacgtcgccgtggagaaccaccatcacgccgctatgctcgatgtcgacctgcatcctgccagcgcgtggaccctttacgccgtggctacaaccattatcacacccatgatgagacacaccattgaaaacacgaccgccaatatctctctgacagctatcgccaaccaggcggccattctcatgggactggataagggctggcctatctccaaaatggacattggcgttcccctgctcgctcttgggtgctatagccaggtgaatccgctgaccctgacagccgctgtcctcatgctggtggcccattacgctatcattggacctggccttcaagccaaggcgacccgggaggcccagaaacgcacggctgccgggatcatgaagaaccccacagttgatggaatcgtggctattgacctggatcccgtcgtgtatgacgccaagtttgaaaaacagctcggccagatcatgctgctgattctctgtacctctcaaatccttctgatgagaacaacctgggccctgtgcgagagcattaccctcgcgacagggcctctgacgaccctttgggagggatccccgggcaagttctggaatacaaccatcgctgtgtctatggccaacatcttccggggcagctacctggctggggccggactcgccttttccctgatgaaaagcctgggcgggggacgcagaggcacaggggctcagggagaaaccctcggcgagaagtggaaacggcagcttaatcagctgtccaagtctgagttcaacacgtataagagaagcggcattatggaggttgaccgctccgaagccaaagaggggctgaagcggggagagacaaccaaacacgcggtctctagaggcaccgccaagctccgctggtttgtggaacggaatctggtgaaacccgaggggaaggtcatcgatcttggatgtggcagagggggatggagctactattgcgctggcctgaagaaagttacagaagtgaagggctacaccaaagggggacctggccacgaggaacccattcctatggccacatacgggtggaacctcgtgaagctgcattccggaaaagacgtcttctttattccccctgagaagtgtgatacgctgctctgcgacattggcgagtctagcccgaatcccaccatcgaagaggggcgcacacttcgggtgctgaaaatggttgaaccttggctgagaggaaaccaattctgtattaagatcctcaatccctatatgccttccgtggtcgagaccctggagcagatgcagcgcaagcacggcggcatgcttgtgcggaaccccctgagcagaaattctacacatgaaatgtactgggtttcctgcgggaccggaaacatcgtgagcgctgtcaatatgacgtctcgcatgctcctgaaccggtttaccatggcccacagaaaaccgacatatgagcgcgatgtggacctgggcgcggggaccagacacgtggccgtcgaacctgaggttgctaacctcgatattatcggacagcggattgaaaatatcaagcatgagcacaaatccacatggcattacgacgaggataacccctataagacctgggcctaccacggcagctatgaagtgaaaccctctgggtccgctagctccatggtgaatggagtcgtgaagctgcttacaaagccttgggacgttattcccatggtgacccaaatcgccatgacggatacaacccctttcggccagcagcgcgtctttaaagagaaggtggacaccagaacaccgaaagctaagcggggcacggcccaaatcatggaagttaccgcgaaatggctgtgggggttcctcagcagaaacaagaagccccggatttgtacacgcgaggaatttaccagaaaagtgcggtctaatgccgctatcggagccgtcttcgtggacgagaaccagtggaatagcgctaaggaggccgttgaagatgagcgcttttgggacctggtgcatagagaacgggagcttcacaaacagggcaagtgcgccacatgcgtctacaacatgatggggaaacgcgaaaagaagctgggagagttcggcaaagcgaaggggtccagagctatttggtacatgtggctcggcgcccggttcctggagtttgaagccctgggattcatgaatgaggatcactggttttctcgcgaaaacagcctctccggcgtggagggggagggactgcataaacttggctatatcctgagagacatttctaagatccctgggggaaatatgtacgctgatgacaccgccggctgggatacacggatcaccgaagacgatctccagaacgaggctcgcattacggacatcatggaacccgagcacgccctgcttgcgaaaagcattttcaagctgacctatcaaaataaagtcgtgagagttcagcggcctgccaagaacgggacagtgatggatgtcatctcccgcagagaccagcggggctctggacaggtgggcacctacgggctcaatacatttaccaacatggaagctcaactgattagacagatggagagcgagggaatcttctcccccagcgaactggagacgccgaacctcgccgaacgcgtgctggattggcttgagaagtatggcgttgaacggctgaaaagaatggctatctctggggacgactgtgtggtcaagcctattgatgaccgctttgccacagcgctcaccgccctgaatgatatgggaaaagtgcggaaggacatcccccagtgggagccttccaaaggctggaacgattggcagcaagttcccttctgcagccatcactttcaccagcttattatgaaggacgggagagagatcgtggtcccttgtcgcaatcaggatgaactggtgggccgggctagagtctctcagggagccggctggtccctccgcgagacagcttgcctgggaaagagctacgcccaaatgtggcagctgatgtatttccatcggagagacctccgcctggctgccaacgcgatttgttccgccgtgcccgttgattggatcccgacctctcggacgacctggagcattcacgctcatcaccagtggatgacaaccgaagacatgctttccgtgtggaatagagtctggatcgaggaaaacccttggatggaggataaaacacatatcagctcttggggagacgtgccctacctgggcaagcgggaggaccaatggtgcgggtccctcattggactgaccgccagagccacatgggctaccaatatccaggttgccattaaccaggtgcgccggcttatcggcaatgaaaactacctggattatatgacgagcatgaaaagatttaagaatgagtctgaccccgaaggggcgctctggtga

SEQ ID NO: 18895 - RNA, 9879 nt, synthetic construct
  misc_feature 1..9879: note = derived and/or modified CDS sequence (opt5) from DENV-1__FJ432733__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaagtccctcctgtttaagacctctgccggcgttaacatgtgcacacttattgccatggacctgggggagctctgtgaagataccatgacatacaagtgcccccgcatcaccgaggtggaacccgacgatgtggactgttggtgcaatgctacggatacctgggtcacatatggaacctgtagccagacaggcgagcaccggcgggacaagcgctccgtggccctggcccctcatgttgggctgggactcgagaccagaacggaaacatggatgtctagcgagggcgcttggaaacagattcagcgggtggaaacctgggccctgcgccaccccggcttcacagtcatcgctctttttctggcccatgtgattgggacctccatcacccagaagggaatcattttcatcctcctgatgcttgttacaccttctatggcgatgagatgcgtgggcattgggagccgggattttgtcgagggactgtccggcgccacgtgggtggacgtggtcctcgagcacgggagctgtgttaccacaatggctaaggataaacccaccctggacatcgaactgctcaagacagaggtgaccaaccctgccgtgctgcgcaaactttgcattgaagctaagatctctaatacgacaaccgattccagatgtccgacccaaggagaggccacactgatggaagaacaagacgcgaacttcgtctgccggcgcacctttgtggatagaggctggggcaatgggtgtggactcttcggcaaagggagcctgattacatgcgccaagtttaagtgcgttacgaaacttgagggaaagatcgtgcagtacgaaaacctgaaatattctgtcatcgtgaccgttcacacaggcgaccagcatcaagtggggaatgagtccaccgaacacggaacaattgctaccatcacgccccaggcccctaccagcgagattcagctcacagactacggcgctctgaccctggattgttctccccggacaggcctcgacttcaacgaaatggtcctgcttaccatgaaggagaaatcctggctggtgcataagcagtggtttctcgatctgcctcttccctggacgagcggggcctccacatctcaagagacctggaatcgccaggacctgctcgtcacattcaaaaccgcccacgctaagaagcaggaagtggttgtgctgggaagccaagagggcgcgatgcacaccgccctgacaggggctacggaaatccagacctccggaacaaccacaatttttgccggccatctcaaatgcagactgaagatggataaacttaccctgaaggggatgagctatgtcatgtgtacgggctctttcaaactcgagaaggaagtggccgagacacagcacggaaccgttctggtgcagatcaagtacgagggcaccgacgctccgtgcaaaatccctttctccacacaagatgaaaagggggtcacccagaacggacggctgattacagccaatcccatcgtgacggacaaagagaagcctgtgaacattgaagcggagccgccctttggcgagagctatatcgttattggggctggagaaaaagcccttaagctctcttggttcaagaaaggcagctccatcgggaagatgtttgaggccaccgctagaggcgcccgccggatggctatcctgggagatacagcctgggacttcggctctattgggggagtctttaccagcgtgggcaaactggtgcatcagatcttcgggacagcgtacggagtcctcttttccggcgtgagctggaccatgaagattgggatcggcgttctgcttacgtggctgggactcaattctagatccaccagcctgtctatgacatgtattgccgtgggcctggtcaccctttacctcggggtgatggttcaggctgattccggatgcgtgatcaactggaaaggccgcgaactgaagtgtgggagcggaattttcgtcacaaatgaggtgcacacctggacagaacaatataagtttcaggccgactcccctaaacggctgtctgctgccatcggcaaggcgtgggaggagggggtttgcggcatcagaagcgccacccgcctcgaaaacattatgtggaaacagatctccaacgagctgaatcatattcttctggaaaacgacatgaagttcacggtggtcgtgggagatgtggtcggcatcctcgctcaggggaaaaagatgattcggccgcaacccatggagcacaaatactcttggaaaagctggggaaaggccaagatcatcggcgctgacgttcagaatacaacctttattatcgatgggcctaacacccccgaatgtcctgacgatcagagagcctggaatatttgggaggtggaggactatggattcggcatctttacaaccaacatttggctgaagctgcgcgattcccacacacaggtgtgcgaccatcggcttatgagcgccgctatcaaagattctaaggcggtccacgccgacatgggctactggatcgaatccgagaaaaatgaaacatggaagctcgctagagccagcttcattgaggtgaagacctgtatctggcccaaatctcatacactgtggtccaacggggttctggaaagcgagatgattatcccgaagatttatggaggccctatctctcaacacaattaccgccccgggtatttcacccagacagccggaccttggcacctcggcaaactggagcttgattttgacctgtgcgaagggaccacggtggtcgtggatgagcattgcggaaaccggggccccagcctcagaaccacaaccgttacaggcaagatcattcacgaatggtgttgccggtcctgtaccctgcctcccctgcgcttcaaaggggaggacggatgctggtacggcatggagatcagaccggtgaaggaaaaggaggaaaatcttgtcaaaagcatggtgtctgctgggtccggagaggttgacagcttttccctcggcctgctgtgtatttctatcatgattgaagaggtgatgcggagcagatggtcccgcaagatgctcatgacggggacactggccgtcttccttctgctcatcatgggacagctgacctggaacgatctgattcggctttgcatcatggtgggcgcgaatgcttctgacagaatgggcatggggacaacctacctggccctcatggccacctttaaaatgcgccctatgttcgctgtgggactgctctttagacggctgacaagccgcgaggtccttctgctcacgatcggcctgtccctggttgcctctgtggaacttcccaacagcctggaggaactcggggatggactggcgatgggcattatgatcctcaagctgcttaccgacttccaatcccatcagctgtgggctacactcctgagcctgacctttattaaaacaaccctttctctgcactatgcctggaagacgatggccatggtgctctccatcgtcagcctgttccccctctgtctgtctacaacctcccagaagaccacatggcttcctgtgctgctggggagcctcggatgcaaaccgctggctatgcttctgattgccgagaataagatctggggcagaaaatcttggcccctcaacgaaggcatcatggctgttggggtggtctccattctgctcagctccctgcttaagaacgatgtgcctctggccggacccctgatcgcgggcgggatgctcattgcctgttacgttatcagcggatctagcgctgacctgtcccttgagaaagccgctgaggtgtcttgggaagaggaagccgagcatagcggcgcctcccacaatattctggtcgaagtgcaggatgacgggaccatgaagatcaaagatgaggagcgggacgatacactcacgatcctgctcaaggctaccctgcttgcggtctctggagtgtatcctctgagcattcccgccacactgtttgtttggtacttctggcaaaagaaaaagcagcgctccggcgtgctctgggacaccccttctcccccggaagtcgagagagctgtgctggatgacggcatctatcggattatgcagcgcgggcttctgggaagaagccaggttggcgtgggggtctttcaagaaaacgtgttccacacaatgtggcatgtgacccggggagccgttctcatgtaccagggcaaacgcctggagccttcctgggccagcgtcaagaaagacctcatctcttatgggggaggctggagactgcagggctcctggaatacgggggaggaagtccaggtgattgctgtcgagcccggaaagaaccctaagaatgtgcaaaccgcccccggcacattcaaaaccccggaaggggaggttggagcgatcgctcttgattttaagcctggcacaagcgggtctcccattgtgaaccgggaaggaaaaatcgtcggcctgtacggcaatggggtggttaccacatccggaacgtacgtgagcgccatcgcccaggctaaggcctcccaggagggccctctgcccgagattgaagacgaggtcttcagaaaacgcaacctcaccatcatggatctgcaccccgggtctggaaagacacggagatatcttcctgcgattgtgcgcgaagctatcaagcggaaactgagaaccctcattctggccccgacccgcgttgtggccagcgagatggctgaagccctgaagggcatgcccatccggtaccaaacaacggctgtcaaatccgagcataccgggaaggagatcgtggacctcatgtgccacgccacatttaccatgagacttctgagccctgtgcgcgtccccaattataacatgattatcatggatgaagcgcatttcacagacccttcttccattgccgctcggggctacatcagcaccagagttggaatgggcgaggccgctgccatttttatgacggccacaccccctgggtctgtggaggctttcccgcagagcaatgcggtgatccaggatgaggaacgggacatccccgagcgctcctggaactctggatatgagtggattaccgattttcctggcaaaaccgtctggttcgtgcccagcatcaagtccgggaatgacattgccaactgtctgagaaagaatggaaaacgggttatccagctctctcgcaagacatttgataccgaataccagaagacgaagaacaacgactgggactatgtggtcaccacggatattagcgagatgggcgctaatttcagagccgaccgggtgatcgatcctagacgctgcctgaaacccgttattcttaaggacgggccggaacgggtgatcctggccggccctatgcccgtcacagtggcttccgccgcgcagagacgcggacggatcggcagaaaccacaataaggagggggatcagtacatttacatgggacagcccctcaacaatgacgaggatcacgctcattggaccgaagccaaaatgctgctggacaacatcaatacacctgagggcattatccccgccctctttgaacctgagcgcgaaaagagcgctgccattgatggggagtatcggcttagaggagaggcgcgcaaaaccttcgtcgaactgatgagacggggcgacctgccggtgtggctctcttacaaggttgcctccgaggggttccaatatagcgatcgcagatggtgctttgacggcgaacggaacaatcaggtgctggaggaaaacatggatgtggagatctggacgaaagagggagaacgcaagaaacttagaccccggtggctggacgctagaacctactccgaccctctcgccctgcgcgagttcaaggaatttgctgccggccggagatctgtcagcggggatctgatcctcgagattggaaaacttccccagcacctgacacagcgcgctcaaaatgccctggacaacctcgttatgctgcataattccgaacagggcgggcgggcgtatagacacgccatggaggagcttcctgataccatcgaaacactgatgctcctggctctgattgccgtgctcaccggaggcgtgacacttttctttctgtctggccgggggctgggaaaaaccagcatcggcctcctgtgtgtcatggcttccagcgtgcttctgtggatggcctctgttgagccccactggattgccgcttccatcatcctcgagttctttctgatggtgctgctcattccggagcctgaccgccagagaacgccccaggataaccaacttgcgtacgtcgtgatcgggctgctgttcatgattctcacagtcgccgctaatgagatgggactgcttgaaaccaccaagaaagacctgggcatcgggcatgtggccgttgagaaccaccatcacgccacaatgctcgatgtggacctgcatcctgctagcgcctggaccctgtatgcggtcgccacaacgattatcacccccatgatgcggcacacaattgaaaacaccacagctaatatctctctcaccgccatcgctaaccaggccgcgattcttatgggactggataagggctggcctatctccaaaatggacattggcgtgcccctgctcgccctggggtgctacagccaggttaatccgcttacgctgaccgctgccgtgctcatgctggtcgctcactacgccatcattggacctggcctgcaagctaaggccacacgcgaggcgcagaagagaaccgccgctgggatcatgaaaaaccccacagtggatggaatcgtggccattgacctcgatcccgttgtctatgacgctaagtttgaaaaacagcttggccagatcatgctgctgattctctgtacctctcaaatcctgcttatgcggacgacatgggccctgtgcgagagcattaccctcgccacagggcctctgaccaccctgtgggagggatccccgggcaagttctggaatacaacgatcgcggtgtctatggctaacatctttcgcggcagctacctcgccggggctggacttgccttctccctgatgaaaagcctgggcgggggaagacggggcaccggggcccagggagaaacactcggcgagaagtggaagcgccagctgaatcagctttccaaatctgaatttaacatttataagagaagcggcatcatggaggtggaccggtccgaagctaaagaggggctgaagagaggagagaccacacgccatgccgtctctcggggcaccgcgaaactcagatggttcgttgaacgcaatctggtgaagcccgaggggaaggtgattgatctgggatgtggcagagggggatggagctactattgcgccggcctcaaaaaggtcacggaagtgaaaggctacacaaaagggggacctggccacgaggaacccatccctatggctacctatgggtggaaccttgttaaactgcattccggaaaggacgtgttctttacaccccctgagaaatgtgatacactgctctgcgacattggcgagtctagcccgaatcccaccatcgaagaggggagaacactgcgcgtccttaagatggtggaaccttggctgcggggaaaccaattctgtattaagatcctcaatccctacatgccttccgttgtggagacgctggagcagatgcagagaaaacacggcggcatgctggtccgcaaccccctcagcagaaattctacccacgaaatgtactgggtgtcctgcgggacaggaaacatcgtgagcgccgtcaatatgacctctagaatgctgcttaaccgctttacaatggctcatcggaagccgacctatgagagagatgttgacctgggcgccgggacgcgccacgtggcggtggaacctgaggtcgccaacctcgatattatcggacagagaattgaaaatatcaaacatgagcacaagtccacctggcattacgacgaggataacccctataaaacatgggcttaccacggcagctatgaagtgaagccctctgggtccgccagctccatggttaatggagtggtcaagctgcttaccaaaccttgggacgtgattcccatggttacacaaatcgctatgaccgatacaacccctttcggccagcagcgggtgtttaaggagaaagtcgacacgcgcacaccgaaggccaaaagaggcaccgctcaaatcatggaagtgaccgcccggtggctgtgggggttcctcagcagaaacaagaagccccggatttgtacacgcgaggaatttacgagaaaagttcggtctaatgcggccatcggagctgtgttcgtcgacgagaaccagtggaatagcgccaaggaggctgtggaagatgagcgcttttgggacctggtccagaaagaaagagagctgcacaagcagggcaaatgcgcgacctgcgtgtacaacatgatggggaagcgggaaaagaaactcggagagttcggcaaggccaaagggtcccgcgcgatttggtatatgtggctgggcgctagatttcttgagttcgaagccctgggatttatgaatgaggatcattggttctctcgggaaaacagcctctccggcgttgagggggagggactgcacaaacttggctacatcctgcgcgacatttctaaaatccctgggggaaatatgtacgccgatgacacagctggctgggataccagaatcacagaagacgatctccaaaacgaggcccggattaccgacatcatggaacccgagcatgctctgctggccacaagcattttcaagctcacctatcagaataaagtggtccgcgtgcagagacctgcgaagaacgggacggtgatggatgttatctcccggcgcgaccagagaggctctggacaagtgggcacctacgggctgaatacatttaccaacatggaagcccagcttattcggcagatggagagcgagggaatcttcctgccctccgaactcgagacacagaacctggctgaaagagtccttgattggctggagaagtatggcgtggaacgcctcaaacggatggccatcagcggggacgactgtgttgtgaagccgattgatgacagatttgctaccgccctgacggcgctgaatgatatgggaaaagtccgcaaggacatccctcaatgggagccctctaaaggctggaacgattggcaacaggtgcctttctgctcccaccactttcatcagctcattatgaaggacgggcgggagatcgtcgtgccctgtagaaatcaagatgaactggttggccgcgcccgggtgagccagggagctggctggtctcttagagagacagcctgcctggggaagtcctacgctcagatgtggcaactcatgtatttccaccgccgggacctgagacttgccgctaacgccatttgtagcgcggtccctgtggattgggttcccacctcccgcacaacctggtctatccatgcccaccatcagtggatgacgaccgaagacatgctgagcgtgtggaatcgggtctggattgaggaaaacccgtggatggaggataaaacacacgtgtccagctggggagacgtgccttacctcggcaagagagaggaccagtggtgcgggtctctgatcggactgaccgctcgggccacatgggcctccaatatccaggttgctattaaccaagtcagacgcctcatcggcaatgaaaactatctggattacatgaccagcatgaaacggtttaagaatgagggggaccccgaaggcgccctttggtga

SEQ ID NO: 18896 - RNA, 9879 nt, synthetic construct
  misc_feature 1..9879: note = derived and/or modified CDS sequence (opt5) from DENV-1__FJ410196__SS-prME
  source 1..9879: mol_type = other RNA
agcgtgaccatgctgctcatgctgatgcccaccgcccttgctttccacctgacgaccagaggaggggaacctcatatgatcgtctccaagcaggaacgggggaaatctctcctgtttaagaccagcgccggcgttaacatgtgcacccttatcgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaaaattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggaccctttctctattgccgctcgcggctacatctccacaagagtgggaatgggcgaggccgccgctatttttatgaccgcgacaccccctgggagcgtggaagccttcccgcagtctaatgctgtcatccaggatgaggaacgggacatccccgagcgcagctggaactccggatatgagtggattacagattttcctggcaagaccgtttggttcgtgccctctatcaaaagcgggaatgacattgccaactgtctcagaaagaatggaaaacgggtgatccagctttccagaaagacattcgataccgaataccaaaagacgaaaaacaacgactgggactacgtcgtgacaaccgatatttctgagatgggcgccaattttcgcgctgaccgggttatcgatcctagacgctgcctgaagcccgtgattctgaaagacgggccggaacgggtcatcctcgccggccctatgcccgtgacagttgcgagcgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctcttcgaacctgagcgcgaaaagtccgcggccattgatggggagtatagactgcggggagaggctcgcaagacctttgtggaactgatgagacggggcgacctcccggtctggcttagctacaaagtggcctctgaggggttccaatattccgatcgcagatggtgctttgacggcgaacggaacaatcaggtcctggaggaaaacatggatgtggagatctggacaaaggagggagaacgcaagaaactgcgcccccggtggctcgacgctagaacctacagcgaccctctggcccttcgcgagttcaaagaatttgctgccggccggagatccgtttctagcgatctgatcctcgagattgggaagctgccccagcacctgacacagcgggcgcaaaatgccctcgacaaccttgtgatgctgcataattccgaacagggaggccgcgcttatagacacgccatggaggagctgcctgataccatcgaaacactcatgctgcttgctctgattgccgtgctcaccgggggagtcacgctgttctttctgtctggccggggcctcgggaaaacaagcatcggacttctgtgtgttatggcctccagcgtgctgctctggatggcttctgtggagccccattggattgcggcctccatcatcctggagttctttcttatggtcctgctcattccggagcctgaccgccagagaacaccccaggataaccaactggcttacgtggttatcggcctcctgttcatgattcttaccgtggccgccaatgagatggggctgctggaaacaaccaagaaggacctcggaatcggccacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatggggctggataaaggatggcctatctccaagatggacattggcgttcccctccttgctctgggctgctatagccaggtgaatccgctgaccctcacagccgctgtcctgatgcttgtggcccattacgcgatcattgggcctggactgcaagccaaagctacccgcgaggcccagaagagaacagctgccggcatcatgaaaaaccccaccgttgatgggatcgtggccattgacctcgatcccgtcgtgtatgacgcgaagtttgaaaagcagctgggacagatcatgctgctcattctttgtacgtctcaaatcctgctgatgcggacaacctgggctctctgcgagagcattacactggccaccggccctcttaccacactgtgggaggggtccccgggaaaattctggaatacgaccatcgctgtgtctatggccaacatcttccgcggcagctacctcgccggcgctgggctggccttttccctgatgaaaagcctcggaggcgggagacggggaacaggcgcgcagggggaaacccttggagagaaatggaagagacagctgaatcagctgtccaaatctgagttcaacacatataagcgcagcggcattatggaggttgaccggtccgaagccaaggagggcctcaaaagaggggagaccacgaagcacgctgtctctcgcggaacagccaaactgcggtggtttgtggaaagaaatcttgtgaagcccgagggcaaagtcatcgatctggggtgtggacgcggcgggtggagctactattgcgctggactcaagaaggttaccgaagtgaaaggctacaccaagggcgggcctggacacgaggaacccattcctatggccacatacggctggaacctggtgaaactgcattccgggaaggacgtcttctttattccccctgagaaatgtgataccctcctttgcgacattggagagtctagcccgaatcccacaatcgaagagggccggacgctgagagtgctgaagatggttgaaccttggctccgcgggaaccaattctgtattaaaatcctgaatccctatatgccttccgtggtcgagacccttgagcagatgcagcggaagcacggaggcatgctggtgagaaaccccctcagccgcaattctacacatgaaatgtactgggtttcctgcggcaccgggaacatcgtgagcgcggtcaatatgacatctcggatgctgctgaacagatttaccatggcccaccgcaagccgacgtatgagagagatgtggacctcggagctggcacccggcacgtggccgtcgaacctgaggttgctaacctggatattatcgggcagcgcattgaaaatatcaaacatgagcacaagtccacatggcattacgacgaggataacccctataaaacctgggcctaccacggaagctatgaagtgaagccctctggctccgctagctccatggtgaatggggtcgtgaaacttctgacaaagccttgggacgttattcccatggtgacccaaatcgccatgacagataccacgcctttcggacagcagagagtctttaaggagaaagtggacacacggaccccgaaggcgaaaagaggcaccgcccaaatcatggaagttacagctaagtggctctggggcttcctgagccggaacaaaaagccccgcatttgtacgagagaggaatttacccggaaggtgcgctctaatgccgctatcggggccgtcttcgtggacgagaaccagtggaatagcgccaaagaggcggttgaagatgagagattttgggaccttgtgcatcgggaacgcgagctgcacaagcagggaaaatgcgctacatgcgtctacaacatgatgggcaagagagagaaaaagctcggggagttcggaaaggccaaaggctcccgggccatttggtacatgtggctgggggctcgcttcctggagtttgaagccctcggcttcatgaatgaggatcactggttttctagagaaaacagcctgtccggagtggagggcgaggggcttcataagctgggatatatcctccggggcatttctaaaatccctgggggaaatatgtacgctgacgataccgccggctgggacacacgcatcaccgaagatgacctgcagaacgaggcgagaattacagatatcatggaacccgagcacgcccttctggctaagagcattttcaaactcacctatcaaaataaggtcgtgcgggttcagcgccctgccaaaaacgggacggtgatggacgtcatctccagacgggatcagagaggctctggacaggtgggcacctacgggctgaatacatttaccaacatggaagctcaactgattcgccagatggagagcgagggaatcttctcccccagcgaactcgagacaccgaacctggccgaacgggtgcttgactggctggagaagtatggcgttgaaagactcaagcgcatggcgatctctggggatgactgtgtggtcaaacctattgacgatcggtttgccaccgctctgacggcccttaatgacatgggaaaggtgagaaaagatatcccccagtgggagccttccaagggctggaacgactggcagcaagttcccttctgcagccatcactttcaccagctgattatgaaagatgggcgcgagatcgtggtcccttgtcggaatcaggacgaactcgtgggcagagctcgcgtctctcagggagccggctggtccctgcgggagacagcttgcctgggaaagagctacgcccaaatgtggcagctcatgtatttccatagacgcgatctgcggcttgcggccaacgctatttgttccgccgtgcccgttgactggatcccgacctctagaacaacctggagcattcacgcccatcaccagtggatgacgaccgaagatatgctgtccgtgtggaatcgggtctggatcgaggaaaacccttggatggaggacaagacacatatcagctcttggggagatgtgccctacctcggcaaaagagaggaccaatggtgcgggtccctgattggacttaccgctcgcgccacatgggcgaccaatatccaggttgctattaaccaggtgcggagactgatcggcaatgaaaactacctcgactatatgacaagcatgaagcgctttaaaaatgagtctgatcccgaaggggccctgtggtga

SEQ ID NO: 18897 - RNA, 9879 nt, synthetic construct
  misc_feature 1..9879: note = derived and/or modified CDS sequence (opt5) from DENV-1__FJ432734__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgccatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggtgctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaggacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctaccacagagatccagctcaccgactacggcgccctgacactggattgttctccccggaccggcctcgacttcaacgaaatggtcctgcttacgatgaaggagaaatcctggctggtgcataagcagtggtttctcgatctgcctcttccctggacaagcggggcctccacctctcaagagacatggaatcgccaggacctgctcgtcaccttcaaaaccgctcacgcgaagaagcaggaagtggttgtgctgggaagccaagagggcgccatgcacacagctctgacgggggccaccgaaattcagacatccggaaccacaaccatctttgccggccatctcaaatgcagactgaagatggataaacttacgctgaaggggatgagctatgtcatgtgtacaggctctttcaaactcgagaaggaagtggctgagacccagcacggaaccgttctggtgcagattaagtacgagggcacagacgccccgtgcaaaatccctttctccacccaagatgaaaagggggtcacacagaacggacggctgatcacggcgaatcccattgtgaccgacaaagagaagcctgtgaacatcgaagctgagccgccctttggcgagagctatattgttatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtctttacaagcgtgggcaaactggtgcatcagattttcgggaccgcctacggagtcctcttttccggcgtgagctggacgatgaagatcgggattggcgttctgcttacctggctgggactcaattctagatccacaagcctgtctatgacctgtatcgctgtgggcctggtcacactttacctcggggtgatggttcaggccgattccggatgcgtgattaactggaaaggccgcgaactgaagtgtgggagcggaatcttcgtcaccaatgaggtgcacacatggaccgaacaatataagtttcaggctgactcccctaaacggctgtctgccgcgattggcaaggcctgggaggagggggtttgcggcatcagaagcgctacgcgcctcgaaaacatcatgtggaaacagatttccaacgagctgaatcatatccttctggaaaacgacatgaagctcacagtggtcgtgggagatgtggccggcattctggggcagggcaagaagatgatccggccgcaacccatggagtacaaatattcttggaaaagctggggcaaggctaagattatcggggccgacgcccagaataccaccttcatcattgatggacctaacacacccgaatgtcctgacgatcagagagcttggaatatctgggaggtcgaggactacggctttggcatgttcaccacgaacatttggctgaaacttcgcgattcctatacacaggtttgcgaccaccggctcatgagcgcggccatcaaagattctaaggctgtgcacgccgacatggggtactggattgaatccgagaaaaatgaaacctggaagctggccagagctagctttatcgaggtgaagacatgtatctggcccaaatctcataccctgtggtccaacggagtcctcgaaagcgagatgattatcccgaagatttatggcgggcctatctctcaacacaattaccgccccggatacttcacacagaccgccggcccttggcatctggggaaacttgagctggatttcgacctctgcgaaggaacgaccgtggttgtggatgagcactgcggcaaccggggccccagcctgagaacaaccacagtcaccgggaagattatccacgaatggtgttgccggtcctgtacgctgcctccccttcgctttagaggagaggacggctgctggtatgggatggagatccggccggtgaaagaaaaggaggaaaatctcgttaagagcatggtgtctgcgggatccggcgaggtcgacagcttctccctggggctgctctgtatttctatcatgattgaagaggtgatgagaagccgctggtcccggaaaatgctgatgacaggaacccttgctgtctttttcctgctcatcatgggccagctgacatggaacgatctgattagactttgcatcatggtgggcgccaatgcctctgaccgcatggggatgggaaccacctacctggctctcatggccacatttaagatgagacctatgttcgcggtcggcctgctctttcggcgcctgacgagcagagaggtgcttctgctcaccattgggctgtccctggtggcttctgtcgaacttcccaacagcctggaggaactcggagatggcctggccatggggatcatgatcctcaaactgcttacagacttccaatcccatcagctgtgggccaccctcctgagcctgacatttattaagaccacgttctctcttcactatgcttggaaaacaatggccatggttctgtccatcgtgagcctctttcccctgtgtctctctaccacctcccagaagacaacctggctgcctgtgcttctgggaagcctgggctgcaagccgctcacaatgttcctgattgctgagaataaaatctggggccggaagtcttggccccttaacgaagggattatggccgtcggaatcgtgtccatcctgctcagctccctgctcaaaaacgatgttcctctggcgggcccccttattgccgggggaatgctgatcgcttgttacgtgattagcggctctagcgccgacctgtccctcgagaaggctgccgaggtctcttgggaagaggaagccgagcatagcggggcttcccacaatatcctggtggaagttcaggatgacggaacgatgaaaattaaggatgaggagcgcgacgatacccttacaatcctgctcaaagcgaccctgctcgccgtgtctggcgtctatcctctgagcatccccgctacactttttgtgtggtacttctggcaaaagaagaaacagagatccggcgtcctgtgggacaccccttctcccccggaagtggagcgggccgttctggatgacgggatttatcgcatcatgcagagaggactcctgggccggagccaggtgggggtcggagtgttccaagaaaacgtttttcatacgatgtggcacgtgacccgcggcgccgtccttatgtaccaggggaagagactggagccttcctgggctagcgtgaaaaaggacctcatttcttacggaggcggctggcggctgagagggtcctggaatacaggagaggaagtgcaggttatcgccgtcgagcccggcaaaaaccctaagaatgtgcagaccgcgcccgggacattcaagaccccggaaggagaggtgggcgctattgccctcgattttaaacctgggacaagcggatctcccatcgtcaaccgcgaaggcaagattgtgggcctgtatgggaatggagttgtgacgacctccggcacatacgtcagcgccatcgctcaagccaaagcgtcccaggaggggcctcttcccgagatcgaagacgaggtgttccggaagagaaacctgaccattatggatctgcaccccggatctggcaaaacccgccggtatctccctgctatcgttagagaagccattaagcgcaagctgcggacacttatcctggccccgacgagagtggtcgctagcgagatggccgaagctctcaaagggatgcccattcgctaccagaccacagccgtgaagtccgagcataccggcaaagagatcgttgacctgatgtgccacgcgacatttaccatgcggctgctcagccctgtgagagtccccaattataacatgatcattatggatgaagcccatttcacggacccttcttccatcgctgcccggggatacattagcacacgcgtgggcatgggggaggctgccgccatctttatgaccgctacaccccctggatctgtggaagcgttcccgcaaagcaatgccgtcattcaggatgaggaaagagacatccccgagcggtcctggaactctggctatgagtggatcacagattttcctgggaagaccgtttggttcgtgcccagcattaaatccggaaatgacatcgctaactgtcttcgcaagaatggcaagagagtgattcagctgtctcggaaaacatttgataccgaataccagaagacgaaaaacaacgactgggactacgtcgtgacaaccgatatcagcgagatgggggccaatttcagagccgaccgcgttattgatcctcggagatgcctgaagcccgtgatcctcaaagacggcccggaacgcgtcattctggctggacctatgcccgtgacagttgcctccgcggctcaacggagaggccgcatcgggcggaaccacaataaggagggagatcagtatatctacatgggccagccccttaacaatgacgaggatcatgcccactggaccgaagccaagatgctgctcgacaacattaatacgcctgaggggatcattcccgctctgttcgaacctgagagagaaaagagcgccgcggtggatggagagtatcgcctgagaggcgaggcccggaagacctttgtcgagctcatgcgcagaggggaccttccggtgtggctgtcttacaaagtcgcttccgagggcttccagtatagcgatcggcgctggtgctttgacggagaaagaaacaatcaagtgctggaggaaaacatggatgttgagatctggacaaaggagggcgaacggaaaaagctcagaccccgctggctggacgcccggacctactccgaccctcttgctctgagagagttcaaagaatttgccgctgggcgccggtctgtgagcggagatctcattctggagatcggcaagctgccccagcacctcacacagagagcccagaatgcgcttgacaacctggtgatgctgcataattccgaacaagggggacgggcctatcgccacgctatggaggagctccctgataccatcgaaacactgatgcttctggccctcattgctgtcctgaccggcggcgttacgctgttctttctctctgggagaggacttggcaagacaagcatcgggctgctgtgtgtgatggcctccagcgtgctcctgtggatggcctctgtcgagccccattggattgctgcgtccatcattcttgagttctttctgatggtgctcctgatcccggagcctgaccggcagcgcacaccccaggataaccagctggcctacgttgtgatcggactccttttcatgattctgaccgtcgctgccaatgagatgggcctgctcgaaacaaccaaaaaggacctggggatcggacacgtggccgtcgagaaccaccatcacgctgccatgcttgatgtggacctgcatcctgcgagcgcctggacactctacgctgttgccacgaccattatcacacccatgatgagacacaccattgaaaacacaaccgctaatatctctctgacggccattgcgaaccaagccgctatcctgatgggcctcgataaaggctggcctatctccaagatggacattggggtgccccttctggccctgggatgctatagccaggtcaatccgctcaccctgacagctgccgtgcttatgctggttgctcattacgccatcattggccctgggctccaggcgaaagccacccgggaggctcaaaagcgcacagccgctggaatcatgaagaaccccaccgtggatggcattgtcgccatcgacctggatcccgtggtgtatgacgccaaatttgaaaagcagctggggcagatcatgctccttattctgtgtacgtctcagatcctgctcatgagaacaacctgggcgctgtgcgagagcattacacttgctaccggacctctgaccacactctgggagggctccccgggcaaattctggaatacgaccatcgccgtttctatggctaacatttttcgggggagctacctggccggagccggcctggctttctccctcatgaaaagccttgggggaggccgcagagggacaggagcccaaggcgaaaccctgggcgagaaatggaagcggcagctgaatcagctctccaagtctgagttcaacacatataaaagaagcgggatcatggaggtcgaccgctccgaagcgaaggagggactgaaacggggcgagaccacgaagcacgccgtgtctagagggacagctaaacttcgctggtttgtggaacggaatctggtcaagcccgagggaaaggttatcgatctcggctgtgggagaggaggctggagctactattgcgccggcctgaaaaaggtgaccgaagtgaaagggtacaccaagggaggccctgggcacgaggaacccattcctatggctacatacggatggaacctggtcaaactccattccggcaaggacgtgttctttattccccctgagaaatgtgatacccttctgtgcgacatcggggagtctagcccgaatcccacaatcgaagagggacgcacgctgcgggttctcaagatggtggaaccttggctgagaggcaaccagttctgtattaagatccttaatccctatatgccttccgtcgtggagaccctggagcaaatgcagcgcaaacacggcgggatgctcgttcggaaccccctgagcagaaattctacacatgaaatgtactgggtgtcctgcggaaccggcaacattgtcagcgccgtgaatatgacatctcgcatgctgctcaaccggtttaccatggcgcacagaaagccgacgtatgagcgcgatgtggacctggggaccggaacaagacacgtcgccgttgaacctgaggtggctaaccttgatatcatcggccagcggattgaaaatatcaaacatgagcacaagtccacctggcattacgacgaggataacccctataaaacatgggcctaccacgggagctatgaagtgaagccctctggatccgctagctccatggtcaatggcgtggttaagctgctcaccaaaccttgggacgtgattcccatggtcacacagatcgccatgaccgatacgacacctttcggccaacagcgcgtgtttaaggagaaagttgacaccagaaccccgaaggctaaacgggggacagcccagattatggaagtgacggcgagatggctgtggggattccttagccggaacaagaagccccgcatctgtaccagagaggaatttacacggaaagtccgctctaatgccgctatcggcgccgtgttcgttgacgagaaccaatggaatagcgctaaggaggccgtggaagatgagagattttgggacctggtccatcgggaacgcgagctccacaaacaggggaagtgcgcgacctgcgtgtacaacatgatgggaaaaagagaaaagaagctgggcgagttcgggaaagcgaagggctcccgggctatttggtacatgtggctgggagcccgctttctcgagttcgaagccctgggcttcatgaatgaggatcactggttttctagagaaaacagcctttccggggtcgagggagagggcctgcataaactcgggtatatcctgcgggacatttctaagatccctggaggcaatatgtacgctgatgacacagccgggtgggatacccgcattacagaagacgatcttcagaacgaggctaaaatcaccgacatcatggaacccgagcacgccctgctcgcgaaggccattttcaaactgacgtatcagaataaggtggttagagtgcaacggcctgctaagaacggcaccgtcatggatgtgatcagccgcagagaccagcggggatccggccaggtggggacatacggactgaatacctttacaaacatggaagcccagctcattagacaaatggagtctgagggcatcttcagcccctccgaactggagaccccgaaccttgctgaacgcgccctggattggctcgagaaatatggggttgaacggctgaagagaatggcgattagcggagacgactgtgtggtcaaacctatcgatgaccgctttgccacggctcttacagccctgaatgatatgggcaaggtgcggaaagacatcccccagtgggagccttctaaggggtggaacgattggcagcaggttcccttctgctcccatcactttcaccaactcattatgaaggacggcagagagatcgtggtcccttgtcgcaatcaggatgaactggtgggacgggctagagtcagccagggcgccgggtggtctctgcgcgagaccgcttgcctcggaaaatcctacgcccagatgtggcaactgatgtatttccatcggagagaccttcgcctggcggccaacgctatttgtagcgccgtgcccgttgattgggtgccgacatcccggaccacgtggtctatccacgcccatcaccagtggatgaccacagaagacatgctcagcgtctggaatagagtgtggattgaggaaaacccttggatggaggataagacccatatctccagctgggaggacgttccctacctgggcaaacgggaagaccagtggtgcgggtctcttattggactgacagctagagccacctgggcgacaaatatccaagtggctatcaaccaggtccgccggctcattggcaatgagaactacctggattatatgacctccatgaagagatttaaaaatgaaacggaccccgagggggccctgtggtga

SEQ ID NO: 18898 - RNA, 9879 nt, synthetic construct
  misc_feature 1..9879: note = derived and/or modified CDS sequence (opt5) from DENV-1__FJ432735__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagaaggcgcagaatgccctggacaacctcgtgatgcttcataatagcgaacaaggcgggcgcgcttatcggcacgccatggaggagctgcccgataccattgaaacactgatgctcctggctcttatcgccgtgctgaccggaggcgtcacgctgttctttctgtccggcagagggctgggaaaaacaagcattggcctcctttgtgttatggcctcttccgtgctgctgtggatggctagcgtggagcctcattggatcgcggcctctattatcctcgagttctttctgatggtccttctgatccccgagccggaccggcagcgcacccctcaggataaccagctcgcttacgtggttattgggctgctgttcatgatcctcaccgtggccgccaatgagatgggacttctggaaacaaccaagaaagacctgggcattgggcacgtcgctgtggagaaccaccatcacgccgcgatgctcgatgtcgacctgcatcccgcctccgcttggacactttacgccgtggctacgaccatcattacacctatgatgagacacaccatcgaaaacacaaccgccaatattagcctgacggcgatcgccaaccaagctgccatcctcatgggactggataagggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaagctacccgggaggcccaaaagcgcacagctgccgggattatgaaaaaccctaccgttgatggaatcgtggccatcgacctggatcccgtcgtgtatgacgcgaagtttgaaaaacagctcggccagattatgctgctgatcctctgtacgtcccagattcttctgatgagaacaacctgggctctgtgcgagtctatcacactcgccaccgggcccctgaccacactttgggagggaagccctggcaagttctggaatacgaccattgctgtgtccatggccaacatcttccggggcagctacctggccggggctggactcgccttttccctgatgaagtctctgggcgggggacgcagaggcacaggggcgcaaggagaaaccctcggcgagaaatggaagcggcagcttaatcagctgagcaaatccgagttcaacacatataagcgctctggcatcatggaggttgacagaagcgaagccaaagaggggctgaagcggggagagaccacgaagcacgctgtctccagaggcacagccaaactccgctggtttgtggaacggaatctggtgaagccggaggggaaagtcattgatcttggatgtggcagagggggatggtcttactattgcgctggcctgaagaaagttaccgaagtgaagggctacaccaaagggggacccggccacgaggaacctatccccatggccacatacgggtggaacctcgtgaagctgcatagcggaaaggacgtcttctttattcctcccgagaaatgtgataccctgctctgcgacatcggcgagtccagccctaatccgacaattgaagaggggcgcacgcttcgggtgctgaagatggttgaaccctggctgagaggaaaccagttctgtatcaaaattctcaatccttatatgccctctgtggtcgagaccctggagcaaatgcagcgcaagcacggcggcatgcttgtgcggaaccctctgtccagaaatagcacacatgaaatgtactgggtttcttgcgggaccggaaacatcgtgtccgcggtcaatatgacaagccgcatgctcctgaaccggtttaccatggcccacagaaaacccacgtatgagcgcgatgtggacctgggcgctgggacccggcacgtggccgtcgaaccggaggttgctaacctcgatatcattggacagagaatcgaaaatattaagcatgagcacaagtctacatggcattacgacgaggataacccttataaaacctgggcctaccacggctcctatgaagtgaagcccagcgggtccgctagctctatggtgaatggagtcgtgaaactgcttacaaagccctgggacgttatccctatggtgacccagattgccatgacagataccacgcccttcggccaacagcgcgtctttaaagagaaggtggacacaagaacccctaaggcgaaacggggcaccgcccagatcatggaagttacagctaagtggctgtgggggttcctcagccgcaacaaaaagccgagaatctgtacgcgggaggaatttaccagaaaagtgcggtccaatgccgctattggagccgtcttcgtggacgagaaccaatggaactctgccaaggaggcggttgaagatgagcgcttttgggacctggtgcatagagaacgggagcttcacaagcagggcaaatgcgctacatgcgtctacaacatgatggggaagcgcgagaaaaagctgggagagttcggcaaagccaaggggagcagagccatctggtacatgtggctcggcgctcggttcctggagtttgaagccctgggattcatgaatgaggatcactggttttcccgcgaaaactctctcagcggcgtggagggggagggactgcataaacttggctatattctgagagacatctccaagattcccgggggaaatatgtacgctgatgacaccgccggctgggatacacggatcaccgaagacgatctccagaacgaggcgaagatcacagacattatggaacctgagcacgccctgcttgctaaatctatcttcaagctgacctatcagaataaagtcgtgcgcgttcaaagacccgccaagaacgggacggtgatggatgtcattagccggcgcgaccagagaggctccggacaggtgggcacctacgggctcaatacatttaccaacatggaagctcagctgatccggcaaatggagagcgagggaattttctctccttccgaactggagacacccaacctcgccggccgcgtgctggattggcttgaaaaacatggggttgagagactgaagcggatggcgatcagcggagacgactgtgtggtcaagccgatcgatgacagatttgccaccgctctcacggccctgaatgatatgggcaaagtgcgcaaggacattcctcagtgggaaccctctaaagggtggaacgattggcagcaggttcctttctgctcccaccactttcatcaacttatcatgaaggacggccgggagattgtggtcccctgtagaaatcaggatgagctggtgggacgcgctcgggtcagccagggcgccgggtggtccctcagagaaacagcttgcctgggaaaatcttatgcccagatgtggcaactgatgtacttccaccgccgggacctcagactggcggccaacgctatctgtagcgccgtgcctgttgattgggtgcccacctcccgcacaacctggagcattcatgcccaccatcagtggatgacgaccgaggacatgctttctgtctggaatcgggtgtggatcgaagagaacccgtggatggaagataagacacacatttccagctggggcgacgttccttatctggggaagagagaggaccagtggtgcggatctctcatcggcctgaccgctcgcgccacatgggcgaccaatatccaagtggctattaaccaggtccggagacttatcgggaatgagaactacctggattacatgacaagcatgaaacggtttaagaatgaatccgaccccgagggcgccctctggtga

SEQ ID NO: 18899 - RNA, 9879 nt, synthetic construct
  misc_feature 1..9879: note = derived and/or modified CDS sequence (opt5) from DENV-1__FJ432736__SS-prME
  source 1..9879: mol_type = other RNA
agcgtgacaatgctgctgatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaaaatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacctgacacagaccgcgggcccttggcatcttgggaaactggagctcgatttcgacctgtgcgaaggaacgaccgtggtcgtggatgagcactgcggcaaccggggccccagcctgagaacaaccacagttaccgggaagatcattcacgaatggtgttgccggtcctgtacgcttcctcccctccgcttcagaggagaggacggctgctggtatgggatggagatccggccggtgaaagaaaaggaggaaaatctggtcaagagcatggtgtctgctggacctggcgaggttgactcctttagcctggggctcctgtgtatttccatcatgattgaagaggtgatgagatctcgctggagccggaaaatgcttatgacaggaaccctggccgtcttctttctcctgatcatgggccagctgacatggaacgatcttattagactgtgcatcatggtgggcgccaatgctttcgaccgcatggggatgggaaccacctacctcgccctgatggcgacatttaagatgagacccatgttcgctgttggcctcctgtttcggcgccttacgtccagagaggtgctgctcctgaccatcgggctgtctcttgtcgccagcgtggaactgcccaactccctcgaggaactgggagatggcctcgccatggggattatgatcctgaaacttctgacagacttccaatctcatcagctctgggctaccctgctgagccttacatttattaagaccacgttctccctgcactatgcctggaaaacaatggctatggtgctcagcatcgtctctctgtttcctctctgtctgtccaccaccagccagaagacaacctggcttccggttctgctgggatctctcggctgcaagcccctgacaatgttccttattgccgagaataaaatctggggccggaagtcctggcctctgaacgaagggatcatggcggtgggaattgtgagcatcctcctgtcttccctcctgaaaaacgatgtcccccttgccggccctctgattgctgggggaatgctgatcgcctgttacgtgattagcggctccagcgctgacctctctctggagaaggccgccgaggttagctgggaagaggaagctgagcattccggggcgtctcacaatatccttgtggaagtccaggatgacggaacgatgaaaatcaaggatgaggagcgcgacgataccctgacaattctcctgaaagccaccctcctggctgtgagcggcgtttatcccctttccatccctgccacactgtttgtgtggtacttctggcaaaagaagaaacagagatctggcgtcctgtgggacacccccagcccgcctgaagtggagcgggccgtcctcgatgacgggatttatcgcatcatgcagagaggactgcttggccggtcccaggtgggggttggagtgttccaagaaaacgtctttcatacgatgtggcacgtgacccgcggcgctgttctgatgtaccaggggaagagactcgagccctcttgggccagcgtgaaaaaggacctgatttcctacggaggcggctggcggctcagagggagctggaatacaggagaggaagtccaggtgatcgcggtggagcctggcaaaaaccccaagaatgttcagaccgctccggggacattcaagacccctgaaggagaggtcggcgccattgccctggattttaaacccgggacatctggatcccctatcgtgaaccgcgaaggcaagatcgtgggcctttatgggaatggagtcgtgacgaccagcggcatttacgtttctgctatcgcccaagcgaaggcttcccaggaggggcccctgcccgagattgaagacgaggtgttccggaagagaaacctgacaatcatggatctccaccctggaagcggcaaaacccgccggtatctgccggccattgtcagagaagccatcaagcgcaaacttcggaccctgatcctcgctcccacaagagtggttgcctccgagatggctgaagccctgaaagggatgcctattcgctaccagacgaccgcggtgaagtctgagcatacaggcaaagagatcgtcgacctgatgtgccacgccacctttacaatgcggctccttagccccgtgagagttcctaattataacatgattatcatggatgaagctcatttcaccgacccctccagcattgccgctcggggatacatctctacgcgcgtgggcatgggggaggccgccgctatctttatgacagcgacccctccgggatccgtcgaagccttcccccaaagcaatgctgtgattcaggatgaggaaagagacatccctgagcggtcttggaacagcggccacgagtggattaccgattttcccgggaagacagtgtggttcgtcccttccatcaaatctggaaatgacattgccaactgtctgcgcaagaatggcaagagagttatccagctgagccggaaaacctttgatacagaatatcagaagaccaaaaacaacgactgggactacgtggtgacgacagatatttccgagatgggggccaatttcagagctgaccgcgtcatcgatccccggagatgcctcaagccggtgatcctgaaagacggccctgaacgcgttattcttgccggacccatgcccgtgaccgtcgcgtctgctgcccaacggagaggccgcatcgggcggaaccataataaggagggagatcagtacatttatatgggccagcctctgaacaatgacgaggatcacgcccactggacagaagctaagatgctcctggacaacatcaatacccccgaggggattatccctgccctgttcgaaccggagagagaaaagagcgcggccgtggatggagagtaccgcctcagaggcgaggctcggaagacgtttgttgagcttatgcgcagaggggacctgcccgtgtggctgtcctataaagtcgccagcgagggcttccagtactctgatcggcgctggtgctttgacggagaaagaaacaatcaagtgctcgaggaaaacatggatgtcgagatctggaccaaggagggcgaacggaaaaagctgagacctcgctggcttgacgctcggacatattccgaccccctggccctcagagagttcaaagaatttgctgccgggcgccggagcgtgtccggagatctgattctggagatcggcaagctccctcagcatcttacccagagagcgcagaatgccctggacaacctggttatgctccacaattctgaacaagggggacgggcttaccgccatgccatggaggagctgcccgatacaattgaaacccttatgctgctcgctctgatcgccgtgctgacaggcggcgtgaccctcttctttcttagcgggagaggactgggcaagacgtccattgggctgctctgtgtcatggcctctagcgttctgctttggatggcttccgtggagccgcactggatcgcggccagcatcattctggagttctttctcatggtgctgctgatccctgagcccgaccggcagcgcacacctcaggataaccagctcgcttatgtcgtgattggacttctgttcatgatcctgaccgttgccgccaatgagatgggcctcctggaaaccaccaagaaggaccttgggattggacacgtggctgtcgagaaccatcaccatgccgcgatgctggatgtggacctccaccccgcctctgcttggaccctgtacgccgtcgctacaacgatcattacccctatgatgagacatacaatcgaaaacaccacagccaatatctccctgaccgcgattgccaaccaagctgccatcctcatgggccttgataaaggctggcccattagcaagatggacatcggggtgccgctgctggctctcggatgctactctcaggttaatcctctgacgcttaccgccgctgtgctgatgctcgtcgcccactatgcgattatcggccccgggctgcaggccaaagctacacgggaggcccaaaagcgcaccgctgccggaatcatgaagaaccccacagtggatggcattgttgccatcgacctggatcctgtggtctacgacgcgaaatttgaaaagcagctcgggcagattatgcttctgatcctgtgtacctcccagattctcctgatgagaacgacatgggctctttgcgagagcatcaccctggccacaggaccgctcaccaccctgtgggagggctctcccggcaaattctggaatacaacgatcgctgtgagcatggccaacatttttcgggggtcctatctggccggagctggcctcgccttctctcttatgaaaagcctcgggggaggccgcagagggaccggagcgcaaggcgaaacactgggcgagaaatggaagcggcagctcaatcagctgtccaagagcgagttcaacacctacaaaagatccgggatcatggaggtggaccgctctgaagccaaggagggacttaaacggggcgagacaaccaagcacgctgttagcagagggacggccaaactgcgctggtttgtcgaacggaatctcgtgaagcctgagggaaaggtgattgatctgggctgtgggagaggaggctggtcctattactgcgctggcctgaaaaaggtcacagaagttaaagggtataccaagggaggccccgggcatgaggaacctatccccatggccacctacggatggaacctcgtgaaacttcactctggcaaggacgtgttctttattcctccggagaaatgtgatacactgctgtgcgacatcggggagagctcccccaatcctaccattgaagagggacgcacactccgggtcctgaagatggtggaaccctggcttagaggcaaccagttctgtatcaagatcctgaatccttacatgccctctgttgtggagacgctcgagcaaatgcagcgcaaacatggcgggatgctggtccggaacccgctgagcagaaattccacccacgaaatgtattgggtgagctgcggaacaggcaacattgtttctgcggtgaatatgacctcccgcatgctcctgaaccggtttacaatggcccacagaaagcctacctacgagcgcgatgtcgaccttgggacgggaaccagacatgtggctgtggaacccgaggtcgccaacctggatatcattggccagcggatcgaaaatattaaacacgagcataagagcacatggcactatgacgaggataacccctacaaaacctgggcttatcatgggtcttacgaagttaagccttccggaagcgcctcttccatggtgaatggcgtggtcaagctcctgacaaaaccctgggacgtgatccctatggttacccagatcgctatgacagataccacgccgttcggccaacagcgcgtgtttaaggagaaagtcgacacaagaacccccaaggccaaacgggggaccgcgcagattatggaagtgacagccagatggctttggggattcctgagccggaacaagaagcctcgcatctgtacgagagaggaatttacccggaaagttcgctccaatgctgccattggcgctgtgttcgtcgacgagaaccaatggaatagcgccaaggaggccgtggaagatgagagattttgggacctcgttcaccgggaacgcgagctgcacaaacaggggaagtgcgcgacatgcgtgtataacatgatgggaaaaagagaaaagaagctgggcgagttcgggaaagctaagggctctcgggccatctggtacatgtggctcggagcccgctttctggagttcgaagctcttggcttcatgaatgaggatcattggtttagcagagaaaactccctgtctggggtcgagggagagggcctccacaaactggggtacattcttcgggacatcagcaagatccccggaggcaatatgtatgccgatgacaccgctgggtgggatacacgcattaccgaagacgatctgcagaacgaggccaaaatcacagacattatggaacctgagcatgcgctcctggccaaggctatcttcaaactgacctaccagaataaggtggtcagagtgcaacggcccgccaagaacggcacggttatggatgtgatttcccgcagagaccagcggggatctggccaggtcgggacctatggactcaatacatttaccaacatggaagctcagctgatcagacaaatggagagcgagggcatcttctccccgtctgaacttgagacacctaacctggccgaacgcgcgctcgattggctggagaaatacggggtggaacggcttaagagaatggccattagcggagacgactgtgtggttaaacccatcgatgaccgctttgctaccgccctgacggctctcaatgatatgggcaaggtgcggaaagacattcctcagtgggagccctccaaggggtggaacgattggcagcaggtccctttctgcagccaccactttcatcaactgatcatgaaggacggcagagagattgtggttccctgtcgcaatcaggatgaactggtgggacgggccagagtctctcagggcgctgggtggtccctccgcgagacagcctgcctgggaaaaagctatgcgcagatgtggcaacttatgtacttccaccggagagacctgcgcctcgccgctaacgccatctgttctgccgtgccggtcgattgggtgcctacctcccggacaacctggagcattcatgctcaccatcagtggatgacgaccgaagacatgctgtccgtttggaatagagtgtggatcgaggaaaacccctggatggaggataagacacacatctctagctgggaggacgtcccctatcttggcaaacgggaagaccagtggtgcgggtccctgattggactcaccgccagagcgacatgggctaccaatatccaagtggccattaaccaggttcgccggctgatcggcaatgagaactacctggattacatgacaagcatgaagagatttaaaaatgaatctgaccctgagggggccctctggtga

SEQ ID NO: 18900 - RNA, 9879 nt, synthetic construct
  misc_feature 1..9879: note = derived and/or modified CDS sequence (opt5) from DENV-1__FJ410198__SS-prME
  source 1..9879: mol_type = other RNA
agcgtgaccatgctgctcatgctgatgcccacagcgcttgctttccacctgacgaccagaggcggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctacgatgctggatgtcgaccttcatcctgccagcgcgtggaccctgtacgccgtggctacaaccattatcacacccatgatgagacacaccattgagaacacgaccgccaatatctctctcacagctatcgccaaccaggcggccattctgatgggcctggataagggctggcctatctccaaaatggacattggggttcccctccttgctctgggatgctatagccaggtgaatccgctgaccctcacagccgctgtcctgatgcttgtggcccattacgctatcattggccctgggctgcaagccaaggcgacccgggaagcccagaaacgcacggctgccggaatcatgaagaaccccacagttgatggcatcgtggctattgacctcgatcccgtcgtgtatgacgccaagttcgagaaacagctggggcagatcatgctgctcattctttgtacctctcaaatcctgctgatgagaacaacctgggccctctgcgaaagcattaccctggcgacaggacctcttacgaccctgtgggagggctccccgggcaagttttggaatacaaccatcgctgtgtctatggccaacatcttccgggggagctacctcgctggagccggcctggccttctccctgatgaaaagcctcgggggaggccgcagagggacaggagctcagggcgagacccttggcgaaaagtggaaacggcagctgaatcagctgtccaagtctgagtttaacacgtataagagaagcgggattatggaagttgaccgctccgaggccaaagaaggactcaagcggggcgagacaaccaaacacgcggtctctagagggaccgccaagctgcgctggttcgtggagcggaatcttgtgaaacccgaaggaaaggtcatcgatctgggctgtgggagaggaggctggagctactattgcgctggcctcaagaaagttacagaggtgaaggggtacaccaaaggaggccctgggcacgaggagcccattcctatggccacatacggatggaacctggtgaagctgcattccggcaaagacgtctttttcattccccctgaaaagtgtgatacgctcctttgcgacattggggagtctagcccgaatcccaccatcgaggaaggacgcacactgcgggtgctgaaaatggttgagccttggctcagaggcaaccaattttgtattaagatcctgaatccctatatgccttccgtggtcgaaacccttgagcagatgcagcgcaagcacggcgggatgctggtgcggaaccccctcagcagaaattctacacatgagatgtactgggtttcctgcggaaccggcaacatcgtgagcgctgtcaatatgacgtctcgcatgctgctgaaccggttcaccatggcccacagaaaaccgacatatgaacgcgatgtggacctcggggcgggaaccagacacgtggccgtcgagcctgaagttgctaacctggatattatcggccagcggattgagaatatcaagcatgaacacaaatccacatggcattacgacgaggataacccctataagacctgggcctaccacgggagctatgaggtgaaaccctctggatccgctagctccatggtgaatggcgtcgtgaaacttctgacaaagccttgggacgttattcccatggtgacccaaatcgccatgacggatacaaccccttttggccagcagcgcgtcttcaaagaaaaggtggacaccagaacaccgaaagctaagcgggggacggcccaaatcatggaggttaccgcgaaatggctctggggatttctgagcagaaacaagaagccccggatttgtacacgcgaagagttcaccagaaaagtgcggtctaatgccgctatcggcgccgtctttgtggacgaaaaccagtggaatagcgctaaggaggccgttgaggatgaacgcttctgggaccttgtgcatagagagcgggaactgcacaaacaggggaagtgcgccacatgcgtctacaacatgatgggaaaacgcgagaagaagctcggcgaatttgggaaagcgaagggctccagagctatttggtacatgtggctgggagcccggttcctggagttcgaggccctcggctttatgaatgaagatcactggttctctcgcgagaacagcctgtccggggtggaaggagagggccttcataaactggggtatatcctcagagacatttctaatatccctggaggcaacatgtacgctgatgacaccgccgggtgggatacacggatcaccgaggacgatctgcagaatgaagctcgcattacggacatcatggagcccgaacacgcccttctggccaagagcatttttaaactcacctatcaaaacaaggtcgtgagagttcagcggcctgccaaaaatggcacagtgatggatgtcatctcccgcagagaccagcggggatctggccaggtggggacctacggactgaacacattcaccaacatggaggctcaactgattagacagatggaaagcgagggcatcttttcccccagcgagctcgaaacgccgaatctggccgagcgcgtgcttgattggctggaaaagtatggggttgagcggctcaagagaatggctatctctggagacgactgtgtggtcaaacctattgatgaccgcttcgccacagcgctgaccgcccttaacgatatgggcaaggtgcggaaagacatcccccagtgggaaccttccaaggggtggaatgattggcagcaagttcccttttgcagccatcacttccaccagctgattatgaaagacggcagagagatcgtggtcccttgtcgcaaccaggatgagctcgtgggacgggctagagtctctcagggcgccgggtggtccctgcgcgaaacagcttgcctgggaaagagctacgcccaaatgtggcagctcatgtattttcatcggagagacctgcgccttgctgccaatgcgatttgttccgccgtgcccgttgattggatcccgacctctcggacgacctggagcattcacgctcatcaccagtggatgacaaccgaggacatgctgtccgtgtggaacagagtctggatcgaagagaatccttggatggaagataagacacatatcagctcttggggcgacgtgccctacctcgggaaacgggaggaccaatggtgcggatccctgattggccttaccgccagagccacatgggctaccaacatccaggttgccattaatcaggtgcgccggctgatcgggaacgagaattacctcgattatatgacgagcatgaagagattcaaaaacgaatctgaccccgagggcgcgctgtggtga

SEQ ID NO: 18901 - RNA, 9879 nt, synthetic construct
  misc_feature 1..9879: note = derived and/or modified CDS sequence (opt5) from DENV-1__FJ410199__SS-prME
  source 1..9879: mol_type = other RNA
tccgtgaccatgctgctgatgctgatgcccaccgcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaaattatggaggccctattagccagcacaactaccgccccgggtactttacacaaaccgcgggaccttggcatctgggcaagctcgagctggatttcgacctttgcgaagggacgaccgtggttgtggatgagcactgcggaaatcggggcccctccctgagaacaaccacagtcaccggcaaaatcattcacgaatggtgttgccggagctgtacgctccctcccctgcgctttaagggggaggacggatgctggtatggcatggagatcagaccggtgaaggaaaaagaggaaaacctggttaagtctatggtgtccgctgggagcggagaggtcgactccttctctcttggcctcctgtgtatcagcattatgatcgaagaggtgatgcggtccagatggtctcgcaaaatgctgatgacagggaccctcgccgttctgtttcttctgattatgggacagctcacatggagcgatctgatccggctgtgcattatggtgggcgccaatgcttccgacagaatgggcatggggaccacctaccttgccctgatggcgacattcaagatgcgccctatgtttgctgtcggactcctgttcagacggctcacgtctcgcgaggtgctgcttctgaccatcggcctcagcctggtggcctccgtcgaactgcccaacagccttgaggaactgggggatggactcgccatgggcattatgatcctgaaactcctgacagactttcagtctcatcaactttgggctaccctgctctccctgacattcatcaagaccacgtttagcctgcactatgcctggaagacaatggctatggttctttctattgtgtccctgttccccctctgtctgagcaccacctctcagaaaacaacctggctccctgtgctgcttgggtccctgggatgcaagccgctgacaatgtttctcatcgccgagaataaaatttggggcagaaagagctggcccctgaacgaaggcatcatggcggtcgggattgtgtccatccttctgagctctctcctgaaaaacgatgttcctctcgccggacccctgatcgctggcgggatgcttattgcctgttacgtgatcagcggatcctctgctgacctgagcctggagaaggccgccgaggtctcctgggaagaggaagctgagcattctggcgcgagccacaatattctcgtggaagttcaggatgacgggacgatgaaaatcaaggatgaggagcgggacgataccctgacaattcttctgaaggccaccctcctggctgtgtccggagtctatcctctctctatccccgccacactgttcgtgtggtacttctggcagaaaaagaaacaacgcagcggcgtcctttgggacacccctagccctcccgaagtggagagagccgttctggatgacggcatctatcggattatgcagcgcgggctgctcggaagaagccaggtgggcgtcggggtgtttcaggaaaacgttttccatacgatgtggcacgtgacccggggagctgtcctgatgtaccaaggcaagcgccttgagccctcttgggcctccgtgaaaaaggacctgatcagctacgggggaggctggagactccagggctcttggaatacaggggaggaagtgcaggttattgcggtcgagcccggaaagaaccctaaaaatgtgcagaccgctcccggcacatttaagacctccgaaggggaggtgggagccatcgccctggatttcaaaccgggcacaagcgggtcccctattgtcaaccgggaaggaaagatcgtgggcctctatggcaatggggttgtgacgacctctggaacatacgtcagcgctattgcccaagcgaaggcttcccaggagggccccctgcctgagatcgaagacgaggtgtttagaaagcgcaaccttaccatcatggatctgcaccccgggagcggaaagacccggaaatatctgcccgccattgttagagaagccatcaagcgcaaactccggacactgattcttgctcctacgagagtggtcgcctctgagatggctgaagccctgaagggcatgccgatccgctaccagaccacagcggtgaaatccgagcataccgggaaggagattgttgacctcatgtgccacgccacattcaccatgcggctgctgagccccgtgagagtccctaattataacatgatcatcatggatgaagctcattttacggacccctctagcattgccgctcgcggctacatctccacacgggtgggaatgggcgaggccgccgctattttcatgaccgcgacccctcccgggtctgtggaagcctttcctcaaagcaatgctgtcatccaggatgaggaaagagacattccggagcggtcctggaactctggatatgagtggatcacagatttccccggcaagaccgtttggtttgtgcctagcatcaaatccgggaatgacattgccaactgtctccgcaagaatggaaaaagagtgatccagcttagccggaagacattcgataccgaataccagaaaacgaagaacaacgactgggactacgtcgtgacaaccgatatttctgagatgggcgccaatttccgcgctgacagagttatcgatccccggagatgcctgaagcctgtgattctgaaagacgggcccgaacgcgtcatcctcgccggcccgatgcctgtgacagttgcgtccgctgcccaacggagaggacgcattggccggaaccacaataaggagggggatcagtatatctacatgggacagcccctgaacaatgacgaggatcatgcccactggaccgaagctaaaatgcttctggacaacatcaatacgcccgagggcattatccctgccctctttgaacccgagagagaaaagagcgcggccattgatggggagtatcgcctgcggggagaggctagaaaaaccttcgtggaactgatgcgcagaggcgacctccctgtctggctttcctacaaggtggcctctgaggggtttcagtatagcgatcggcgctggtgcttcgacggcgaaagaaacaatcaagtcctggaggaaaacatggatgtggagatctggacaaaagagggagaacggaagaagctgcgcccgagatggctcgacgctcggacctactccgaccccctggcccttagagagtttaaagagttcgctgccggccgccggtctgttagcggggatctgattctcgagatcggaaagctgcctcagcacctgacacagagagcgcagaatgccctcgacaaccttgtgatgctgcataattccgaacaaggcgggcgcgcttatcggcacgccatggaggagctgcccgataccatcgaaacactcatgctgcttgctctgattgccgtgctcaccggaggcgtcacgctgtttttcctgagcggcagagggctcggaaaaacatctatcggccttctgtgtgttatggcctccagcgtgctgctctggatggcttctgtggagcctcattggattgcggcctccatcattctggaatttttccttatggtcctgctcatccccgagccggaccggcagcgcacccctcaggataaccagctggcttacgtggttatcgggctgctctttatgattcttaccgtggccgccaatgagatgggactgctggaaacaaccaagaaagacctcggcatcgggcacgtcgctgtggagaaccaccatcacgccgcgatgctggatgtcgaccttcatcccgccagcgcttggacactgtacgccgtggctacgaccattatcacacctatgatgagacacaccattgaaaacacaaccgccaatatctctctcacggcgattgccaaccaagctgccatcctgatgggactggataagggctggcccatcagcaagatggacattggcgttcctctccttgctctggggtgctattcccaggtgaatcccctgaccctcacagccgctgtcctgatgcttgtggcccattacgcgatcattggaccgggcctgcaggccaaagctacccgggaggcccaaaagcgcacagctgccgggatcatgaaaaaccctaccgttgatggaattgtggccatcgacctcgatcccgtcgtgtatgacgcgaagttcgaaaaacagctgggccagatcatgctgctcattctttgtacgtctcagatcctgctgatgagaacaacctgggctctctgcgagagcattacactggccaccgggccccttaccacactgtgggagggatcccctggcaagttttggaatacgaccatcgctgtgagcatggccaacattttccggggctcctacctcgccggggctggactggccttctctctgatgaagtccctcggcgggggacgcagaggcacaggggcgcaaggagaaacccttggcgagaaatggaagcggcagctgaatcagctgtccaaatctgaatttaacacatataagcgcagcggcatcatggaggttgacagatccgaagccaaagaggggctcaagcggggagagaccacgaagcacgctgtctctagaggcacagccaaactgcgctggttcgtggaacggaatcttgtgaagccggaggggaaagtcatcgatctgggatgtggcagagggggatggagctactattgcgctggcctcaagaaagttaccgaagtgaagggctacaccaaagggggacccggccacgaggaacctattcccatggccacatacgggtggaacctggtgaagctgcattccggaaaggacgtctttttcatccctcccgagaaatgtgataccctcctttgcgacattggcgagagctctcctaatccgacaatcgaagaggggcgcacgctgcgggtgctgaagatggttgaaccctggctcagaggaaaccagttttgtattaaaatcctgaatccttatatgccctccgtggtcgagacccttgagcaaatgcagcgcaagcacggcggcatgctggtgcggaaccctctcagcagaaattctacacatgaaatgtactgggtttcctgcgggaccggaaacattgtgagcgcggtcaatatgacatctcgcatgctgctgaaccggttcaccatggcccacagaaaacccacgtatgagcgcgatgtggacctcggcgctgggacccggcacgtggccgtcgaaccggaggttgctaacctggatatcatcggacagagaattgaaaatatcaagcatgagcacaagtccacatggcattacgacgaggataacccttataaaacctgggcctaccacggcagctatgaagtgaagccctccgggagcgcttctagcatggtgaatggagtcgtgaaacttctgacaaagccctgggacgttattcctatggtgacccagatcgccatgacagataccacgccctttggccaacagcgcgtcttcaaagagaaggtggacacaagaacccctaaggcgaaacggggcaccgcccagattatggaagttacagctaagtggctctgggggtttctgtcccgcaacaaaaagccgagaatctgtacgcgggaggagttcaccagaaaagtgcggtctaatgccgctatcggagccgtctttgtggacgagaaccaatggaatagcgccaaggaggcggttgaagatgagcgcttctgggaccttgtgcatagagaacgggagctgcacaagcagggcaaatgcgctacatgcgtctacaacatgatggggaagcgcgagaaaaagctcggagagtttggcaaagccaaggggtccagagccatttggtacatgtggctgggcgctcggttcctggagttcgaagccctcggatttatgaatgaggatcactggttctctcgcgaaaacagcctgtccggcgtggagggggagggacttcataaactgggctatatcctcagagacatttctaagatccccgggggaaatatgtacgctgatgacaccgccggctgggatacacggattaccgaagacgatctgcagaacgaggcgaagatcacagacatcatggaacctgagcacgcccttctggctaaaagcatttttaagctcacctatcagaataaagtcgtgcgcgttcaaagacccgccaagaacgggacggtgatggatgtcatctcccggcgcgaccagagaggcagcggacaggtgggcacctacgggctgaatacattcaccaacatggaagctcagctgattcggcaaatggagtctgagggaatcttttcccctagcgaactcgagacacccaacctggccggccgcgtgcttgattggctggaaaaacatggggttgagagactcaagcggatggcgatttctggagacgactgtgtggtcaagccgatcgatgacagattcgccaccgctctgacggcccttaatgatatgggcaaagtgcgcaaggacatccctcagtgggaaccctccaaagggtggaacgattggcagcaggttcctttttgcagccaccacttccatcaactgattatgaaggacggccgggagatcgtggtcccctgtagaaatcaggatgagctcgtgggacgcgctcgggtctcccagggcgccgggtggtctctgagagaaacagcttgcctgggaaaaagctatgcccagatgtggcaactcatgtactttcaccgccgggacctgagacttgcggccaacgctatttgttccgccgtgcctgttgattgggtgcccaccagccgcacaacctggtctatccatgcccaccatcagtggatgacgaccgaggacatgctgtccgtctggaatcgggtgtggattgaagagaacccgtggatggaagataagacacacatcagctcttggggcgacgttccttatctcgggaagagagaggaccagtggtgcggaagcctgattggccttaccgctcgcgccacatgggcgaccaatatccaagtggctatcaaccaggtccggagactgattgggaatgagaactacctcgattacatgacatccatgaaacggttcaagaatgaatctgaccccgagggcgccctgtggtga

SEQ ID NO: 18902 - RNA, 9879 nt, synthetic construct
  misc_feature 1..9879: note = derived and/or modified CDS sequence (opt5) from DENV-1__FJ432739__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaacatgtgcacccttattgccatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttaaagggatgagctatgtgatgtgtacaggctctttcaagctggagaaggaagtcgcggagacccagcacggaaccgtgctcgttcagatcaaatacgagggcacagacgctccgtgcaagattcctttttccacccaggatgaaaaaggggtgacacaaaacggacggctgatcacggccaatcccatcgtcaccgacaaggagaaacctgtgaacattgaagccgagccgcccttcggcgagagctatatcgtgattggggctggagaaaaggccctgaaactttcttggtttaaaaagggcagctccatcgggaaaatgttcgaggctacagccagaggcgcgcgccggatggccattctcggagataccgcttgggactttggctctatcgggggagttttcacaagcgtcggcaagctggtgcatcagatctttgggaccgcctacggagtgctgttctccggcgtcagctggacgatgaaaattgggatcggcgtgctcctgacctggcttggactcaattctagatccacaagcctctctatgacctgtattgctgttggcctggtgacactgtaccttggggtcatggtgcaggccgattccggatgcgttatcaactggaagggccgcgaactcaagtgtgggagcggaatttttgtgaccaatgaggtccacacatggaccgaacagtataaattccaagcggactcccctaagcggctgtctgccgctatcggcaaagcctgggaggagggggtgtgcggcattagaagcgctacgcgcctggaaaacatcatgtggaagcagatctccaacgagctcaatcatattctgcttgaaaacgacatgaaatttacagttgtggtcggagatgtggccggcatcctggcccaggggaagaaaatgattcggccgcagcccatggagtacaagtattcttggaaaagctggggaaaggctaagatcattggcgcggacgtgcaaaatgccaccttcatcatcgatgggcctaacacccccgaatgtcctgacgatcagagagcttggaatatttgggaggtcgaggactacggatttggcatcttcacaaccaacatttggctcaaactgcgcgattcctatacgcaggtttgcgaccaccggctgatgagcgccgccatcaaggattctaaagctgtgcacgccgacatgggctactggattgaatccgagaagaatgaaacatggaaacttgcgagagctagcttcatcgaggtgaaaacctgtatctggcccaagtctcatacactctggtccaacggggtcctggaaagcgagatgattatcccgaaaatttatggaggccctatctctcagcacaattaccgccccgggtactttacccaaacagccggaccttggcatctgggcaagctcgagctggatttcgacctttgcgaagggaccacggtggttgtggatgagcactgcggaaaccggggccccagcctgagaaccacaaccgtcacaggcaaaattatccacgaatggtgttgccggtcctgtaccctccctcccctgcgctttaagggggaggacggatgctggtatggcatggagatcagaccggtgaaggaaaaagaggaaaatctggttaagagcatggtgtctgccgggtccggagaggtcgacagcttctcccttggcctcctgtgtatttctatcatgattgaagaggtgatgcggagcagatggtcccgcaaaatgctgatgacggggatcctcgctgtctttttcctgcttattatgggacagctgacatggaacgatctcatccggctgtgcattatggtgggcgccaatgcgtctgacagaatgggcatggggaccacatacctggctcttatggccacctttaagatgcgccctatgttcgccgtcggactgctctttagacggctgaccagccgcgaggtgctcctgcttacaatcggcctgtccctcgtggcttctgtcgaactgcccaacagcctggaggaacttggggatggactggccatgggcatcatgattctcaaactgctcacggacttccagtcccatcaactgtgggctacccttctgagcctcacatttatcaagaccacattctctctgcactatgcctggaagaccatggcgatggttctgtccattgtgagcctttttcccctgtgtctctctacgacatcccagaaaaccacctggctgcctgtgctcctggggagccttggatgcaagccgctgacaatgttcctgatcgccgagaataaaatttggggcagaaagtcttggcccctcaacgaaggcatcatggctgtcgggatcgtgtccattctgcttagctccctgctcaaaaacgatgttcctctggccggacccctcatcgctggcgggatgctgattgcctgttacgtgatcagcggatctagcgccgacctttccctggagaaggctgcggaggtctcttgggaagaggaagccgagcatagcggcgcttcccacaatattctggtggaagttcaggatgacgggaccatgaaaatcaaggatgaggagcgggacgatacactcacgatcctgcttaaggccaccctgctcgccgtgtctggagtctatcctctgagcattcccgctacactcttcgtgtggtacttttggcagaaaaagaaacaacgctccggcgtcctgtgggacaccccttctcccccggaagtggagagagccgttcttgatgacggcatctatcggattatgcagcgcgggctgctgggaagaagccaggtgggcgtcggggtgttccaggaaaacgtttttcatacaatgtggcacgtgacccggggagcggtcctcatgtaccaaggcaagcgcctggagccttcctgggctagcgtgaaaaaggaccttatctcttacgggggaggctggagactgcagggctcctggaatacgggggaggaagtgcaggttattgccgtcgagcccggaaagaaccctaaaaatgtgcagaccgcccccggcacattcaagaccagcgaaggggaggtgggagctatcgccctcgattttaaaccgggcacatctgggtcccctattgtcaaccgggaaggaaagatcgtgggcctgtatggcaatggggttgtgaccacaagcggaacgtacgtctccgcgatcgctcaagccaaagcctctcaggagggccccctccctgagattgaagacgaggtgttcagaaagcgcaacctgaccatcatggatcttcaccccgggagcggaaagacacggagatatctgcccgctattgttcgcgaagccatcaaacggaagctgagaaccctcattctggctcctacccgcgtggtcgcctccgagatggcggaagcccttaaaggcatgccgatccggtaccagacaacggctgtgaagtccgagcataccgggaaagagatcgttgacctgatgtgccacgccacatttaccatgagactcctgtctcccgtgcgcgtccctaattataacatgattatcatggatgaagctcatttcacagacccctccagcattgccgcccggggctacatctctaccagagtgggaatgggcgaggctgcggccatttttatgacggctacacctcccgggagcgtggaagccttccctcaatccaatgccgtcatccaggatgaggaacgggacatcccggagcgctcttggaacagcggatatgagtggattaccgattttcccggcaagaccgtttggttcgtgccttccatcaagtctgggaatgacattgctaactgtctgcgcaagaatggaaagcgggtgatccagctcagccgcaaaacattcgataccgaataccagaagaccaagaataacgactgggactacgtcgtgaccacggatatttccgagatgggcgccaattttagagcggaccgggttatcgatcccagacgctgccttaagcctgtgattctgaaggacgggcccgaacgggtcatcctggctggcccgatgcctgtgacagttgccagcgccgctcaaagacgcggacggatcggcagaaaccacaataaagagggggatcagtatatttacatgggacagcccctcaacaatgacgaggatcatgcccactggaccgaagcgaagatgctgcttgacaacatcaatacacccgagggcattatccctgccctgttcgaacccgagcgcgaaaaatctgctgccattgatggggagtatcggctcagaggagaggctcgcaagacctttgtggaactgatgagacggggcgacctgcctgtctggctctcctacaaagtggccagcgaggggttccagtattccgatcgcagatggtgctttgacggcgaacggaacaatcaagtccttgaggaaaacatggatgtggagatctggacgaaggagggagaacgcaaaaagctgagaccgcggtggctggacgctagaacctactctgaccccctcgccctgcgcgagttcaaggaatttgcggccggccggagaagcgtttccggggatcttatcctggagattggaaaactccctcagcacctgacacagcgcgctcagaatgccctggacaacctcgtgatgcttcataattctgaacaaggcgggcgggcttatagacacgccatggaggagctgcccgataccatcgaaacactgatgctcctggcccttattgctgtgctgaccggaggcgtcacactcttctttctgagcggccgggggctgggaaagacctccatcggcctcctttgtgttatggcgagctctgtgctgctgtggatggcctccgtggagcctcattggattgctgccagcatcatcctcgagttctttctgatggtccttctgattcccgagccggaccgccagagaacgcctcaggataaccagctcgcctacgtggttatcgggctgctgttcatgattctcacagtggctgccaatgagatgggacttctggaaaccaccaaaaaggacctgggcatcgggcacgtcgcggtggagaaccaccatcacgccgctatgctcgatgtcgacctgcatcccgcctctgcttggacactttacgccgtggcgaccacaattatcacgcctatgatgcggcacaccattgaaaacacaaccgccaatatctccctgacagctatcgccaaccaagctgccattctcatgggactggataaaggctggcccatcagcaagatggacattggcgttcctctgctcgctcttgggtgctattctcaggtgaatcccctgaccctgacggccgcggtcctcatgctggtggcccattacgctatcattggaccgggccttcaggccaaggctacccgcgaggcccagaagagaacagccgcggggatcatgaagaaccctaccgttgatggaatcgtggctattgacctggatcccgtcgtgtatgacacaaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggttgaccggtctgaagctaaggaggggctgaaaagaggagagacaaccaagcacgccgtcagccgcggcacggctaagctccggtggtttgtggaaagaaatctggtgaaaccggaggggaaggtcatcgatcttggatgtggccgcgggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggcggacacttagagtgctgaaaatggttgaaccctggctgcgcggaaaccagttctgtattaagatcctcaatccttatatgcccagcgtggtcgagacgctggagcaaatgcagcggaaacacggcggcatgcttgtgagaaaccctctgtctcgcaattccacccatgaaatgtactgggttagctgcgggacaggaaacatcgtgtctgccgtcaatatgacctcccggatgctcctgaacagatttacaatggctcaccgcaagcccacctatgagcgggatgtggacctgggcgccgggacgagacacgtggctgtcgaaccggaggttgccaacctcgatattatcggacagcgcattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccaacagagagtctttaaggagaaagtggacacgcggacacctaaggccaagcgcggcaccgctcagatcatggaagttaccgccaaatggctgtgggggttcctctctagaaacaagaaaccgcggatttgtacaagagaggaatttacgcggaaggtgcgcagcaatgctgccatcggagccgtcttcgtggacgagaaccaatggaactccgcgaaagaggctgttgaagatgagagattttgggacctggtgcatcgggaacgcgagcttcacaagcagggcaagtgcgcgacctgcgtctacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtggagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtcgtgagagttcaacggcccgctaaaaacgggaccgtgatggatgtcatctctcgcagagaccagcggggcagcggacaggtgggcacgtacgggctcaatacctttacaaacatggaagcccagctgattcgccaaatggagtccgagggaatcttcagcccttctgaactggagacccccaacctcgcgggcagagtgctggattggcttgaaaagcatggggttgagcggctgaaaagaatggccatctccggagacgactgtgtggtcaagccgattgatgaccgctttgctacagccctcaccgctctgaatgatatgggcaaggtgcggaaagacatccctcagtgggaacccagcaaggggtggaacgattggcagcaggttcctttctgctctcaccactttcatcaacttattatgaaagacggcagagagatcgtggtcccctgtcgcaatcaggatgagctggtgggacgggccagagtctcccagggcgctgggtggagcctccgcgaaacggcctgcctgggaaagtcctatgcgcagatgtggcaactgatgtacttccaccggagagacctccgcctggccgctaacgccatttgttctgccgtgcctgttgattgggtgcccacaagccggaccacatggtccatccatgctcaccatcagtggatgaccacggaggacatgcttagcgtctggaatagagtgtggattgaagagaacccgtggatggaagataaaacccacatctcttcctggggcgacgttccttatctggggaagcgcgaggaccagtggtgcggaagcctcatcggcctgacagcccgggcgacctgggctacaaatattcaagtggccatcaaccaggtcagacggcttattgggaatgagaactacctggattacatgacctctatgaagagatttaaaaatgaaatcgaccccgagggcgccctctggtga

SEQ ID NO: 18903 - RNA, 9879 nt, synthetic construct
  misc_feature 1..9879: note = derived and/or modified CDS sequence (opt5) from DENV-1__FJ410201__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgccggtctgttagcggagatctcatcctggagatcggcaagctgccccagcacctcacacagagagcgcagaatgcccttgacaacctggtgatgctgcataattccgaacaagggggacgggcttatcgccacgccatggaggagctccctgataccattgaaacactgatgcttctggctctcatcgccgtgctgaccggcggcgtcacgctgttctttctctctgggagaggacttggcaagacaagcattgggctgctgtgtgttatggcctccagcgtgctcctgtggatggcttctgtggagccccattggatcgcggcctccattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctacgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctatagccaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgtacgtctcagattctgctcatgagaacaacctgggctctgtgcgagagcatcacacttgccaccggacctctgaccacactctgggagggctccccgggcaaattctggaatacgaccattgctgtgtctatggccaacatctttcgggggagctacctggccggagctggcctggccttctccctcatgaaaagccttgggggaggccgcagagggacaggagcgcaaggcgaaaccctgggcgagaaatggaagcggcagctgaatcagctctccaagtctgagttcaacacatataaaagaagcgggatcatggaggttgaccgctccgaagccaaggagggactgaaacggggcgagaccacgaagcacgctgtctctagagggacagccaaacttcgctggtttgtggaacggaatctggtgaagcccgagggaaaggtcattgatctcggctgtgggagaggaggctggagctactattgcgctggcctgaaaaaggttaccgaagtgaaagggtacaccaagggaggccctgggcacgaggaacccatccctatggccacatacggatggaacctggtgaaactccattccggcaaggacgtcttctttattccccctgagaaatgtgatacccttctgtgcgacatcggggagtctagcccgaatcccacaattgaagagggacgcacgctgcgggtgctcaagatggttgaaccttggctgagaggcaaccagttctgtatcaagattcttaatccctatatgccttccgtggtcgagaccctggagcaaatgcagcgcaaacacggcgggatgctcgtgcggaaccccctgagcagaaattctacacatgaaatgtactgggtttcctgcggaaccggcaacatcgtgagcgcggtcaatatgacatctcgcatgctgctcaaccggtttaccatggcccacagaaagccgacgtatgagcgcgatgtggacctggggaccggaacaagacacgtggctgtcgaacctgaggttgccaaccttgatatcattggccagcggatcgaaaatattaaacatgagcacaagtccacctggcattacgacgaggataacccctataaaacatgggcttaccacgggagctatgaagtgaagccctctggatccgccagctccatggtgaatggcgtcgtgaagctgctcaccaaaccttgggacgttatccccatggtgacacagattgctatgaccgatacgacacctttcggccaacagcgcgtctttaaggagaaagtggacaccagaaccccgaaggccaaacgggggacagcgcagatcatggaagttacggccagatggctgtggggattccttagccggaacaagaagccccgcatctgtaccagagaggaatttacacggaaagtgcgctctaatgctgccattggcgctgtcttcgtggacgagaaccaatggaatagcgccaaggaggccgttgaagatgagagattttgggacctggtgcatcgggaacgcgagctccacaaacaggggaagtgcgcgacctgcgtctacaacatgatgggaaaaagagaaaagaagctgggcgagttcgggaaagctaagggctcccgggccatctggtacatgtggctgggagcccgctttctcgagttcgaagctctgggcttcatgaatgaggatcactggttttctagagaaaacagcctttccggggtggagggagagggcctgcataaactcgggtatattctgcgggacatctctaagattcctggaggcaatatgtacgccgatgacacagctgggtgggatacccgcatcacagaagacgatcttcagaacgaggccaaaatcaccgacattatggaacccgagcacgcgctgctcgccaaggctatcttcaaactgacgtatcagaataaggtcgtgagagttcaacggcctgccaagaacggcaccgtgatggatgtcattagccgcagagaccagcggggatccggccaggtggggacatacggactgaatacctttacaaacatggaagctcagctcatcagacaaatggagtctgagggcattttcagcccctccgaactggagaccccgaaccttgccgaacgcgcgctggattggctcgagaaatatggggtggaacggctgaagagaatggccatcagcggagacgactgtgttgtgaaacctatcgatgaccgctttgctacggcccttacagctctgaatgatatgggcaaggtccggaaagacattccccagtgggagccttctaaggggtggaacgattggcaacaggtgcccttctgctcccatcactttcaccaactcatcatgaaggacggcagagagattgttgtgccttgtcgcaatcaggatgaactggtcggacgggccagagtgagccagggcgctgggtggtctctgcgcgagaccgcctgcctcggaaaatcctacgcgcagatgtggcaactgatgtatttccatcggagagaccttcgcctggccgctaacgccatctgtagcgccgtccccgtggattgggttccgacatcccggaccacgtggtctattcacgctcatcaccagtggatgaccacagaagacatgctcagcgtgtggaatagagtctggatcgaggaaaacccttggatggaggataagacccatatttccagctgggaggacgtgccctacctgggcaaacgggaagaccagtggtgcgggtctcttatcggactgacagccagagcgacctgggctacaaatatccaagttgccattaaccaggtgcgccggctcatcggcaatgagaactacctgaattatatgacctccatgaagagatttaaaaacgaaagcgatcccgagggggccctgtggtga

SEQ ID NO: 18904 - RNA, 9879 nt, synthetic construct
  misc_feature 1..9879: note = derived and/or modified CDS sequence (opt5) from DENV-1__FJ410203__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttacgtgatttccggcagctctgctgacctgagcctcgagaaggccgccgaggtttcctgggaagaggaagctgagcattctggggcgagccacaatatcctggtggaagtccaggatgacggaacgatgaaaatcaaggatgaggagcgcgacgatacccttacaattctgctcaaagccaccctgctcgctgtgtccggcgtttatcctctgtctatccccgccacacttttcgtgtggtacttctggcaaaagaagaaacagagaagcggcgtcctgtgggacacccctagccctcccgaagtggagcgggccgtcctggatgacgggatttatcgcatcatgcagagaggactcctgggccggtctcaggtgggggttggagtgtttcaagaaaacgtcttccatacgatgtggcacgtgacccgcggcgctgttcttatgtaccaggggaagagactggagcccagctgggcctccgtgaaaaaggacctcattagctacggaggcggctggcggctgagagggtcttggaatacaggagaggaagtccaggtgatcgcggtggagcccggcaaaaaccctaagaatgttcagaccgctcccgggacatttaagaccccggaaggagaggtcggcgccattgccctcgatttcaaacctgggacatccggaagccccatcgtgaaccgcgaaggcaagatcgtgggcctgtatgggaatggagtcgtgacgacctctggcacatacgtttccgctattgcccaagcgaaagctagccaggaggggcctcttcccgagatcgaagacgaggtgtttcggaagagaaacctgaccattatggatctgcaccccggatccggcaaaacccgccggtatctccctgccatcgtcagagaagccattaagcgcaagctgcggacacttatcctggctccgacgagagtggttgcctctgagatggctgaagccctcaaagggatgcccatccgctaccagaccacagcggtcaagagcgagcataccggcaaagagattgtcgacctgatgtgccacgccacattcaccatgcggctgctctcccctgtgagagttcccaattataacatgatcattatggatgaagctcattttacggaccctagctctatcgccgctcggggatacatttccacacgcgtgggcatgggggaggccgccgctatcttcatgaccgcgacaccccctggaagcgtcgaagcctttccgcaatctaatgctgtgatccaggatgaggaaagagacattcccgagcggagctggaactccggccacgagtggatcacagatttccctgggaagaccgtgtggtttgtcccctctattaaaagcggaaatgacatcgccaactgtcttcgcaagaatggcaagagagttattcagctgtcccggaaaacattcgataccgaatatcagaagacgaaaaacaacgactgggactacgtggtgacaaccgatatctctgagatgggggccaatttcagagctgaccgcgtcattgatcctcggagatgcctgaagcccgtgatcctcaaagacggcccggaacgcgttatcctggccggacctatgcccgtgacagtcgcgagcgctgcccaacggagaggccgcattgggcggaaccataataaggagggagatcagtacatctatatgggccagccccttaacaatgacgaggatcacgcccactggaccgaagctaagatgctgctcgacaacattaatacgcctgaggggatcattcccgccctgtttgaacctgagagagaaaaatccgcggccgtggatggagagtaccgcctgagaggcgaggctcggaagaccttcgttgaactcatgcgcagaggggaccttccggtgtggctgagctataaagtcgcctctgagggctttcagtactccgatcggcgctggtgcttcgacggagaaagaaacaatcaagtgctggaggaaaacatggatgtcgagatctggacaaaggagggcgaacggaaaaagctcagaccccgctggctggacgctcggacctatagcgaccctcttgccctgagagagtttaaagagttcgctgccgggcgccggtccgtgtctggagatctcatcctggagattggcaagctgccccagcatctcacacagagagcgcagaatgcccttgacaacctggttatgctgcacaatagcgaacaagggggacgggcttaccgccatgccatggaggagctccctgataccatcgaaacactgatgcttctggctctcattgccgtgctgaccggcggcgtgacgctgtttttcctctccgggagaggacttggcaagacatctatcgggctgctgtgtgtcatggccagctccgttctcctgtggatggctagcgtggagccccactggattgcggcctctatcatccttgaatttttcctgatggtgctcctgattccggagcctgaccggcagcgcacaccccaggataaccagctggcttatgtcgtgatcggactcctttttatgattctgaccgttgccgccaatgagatgggcctgctcgaaacaaccaaaaaggacctggggatcggacacgtggctgtcgagaaccatcaccatgccgcgatgcttgatgtggacctgcaccctgcctccgcttggacactctacgccgtcgctacgaccattatcacacccatgatgagacataccattgaaaacacaaccgccaatatcagcctgacggcgatcgccaaccaagctgccattctgatgggcctcgataaaggctggcctatctctaagatggacattggggtgccccttctggctctgggatgctactcccaggttaatccgctcaccctgacagccgctgtgcttatgctggtcgcccactatgcgatcattggccctgggctccaggccaaagctacccgggaggcccaaaagcgcacagctgccggaatcatgaagaaccccaccgtggatggcatcgttgccattgacctggatcccgtggtctacgacgcgaaattcgaaaagcagctggggcagatcatgctccttattctgtgtacgagccagatcctgctcatgagaacaacctgggctctgtgcgagtctattacacttgccaccggacctctgaccacactctgggagggcagcccgggcaaattttggaatacgaccatcgctgtgtccatggccaacatcttccgggggtcttatctggccggagctggcctggccttcagcctcatgaagtcccttgggggaggccgcagagggacaggagcgcaaggcgaaaccctgggcgagaaatggaagcggcagctgaatcagctcagcaagtccgaatttaacacatacaaaagatctgggattatggaggtggaccgcagcgaagccaaggagggactgaaacggggcgagaccacgaagcacgctgtttccagagggacagccaaacttcgctggttcgtcgaacggaatctggtgaagcccgagggaaaggtgatcgatctcggctgtgggagaggaggctggtcttattactgcgctggcctgaaaaaggtcaccgaagttaaagggtataccaagggaggccctgggcatgaggaacccattcctatggccacatacggatggaacctggtgaaactccacagcggcaaggacgtgtttttcattccccctgagaaatgtgatacccttctgtgcgacatcggggagtcctctccgaatcccacaatcgaagagggacgcacgctgcgggtcctcaagatggtggaaccttggctgagaggcaaccagttttgtattaagatccttaatccctacatgcctagcgttgtggagaccctggagcaaatgcagcgcaaacatggcgggatgctcgtccggaaccccctgtccagaaatagcacacacgaaatgtattgggtgtcttgcggaaccggcaacatcgtttccgcggtgaatatgacaagccgcatgctgctcaaccggttcaccatggcccacagaaagccgacgtacgagcgcgatgtcgacctggggaccggaacaagacatgtggctgtggaacctgaggtcgccaaccttgatattatcggccagcggattgaaaatatcaaacacgagcataagtctacctggcactatgacgaggataacccctacaaaacatgggcttatcatgggtcctacgaagttaagcccagcggatctgcctccagcatggtgaatggcgtggtcaagctgctcaccaaaccttgggacgtgattcccatggttacacagatcgctatgaccgatacgacaccttttggccaacagcgcgtgttcaaggagaaagtcgacaccagaaccccgaaggccaaacgggggacagcgcagatcatggaagtgacggccagatggctgtggggatttctttcccggaacaagaagccccgcatttgtaccagagaggagttcacacggaaagttcgcagcaatgctgccatcggcgctgtgtttgtcgacgagaaccaatggaactctgccaaggaggccgtggaagatgagagattctgggacctggttcaccgggaacgcgagctccacaaacaggggaagtgcgcgacctgcgtgtataacatgatgggaaaaagagaaaagaagctgggcgagtttgggaaagctaagggcagccgggccatttggtacatgtggctgggagcccgcttcctcgagttcgaagctctgggctttatgaatgaggatcattggttctccagagaaaactctcttagcggggtcgagggagagggcctgcacaaactcgggtacatcctgcgggacatttccaagatccctggaggcaatatgtatgccgatgacacagctgggtgggatacccgcatcacagaagacgatcttcagaacgaggccaaaattaccgacatcatggaacccgagcatgcgctgctcgccaaggctatttttaaactgacgtaccagaataaggtggtcagagtgcaacggcctgccaagaacggcaccgttatggatgtgatctctcgcagagaccagcggggaagcggccaggtcgggacatatggactgaataccttcacaaacatggaagctcagctcattagacaaatggagtccgagggcatcttttctcccagcgaactggagaccccgaaccttgccgaacgcgcgctggattggctcgagaaatacggggtggaacggctgaagagaatggccatctccggagacgactgtgtggttaaacctattgatgaccgcttcgctacggcccttacagctctgaatgatatgggcaaggtgcggaaagacatcccccagtgggagcctagcaaggggtggaacgattggcagcaggtccccttttgctctcaccacttccatcaactcattatgaaggacggcagagagatcgtggttccttgtcgcaatcaggatgaactggtgggacgggccagagtctcccagggcgctgggtggagcctgcgcgagaccgcctgcctcggaaaatcttatgcgcagatgtggcaactgatgtactttcaccggagagaccttcgcctggccgctaacgccatttgttccgccgtgcccgtcgattgggtgccgacaagccggaccacgtggtccatccatgctcaccatcagtggatgaccacagaagacatgctctctgtttggaatagagtgtggattgaggaaaacccttggatggaggataagacccacatcagctcctgggaggacgtcccctatctgggcaaacgggaagaccagtggtgcgggagccttatcggactgacagccagagcgacctgggctacaaatattcaagtggccatcaaccaggttcgccggctcattggcaatgagaactacctggattacatgacctctatgaagagattcaaaaatgaatccgaccccgagggggccctgtggtga

SEQ ID NO: 18905 - RNA, 9879 nt, synthetic construct
  misc_feature 1..9879: note = derived and/or modified CDS sequence (opt5) from DENV-1__FJ410204__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagaccagcgccggcgttaatatgtgcacccttattgccatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgtatacatggaccgaacaatacaagtttcaggccgactcccctaaacggctgtctgcggccatcggcaaggcttgggaggagggggtctgcggcatcagaagcgccacgcgcctcgaaaacattatgtggaaacagatctccaacgagctgaatcacattcttctggaaaacgacatgaagctcacagtggttgtgggagatgtcgctggcatcctggggcagggcaagaagatgattcggccgcaacccatggagtataaatactcttggaaaagctggggcaaggccaagatcatcggggccgacgctcagaataccaccttcattatcgatggacctaacacacccgaatgtcctgacgatcagagagcgtggaatatttgggaggtggaggactatggctttggcatcttcaccacgaacatttggctgaaacttcgcgattcctacacacaggtgtgcgaccatcggctcatgagcgccgctatcaaagattctaaggccgtccacgccgacatggggtattggatcgaatccgagaaaaatgaaacctggaagctggctagagccagctttattgaggttaagacatgtatctggcccaaatctcacaccctgtggtccaacggagtgctcgaaagcgagatgattatcccgaagatttacggcgggcctatctctcaacataattaccgccccggatatttcacacagaccgcgggcccttggcacctggggaaacttgagctggatttcgacctctgcgaaggaacgaccgtggtcgtggatgagcattgcggcaaccggggccccagcctgagaacaaccacagttaccgggaagatcattcacgaatggtgttgccggtcctgtacgctgcctccccttcgctttagaggagaggacggctgctggtacgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctatctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccaccagctgtgggctaccctcctgtccctgacattcattaagaccacgtttagccttcattacgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttatgtgatttccggcagctctgctgacctgagcctcgagaaggccgccgaggtttcctgggaagaggaagctgagcactctggggcgagccataatatcctggtggaagtccaggatgacggaacgatgaaaatcaaggatgaggagcgcgacgatacccttacaattctgctcaaagccaccctgctcgctgtgtccggcgtttaccctctgtctatccccgccacacttttcgtgtggtatttctggcaaaagaagaaacagagaagcggcgtcctgtgggacacccctagccctcccgaagtggagcgggccgtcctggatgacgggatttaccgcatcatgcagagaggactcctgggccggtctcaggtgggggttggagtgtttcaagaaaacgtcttccacacgatgtggcatgtgacccgcggcgctgttcttatgtaccaggggaagagactggagcccagctgggcctccgtgaaaaaggacctcattagctatggaggcggctggcggctgagagggtcttggaatacaggagaggaagtccaggtgatcgcggtggagcccggcaaaaaccctaagaatgttcagaccgctcccgggacatttaagaccccggaaggagaggtcggcgccattgccctcgatttcaaacctgggacatccggaagccccatcgtgaaccgcgaaggcaagatcgtgggcctgtacgggaatggagtcgtgacgacctctggcacatatgtttccgctattgcccaagcgaaagctagccaggaggggcctcttcccgagatcgaagacgaggtgtttcggaagagaaacctgaccattatggatctgcaccccggatccggcaaaacccgccggtacctccctgccatcgtcagagaagccattaagcgcaagctgcggacacttatcctggctccgacgagagtggttgcctctgagatggctgaagccctcaaagggatgcccatccgctatcagaccacagcggtcaagagcgagcacaccggcaaagagattgtcgacctgatgtgccatgccacattcaccatgcggctgctctcccctgtgagagttcccaattacaacatgatcattatggatgaagctcactttacggaccctagctctatcgccgctcggggatatatttccacacgcgtgggcatgggggaggccgccgctatcttcatgaccgcgacaccccctggaagcgtcgaagcctttccgcaatctaatgctgtgatccaggatgaggaaagagacattcccgagcggagctggaactccggccatgagtggatcacagatttccctgggaagaccgtgtggtttgtcccctctattaaaagcggaaatgacatcgccaactgtcttcgcaagaatggcaagagagttattcagctgtcccggaaaacattcgataccgaataccagaagacgaaaaacaacgactgggactacgtggtgacaaccgatatctctgagatgggggccaatttcagagctgaccgcgtcattgatcctcggagatgcctgaagcccgtgatcctcaaagacggcccggaacgcgttatcctggccggacctatgcccgtgacagtcgcgagcgctgcccaacggagaggccgcattgggcggaaccacaataaggagggagatcagtatatctacatgggccagccccttaacaatgacgaggatcatgcccactggaccgaagctaagatgctgctcgacaacattaatacgcctgaggggatcattcccgccctgtttgaacctgagagagaaaaatccgcggccgtggatggagagtatcgcctgagaggcgaggctcggaagaccttcgttgaactcatgcgcagaggggaccttccggtgtggctgagctacaaagtcgcctctgagggctttcagtattccgatcggcgctggtgcttcgacggagaaagaaacaatcaagtgctggaggaaaacatggatgtcgagatctggacaaaggagggcgaaaccaaaaagctccggcacagatggcccgacgctcgccagtacagcgaccctctggggcttcgggagtttaaagagttcgccgctggaagacgctccgtgtctggcgatctgatcctcgagattgggaagctgccccagcatctgacacagcgggcccaaaatgcgctcgacaaccttgttatgctgcacaatagcgaacagggaggcagagcctatcggcatgctatggaggagctgcctgataccatcgaaacactcatgctgcttgccctgattgctgtgctcaccggcggggtgacgctgtttttcctgtccggacgcggcctcgggaagacatctatcggacttctgtgtgtcatggccagctccgttctgctctggatggccagcgtggagccccactggattgctgcgtctatcatcctggaatttttccttatggtgctgctcattccggagcctgacagacagcggacaccccaggataaccaactggcctacgtcgtgatcggcctgctctttatgattcttaccgttgctgccaatgagatggggctgctggaaacaaccaaaaaggacctcggaatcggccacgtggccgtcgagaaccatcaccatgctgccatgctggatgtggaccttcaccctgcgtccgcctggacactgtacgctgtcgccacgaccattatcacacccatgatgcgccataccattgaaaacacaaccgctaatatcagcctcacggccatcgcgaaccaggccgctattctgatgggcctggataaagggtggcctatctctaagatggacattggagtgcccctccttgccctgggctgctattcccaggttaatccgctgaccctcacagctgccgtgctgatgcttgtcgctcactacgccatcattgggcctggactgcaagcgaaagccaccagagaggctcagaagcggacagccgctggcatcatgaagaaccccaccgtggatgggatcgttgccattgacctcgatcccgtggtctatgacgccaaattcgaaaagcagctgggacagatcatgctgctcattctttgtacgagccaaatcctgctgatgcgcacaacctgggcgctctgcgagtctattacactggctaccggccctcttaccacactgtgggagggcagcccggggaaattttggaatacgaccatcgccgtgtccatggctaacatcttcagaggatcttacctcgccggcgccgggctggctttcagcctgatgaagtccctcggaggcgggcggcgcggaacaggcgcccagggcgaaacccttggggagaaatggaagagacagctgaatcagctgagcaagtccgaatttaacacatataaacggtctggaattatggaggtggacagaagcgaagcgaaggagggcctcaaacgcggggagaccacgaagcacgccgtttcccggggaacagctaaactgagatggttcgtcgaacgcaatcttgtgaagcccgagggcaaggtgatcgatctggggtgtggacggggcggctggtcttactattgcgccgggctcaaaaaggtcaccgaagttaaaggatacaccaagggcgggcctggacatgaggaacccattcctatggctacatacggctggaacctggtgaaactgcacagcgggaaggacgtgtttttcattccccctgagaaatgtgataccctcctttgcgacatcggagagtcctctccgaatcccacaatcgaagagggcagaacgctgcgcgtcctgaagatggtggaaccttggctccggggcaaccaattttgtattaagatcctgaatccctatatgcctagcgttgtggagacccttgagcagatgcagagaaaacatgggggaatgctggtccgcaaccccctctcccggaatagcacacacgaaatgtactgggtgtcttgcggcaccgggaacatcgtttccgccgtgaatatgacaagcagaatgctgctgaaccgcttcaccatggcgcaccggaagccgacgtatgagagagatgtcgacctcggaaccggcacacgccatgtggccgtggaacctgaggtcgctaacctggatattatcgggcagagaattgaaaatatcaaacacgagcataagtctacctggcactacgacgaggataacccctataaaacatgggcctaccatggatcctatgaagttaagcccagcggctctgcttccagcatggtgaatggcgtggtcaaacttctgaccaaaccttgggacgtgattcccatggttacacaaatcgccatgaccgatacgacaccttttgggcagcagcgggtgttcaaggagaaagtcgacacccgcaccccgaaggctaaaagaggaacagcccaaatcatggaagtgacggcgcggtggctctggggctttctgtccagaaacaagaagccccggatttgtacccgcgaggagttcacaagaaaagttcggagcaatgccgctatcggggccgtgtttgtcgacgagaaccagtggaactctgctaaggaggccgtggaagatgagcgcttctgggaccttgttcacagagaacgggagctgcacaaacagggaaagtgcgcgacctgcgtgtacaacatgatgggcaaacgcgaaaagaagctcggggagtttggcaaagcgaagggaagcagagctatttggtacatgtggctgggcgcccggttcctggagttcgaagccctcgggtttatgaatgaggatcattggttctcccgcgaaaactctctgagcggagtcgagggcgaggggcttcacaaactgggatatatcctcagagacatttccaagatccctggcgggaatatgtacgctgatgacacagccggctgggatacccggatcacagaagacgatctgcagaacgaggctaaaattaccgacatcatggaacccgagcatgcccttctggcgaaggccatttttaaactcacgtatcaaaataaggtggtccgcgtgcagagacctgctaagaacggaaccgttatggatgtgatctctcggcgcgaccagagaggcagcgggcaggtcggaacatacggcctgaataccttcacaaacatggaagcccaactgattcggcagatggagtccgaggggatcttttctcccagcgaactcgagaccccgaacctggctgaaagagcccttgattggctggagaaatatggagtggaacgcctcaagcggatggcgatctccggcgacgactgtgtggttaaacctattgatgacagattcgccacggctctgacagcccttaatgatatggggaaggtgcgcaaagacatcccccagtgggagcctagcaagggctggaacgattggcagcaagtccccttttgctctcaccacttccatcagctgattatgaaggacggacgggagatcgtggttccttgtagaaatcaggatgaactcgtgggccgcgctcgggtctcccagggggccggatggagcctgagagagaccgcttgcctgggcaaatcttacgcccaaatgtggcagctcatgtattttcaccgccgggacctgagacttgcggccaacgctatttgttccgccgtgcccgtcgattgggtgccgacaagccgcaccacgtggtccatccatgcccaccatcagtggatgaccacagaagacatgctgtctgtttggaatcgggtgtggattgaggaaaacccttggatggaggataagacccacatcagctcctgggaggacgtcccctacctcgggaaaagagaagaccaatggtgcggaagcctgatcggccttacagctcgggccacctgggcgacaaatattcaggtggctatcaaccaggttagacgcctgattgggaatgagaactacctcgattatatgacctctatgaagcggttcaaaaatgaatccgaccccgagggcgccctgtggtga

SEQ ID NO: 18906 - RNA, 9879 nt, synthetic construct
  misc_feature 1..9879: note = derived and/or modified CDS sequence (opt5) from DENV-1__FJ432742__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctggggagcctcggatgcaaaccgctgacaatgtttcttattacggagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttatgtgatcagcggatctagcgctgacctctccctggagaaagccgctgaggtttcttgggaagaggaagccgagcacagcggcgcctcccataatattcttgtggaagtccaggatgacgggaccatgaagatcaaagatgaggagcgggacgatacactgaccattctcctgaaggctacactcctggcggtgtctggagtctaccctcttagcatccccgccaccctgttcgtgtggtatttttggcaaaagaaaaagcagcgctccggcgttctgtgggacacgccttctcccccggaagtggagagagctgtcctcgatgacggcatctaccggattatgcagcgcgggctgcttggaagaagccaggtgggcgttggggtgttccaagaaaacgtcttccacaccatgtggcacgtgacacggggagccgtgctgatgtatcagggcaaacgcctcgagccttcctgggccagcgttaagaaagacctgatctcttacgggggaggctggagactccagggctcctggaataccggggaggaagtccaggtgattgctgtggagcccggaaagaaccctaagaatgtccaaacagcccccggcacctttaaaacaccggaaggggaggtgggagcgatcgctctggatttcaagcctggcacgagcgggtctcccattgttaaccgggaaggaaaaatcgtgggcctttacggcaatggggtcgtgaccacatccggaacctatgttagcgccattgcccaggctaaggcctcccaggagggccctctgcccgagatcgaagacgaggtgtttagaaaacgcaacctgaccatcatggatctccatcccgggtctggaaagacacggagatacctgcctgcgattgtccgcgaagctatcaagcggaaacttagaacgctgattctcgccccgacccgcgtggttgccagcgagatggctgaagccctgaagggcatgcccatccggtatcaaacaaccgctgtgaaatccgagcacacagggaaggagattgtcgacctgatgtgccatgccaccttcacgatgagactccttagccctgtgcgcgtgcccaattacaacatgatcatcatggatgaagcgcactttacagacccttcttccattgccgctcggggctatatcagcaccagagtcggaatgggcgaggccgctgccattttcatgaccgccacaccccctgggtctgttgaggcttttccgcagagcaatgcggtgatccaggatgaggaacgggacattcccgagcgctcctggaactctggatacgagtggatcaccgatttccctggcaaaacagtgtggtttgtccccagcatcaagtccgggaatgacattgccaactgtctgagaaagaatggaaaacgggtgatccagctgtctcgcaagaccttcgatacggaatatcagaagaccaagaacaacgactgggactacgttgtgaccacagatattagcgagatgggcgctaattttagagccgaccgggtcatcgatcctagacgctgcctcaaacccgtgattctgaaggacgggccggaacgggttatccttgccggccctatgcccgtgaccgtcgcttccgccgcgcagagacgcggacggattggcagaaaccataataaggagggggatcagtacatctatatgggacagcccctgaacaatgacgaggatcacgctcactggacggaagccaaaatgctcctggacaacatcaatacccctgagggcattatccccgccctgttcgaacctgagcgcgaaaagagcgctgccattgatggggagtaccggctcagaggagaggcgcgcaaaacattcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatctggaccaaagagggagaacgcaagaaactgagaccccggtggcttgacgctagaacatattccgaccctctggccctccgcgagtttaaggagttcgctgccggccggagatctgtgagcggggatctgattctggagatcggaaagctcccccagcatcttacccagcgcgctcaaaatgccctggacaacctggtcatgctccacaattccgaacagggcgggcgggcgtacagacatgccatggaggagctgcctgatacaatcgaaacccttatgctgctcgctctgattgccgttctgacgggaggcgtgacactctttttcctttctggccgggggctgggaaaaaccagcatcggcctgctctgtgtgatggcttccagcgtcctgctttggatggcctctgtggagccccactggattgccgcttccatcattctggaatttttcctcatggttctgctgatcccggagcctgaccgccagagaacaccccaggataaccaactcgcgtatgtggtcatcgggcttctgtttatgattctgacagtggccgctaatgagatgggactcctggaaaccacaaagaaagaccttggcatcgggcacgtcgccgtggagaaccatcaccatgccacgatgctggatgttgacctccaccctgctagcgcctggaccctgtacgcggtggccacaaccattatcacacccatgatgcggcataccattgaaaacacgaccgctaatatctctctgacagccattgctaaccaggccgcgatcctcatgggacttgataagggctggcctatctccaaaatggacattggcgtccccctgctggccctcgggtgctacagccaggtgaatccgctgacccttacagctgccgttctgatgctcgtggctcactatgccatcattggacctggcctgcaagctaaggccacccgcgaggcgcagaagagaacggccgctgggatcatgaaaaaccccacagtcgatggaattgtggccatcgacctggatcccgtggtttacgacgctaagttcgaaaaacagctcggccagatcatgcttctgattctgtgtacctctcaaatcctcctgatgcggacaacctgggccctttgcgagagcattaccctggccacagggcctctcacgaccctgtgggagggatccccgggcaagttttggaatacaaccatcgcggtctctatggctaacattttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcatcatggaggtggaccggtccgaagctaaagaggggcttaagagaggagagacgacacgccacgccgtgtctcggggcaccgcgaaactgagatggttcgtcgaacgcaatctcgttaagcccgaggggaaggtgattgatctgggatgtggcagagggggatggagctattactgcgccggcctgaaaaaggtgaccgaagtcaaaggctatacaaaagggggacctggccatgaggaacccatccctatggctacctacgggtggaacctcgtgaaacttcactccggaaaggacgtctttttcacaccccctgagaaatgtgatacgctgctgtgcgacattggcgagtctagcccgaatcccaccatcgaagaggggagaacactccgcgtgctgaagatggtcgaaccttggcttcggggaaaccaattttgtattaagatcctgaatccctacatgccttccgtggttgagaccctcgagcagatgcagagaaaacatggcggcatgctggtgcgcaaccccctgagcagaaattctacacacgaaatgtattgggtctcctgcgggaccggaaacattgtgagcgccgtgaatatgacgtctagaatgctcctgaaccgcttcaccatggctcaccggaagccgacatacgagagagatgtcgaccttggcgccgggacccgccatgttgcggtggaacctgaggtggccaacctggatatcatcggacagagaattgaaaatatcaaacacgagcataagtccacatggcactatgacgaggataacccctacaaaacctgggcttatcatggcagctacgaagtcaagccctctgggtccgccagctccatggtgaatggagttgtgaagctcctgacaaaaccttgggacgtcattcccatggtgacccaaatcgctatgacggatacaaccccttttggccagcagcgggttttcaaggagaaagtggacacccgcacaccgaaggccaaaagaggcacggctcaaattatggaagtcaccgcccggtggctttgggggtttctgagcagaaacaagaagccccggatctgtacacgcgaggagttcaccagaaaagtgcggtctaatgcggccatcggagctgtttttgtggacgagaaccagtggaatagcgccaaggaggctgtcgaagatgagcgcttctgggacctcgtgcagaaagaaagagagctgcacaagcagggcaaatgcgccacatgcgtctataacatgatggggaagcgggaaaagaaactgggagagtttggcaaggccaaagggtcccgcgcgatttggtacatgtggctcggcgctagattcctggagtttgaagcccttggattcatgaatgaggatcactggttctctcgggaaaacagcctgtccggcgtggagggggagggactccataagctgggctacatccttcgcgacatttctaaaatccctgggggaaatatgtatgccgatgacaccgctggctgggatacaagaattaccgaagacgatctgcaaaacgaggccaagatcacggacatcatggaacccgagcacgctctcctggccaccagcatttttaaactgacataccagaataaggttgtgcgggtccagcgccctgcgaagaacgggaccgtgatggatgtgatctccagacgggaccagcgcggctctggacaagttggcacatatgggctcaataccttcacgaacatggaagcccagctgattagacagatggagagcgagggaatctttcttccctccgaactggagacaccgaacctcgctgaacgggtgctggattggcttgagaaatacggcgtcgaaagactgaagcgcatggccattagcggggacgactgtgtggttaaacctatcgatgaccggttcgctaccgccctcacagcgctgaatgatatgggaaaggtgagaaaagacatcccccagtgggagccttctaagggctggaacgattggcaacaggtccccttttgctcccatcacttccaccagctgattatgaaggacgggcgcgagatcgtggtcccttgtcggaatcaggatgaactcgtgggcagagcccgcgttagccaaggagctggctggtctctgcgggagaccgcctgccttgggaaatcctatgctcagatgtggcagctgatgtactttcatagacgcgacctccggctggccgctaacgccatttgtagcgcggtgcccgtcgattgggtgccgacgtccagaaccacatggtctatccacgcccatcaccaatggatgaccacagaagacatgcttagcgtttggaatcgcgtgtggattgaggaaaacccttggatggaggataagacccatgtctccagctggggagacgtgccctatctgggcaaacgggaggaccagtggtgcgggtctctcatcggactgacagctagagccacctgggcctccaatattcaggtggctatcaaccaggttcggagactgatcggcaatgaaaactacctcgattacatgacgagcatgaagcgcttcaaaaatgagggggaccccgaaggcgccctgtggtga

SEQ ID NO: 18907 - RNA, 9879 nt, synthetic construct
  misc_feature 1..9879: note = derived and/or modified CDS sequence (opt5) from DENV-1__FJ410205__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgccggcaaactcgttcatcagattttcgggacggcttacggagtcctgttttccggcgtgagctggaccatgaagatcgggattggcgtgcttctgacatggctcggactcaattctagatccaccagcctgtctatgacatgtatcgccgtcggccttgtgaccctctacctgggggttatggtgcaggctgattccggatgcgtcattaactggaaaggccgcgaactgaagtgtgggagcggaatcttcgtgacaaatgaggttcacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgtcgtggttggagatgtggctggcattctggcccaggggaaaaagatgatccggccgcaacccatggagtacaaatattcttggaaaagctggggaaaggccaagattatcggcgctgacgtccagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctaaggccgtccacgccgacatgggctactggatcgaatccgagaaaaatgaaacatggaagctggctagagccagcttcatcgaggttaagacctgtatttggcccaaatctcatacactgtggtccaacggggtgctcgaaagcgagatgatcattccgaagatctatggaggccctatttctcaacacaattaccgccccgggtacttcacccagacggcgggaccttggcatctgggcaaacttgagctggattttgacctctgcgaagggaccacagtggtcgtggatgagcactgcggaaaccggggccccagcctgagaaccacaaccgttacgggcaagatcatccacgaatggtgttgccggtcctgtacactgcctccccttcgcttcagaggggaggacggatgctggtatggcatggagattcggccggtgaaagaaaaggaggaaaatctcgtcaagagcatggtgtctgctgggtccggagaggttgacagcttttccctgggcctgctctgtatctctattatgatcgaagaggtgatgagaagccgctggtcccggaaaatgctgatgaccgggacacttgccgtcttctttctgctcattatgggacagctgacctggaacgatctgatcagactttgcattatggtgggcgccaatgcttctgaccgcatgggcatggggaccacatacctggccctcatggcgacgttcaagatgagacctatgtttgctgttggactgctgttccggcgcctgaccagcagagaggtgcttctgctcacaatcggcctgtccctggtcgcctctgtggaacttcccaacagcctggaggaactcggggatggactggccatgggcatcatgattctcaaactgcttaccgactttcaatcccatcagctgtgggctacactcctgagcctgaccttcatcaagacgacattttctcttcactatgcctggaaaaccatggctatggtgctgtccattgtcagcctcttccccctgtgtctctctaccacatcccagaagaccacatggctgcctgttcttctggggagcctgggatgcaagccgctcacgatgtttctgatcgccgagaataaaatttggggccggcgctcttggccccttaacgaaggcatcatggcggtggggatcgtgtccattctgctcagctccctgctcaagaacgatgtccctctggccggaccccttatcgctggcgggatgctgattgcctgttacgtgatcagcggatctagcgctgacctgtccctcgagaaagccgccgaggtttcttgggaagaggaagctgagcatagcggcgcgtcccacaatattctggtggaagtccaggatgacgggaccatgaagatcaaagatgaggagagagacgatacacttaccatcctgctcaaggccacactgctcgctgtgtctggagtttatcctctgagcattcccgccacccttttcgtgtggtacttctggcagaagaagaagcagcggtccggcgtcctgtgggacacgccttctcccccggaagtggagcgcgccgtcctggatgacggcatctatagaattatgcagcgggggctcctgggacgcagccaggtgggcgttggggtgtttcaagaaaacgtcttccataccatgtggcacgtgacaagaggagctgttcttatgtaccagggcaaacggctggagccttcctgggccagcgtgaagaaagacctcatctcttacgggggaggctggagactgcagggctcctggaataccggggaggaagtccaggtgattgcggtggagcccggaaagaaccctaaaaatgttcaaacagctcccggcacctttaagacaccggaaggggaggtcggagccatcgccctcgatttcaagcctggcacgagcgggtctcccattgtgaaccgcgaaggaaaaatcgtgggcctgtatggcaatggggtcgtgaccacatccggaacctacgttagcgctatcgcccaggcgaaggcttcccaggagggccctcttcccgagattgaagacgaggtgtttcggaaaagaaacctgaccatcatggatctgcaccccgggtctggaaagacacgccggtatctccctgccattgtcagagaagccatcaaacgcaagctgcggacgcttattctggctccgaccagagtggttgccagcgagatggctgaagccctcaagggcatgcccatccgctaccaaacaaccgcggtgaaatccgagcatacagggaaggagatcgtcgacctgatgtgccacgccaccttcacgatgcggctgctcagccctgtgagagttcccaattataacatgattatcatggatgaagctcattttacagacccttcttccattgccgctcggggctacatcagcacccgcgtgggaatgggcgaggccgccgctattttcatgaccgcgacaccccctgggtctgtcgaagcctttccgcagagcaatgctgtgatccaggatgaggaaagagacatccccgagcggtcctggaactctggatatgagtggattaccgatttccctggcaaaacagtgtggtttgtccccagcatcaagtccgggaatgacattgccaactgtcttcgcaaaaatggaaagagagttatccagctgtctcggaagaccttcgatacggaataccagaagaccaagaacaacgactgggactacgtggtgaccacagatattagcgagatgggcgccaatttcagagctgaccgcgtcatcgatcctcggagatgcctgaaacccgtgattctcaaggacgggccggaacgcgttatcctggccggccctatgcccgtgaccgtcgcgtccgctgcccagcggagaggacgcatcggccggaaccacaataaagagggggatcagtatatttacatgggacagccccttaacaatgacgaggatcatgcccactggacggaagctaagatgctgctcgacaacatcaatacccctgagggcattatccccgccctgtttgaacctgagagagaaaagagcgcggccattgatggggagtatcgcctgagaggagaggctcggaaaacattcgtggaactcatgcgcagaggcgaccttccggtttggctgtcttacaaggtggcctccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgctcggacatactccgaccctcttgccctgagagagtttaaggagttcgctgccggccgccggtctgtcagcggggatctcatcctggagattggaaaactgccccagcacctcacccagagagcgcaaaatgcccttgacaacctggtgatgctgcataattccgaacagggcgggcgggcttatcgccacgccatggaggagctccctgatacaatcgaaaccctgatgcttctggctctcattgccgttctgacgggaggcgtgacactgtttttcctctctggcagagggcttggaaagaccagcatcggcctgctgtgtgtgatggcctccagcgtcctcctgtggatggcttctgttgagccccattggattgcggcctccatcatccttgaatttttcctgatggtgctcctgattccggagcctgaccggcagcgcacaccccaggataaccaactggcttacgtggtcatcgggctcctttttatgattctgacagtggccgccaatgagatgggactgctcgaaaccacaaagaaagacctgggcatcgggcacgttgctgtggagaaccaccatcacgccgcgatgcttgatgtcgacctgcatcctgccagcgcttggacgctctacgccgtggctaccacaattatcacccccatgatgagacacacaattgaaaacaccacggccaatatctctctgaccgcgatcgccaaccaggctgccattctgatgggactcgataagggctggcctatctccaaaatggacattggcgtcccccttctggctctggggtgctatagccaggtgaatccgctcacactgaccgccgctgttcttatgctggtggcccattacgcgatcattggacctggcctccaagccaaggctacacgggaggcccagaaacgcaccgctgccgggatcatgaagaaccccacggtcgatggaatcgtggccattgacctggatcccgttgtgtatgacgcgaagttcgaaaaacagctgggccagatcatgctccttattctgtgtacatctcaaatcctgctcatgagaaccacatgggctctgtgcgagagcattacccttgccaccgggcctctgacaacgctctgggagggatccccgggcaagttttggaataccacaatcgctgtctctatggccaacatcttccggggcagctacctggccggggctggactggccttctccctcatgaaaagccttggcgggggacgcagaggcaccggggcgcagggagaaacactgggcgagaagtggaaacggcagctgaatcagctctccaagtctgaatttaacacctataagagaagcggcattatggaggtggaccgctccgaagccaaagaggggctgaagcggggagagacgacaaaacacgctgtgtctagaggcaccgccaaacttcgctggttcgttgaacggaatctggtcaaacccgaggggaaggtgatcgatctcggatgtggcagagggggatggagctactattgcgctggcctgaagaaagtgaccgaagtcaagggctacacaaaagggggacctggccacgaggaacccattcctatggccacctacgggtggaacctggttaagctccattccggaaaagacgtgtttttcattccccctgagaagtgtgatacacttctgtgcgacatcggcgagtctagcccgaatcccacgatcgaagaggggcgcaccctgcgggtgctcaaaatggtcgaaccttggctgagaggaaaccaattttgtattaagatccttaatccctatatgccttccgtggttgagacactggagcagatgcagcgcaagcacggcggcatgctcgtgcggaaccccctgagcagaaattctacccatgaaatgtactgggtctcctgcgggacaggaaacatcgtgagcgcggttaatatgacctctcgcatgctgctcaaccggttcacgatggcccacagaaaaccgacctatgagcgcgatgtggacctgggcgctgggacaagacacgtcgccgtggaacctgaggtggctaaccttgatattatcggacagcggattgaaaatatcaagcatgagcacaaatccacctggcattacgacgaggataacccctataagacatgggcctaccacggcagctatgaagtcaaaccctctgggtccgctagctccatggttaatggagtggtgaagctgctcaccaagccttgggacgtcattcccatggtgacacaaatcgccatgaccgatacgacaccttttggccagcagcgcgttttcaaagagaaggtggacaccagaaccccgaaagcgaagcggggcacagcccaaatcatggaagtcacggctaaatggctgtgggggtttcttagcagaaacaagaagccccggatttgtacccgcgaggagttcacaagaaaagtgcggtctaatgccgctatcggagccgtttttgtggacgagaaccagtggaatagcgccaaggaggcggtcgaagatgagcgcttctgggacctggtgcatagagaacgggagctccacaaacagggcaagtgcgctacctgcgtttacaacatgatggggaaacgcgaaaagaagctgggagagtttggcaaagccaaggggtccagagccatttggtacatgtggctgggcgctcggttcctcgagttcgaagccctgggatttatgaatgaggatcactggttctctcgcgaaaacagcctttccggcgtggagggggagggactgcataaactcggctatatcctgagagacatttctaagatccctgggggaaatatgtacgctgatgacacagccggctgggatacccggatcacagaagacgatcttcagaacgaggcgcgcattaccgacatcatggaacccgagcacgccctgctcgctaaaagcatttttaagctgacgtatcaaaataaagtcgtgagagtccagcggcctgccaagaacgggaccgtgatggatgttatctcccgcagagaccagcggggctctggacaggtgggcacatacgggctgaataccttcacaaacatggaagctcaactcattagacagatggagagcgagggaatcttttcccccagcgaactggagaccccgaaccttgccgaacgcgtcctggattggctcgagaagtatggcgtggaacggctgaaaagaatggcgatctctggggacgactgtgtggttaagcctattgatgaccgcttcgccacggctcttacagccctgaatgatatgggaaaagtgcggaaggacatcccccagtgggagccttccaaaggctggaacgattggcagcaagtccccttttgcagccatcacttccaccagctcattatgaaggacgggagagagatcgtggttccttgtcgcaatcaggatgaactggtgggccgggctagagtctctcagggagccggctggtccctgcgcgagaccgcttgcctcggaaagagctacgcccaaatgtggcagctgatgtattttcatcggagagaccttcgcctggcggccaacgctatttgttccgccgtgcccgtcgattggatcccgacatctcggaccacgtggagcattcacgcccatcaccagtggatgaccacagaagacatgctctccgtgtggaatagagtttggatcgaggaaaacccttggatggaggataaaacccatatcagctcttggggagacgtgccctacctgggcaagcgggaggaccaatggtgcgggtcccttattggactgacagctagagccacctgggcgacaaatatccaggtcgctattaaccaggtgcgccggctcatcggcaatgaaaactacctggattatatgaccagcatgaaaagattcaagaatgagtctgaccccgaaggggccctgtggtga

SEQ ID NO: 18908 - RNA, 9879 nt, synthetic construct
  misc_feature 1..9879: note = derived and/or modified CDS sequence (opt5) from DENV-1__FJ410207__SS-prME
  source 1..9879: mol_type = other RNA
tccgtgaccatgctgctcatgctgatgcccacagcccttgctttccacctgacgacccggggcggggaacctcatatgatcgtgtccaagcaggaacggggaaaatctctcctgtttaagaccagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttatggtgatcgccctgttccttgcgcatgccattgggacctctatcacacagaagggaatcatttttatcctgctcatgctggtcacccctagcatggctatgagatgcgtgggcattgggtcccgggatttcgttgagggacttagcggcgccacctgggtggacgtcgtgctggagcacgggtcttgtgtgacaacgatggctaaggataaacccaccctcgacatcgaactgctgaagacagaggtcaccaaccctgccgttctccgcaaactgtgcattgaagcgaagatctccaatacaaccacggatagcagatgtccgacacaaggagaggccacccttgtggaagaacaggacgctaactttgtgtgccggcgcaccttcgtcgatagaggctggggcaatgggtgtggactgtttggcaaagggtctctcattacatgcgccaagttcaagtgcgtgaccaaactggagggaaagacagttcagtacgaaaaccttaaatattccgtgatcgtcacggtgcacaccggcgaccagcatcaagttgggaatgagagcacagaacacggaaccacagctaccatcacgccccaggccccttctaccgagattcagctgacagactacggcgccctcaccctggattgtagcccgcggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaatccaaaccagcggaacaaccacaattttcgctggccatctgaagtgcagactcaaaatggataagctgacccttaaagggatgtcttatgtgatgtgtacgggctccttcaagctggagaaggaagtcgccgagacacagcacggaaccgtgctcgttcagatcaaatacgagggcaccgacgcgccgtgcaagattccttttagcacacaggatgaaaaaggggtgacccaaaacggacggctgatcacagctaatcccatcgtcacggacaaggagaaactggtgaacattgaagccgagcctcccttcggcgagtcttatatcgtgattggggccggagaaaaggctcttaagctcagctggtttaaaaagggctcctctatcgggaaaatgttcgaggccaccgctagaggcgcccgccggatggcgattctgggagatacagcctgggactttggcagcatcgggggagttttcacctccgtcggcaagctggtgcatcagatctttgggacagcttacggagtcctgttcagcggcgtctcttggaccatgaaaattgggatcggcgtgctgcttacgtggctgggactcaattccagaagcacctctctgtccatgacatgtattgccgttggcctggtgaccctttacctcggggtcatggtgcaggctgatagcggatgcgttatcaactggaagggccgcgaactgaagtgtgggtccggaatttttgtgacaaatgaggtccacacctggacagaacagtataaattccaagccgactctcccaagcggctgagcgcggccatcggcaaggcttgggaggagggggtgtgcggcattagatccgccacccgcctcgaaaacatcatgtggaagcagatctctaacgagctgaatcatattcttctggaaaacgacatgaaatttacggttgtggtcggagatgtggctggcatcctcgcccaggggaagaaaatgattcggcctcagccgatggagtacaagtatagctggaagtcctggggaaaagccaagatcattggcgctgacgtgcaaaatacaaccttcatcatcgatgggcccaacacccctgaatgtcccgacgatcagagagcgtggaatatttgggaggtcgaggactacggatttggcatcttcacaaccaacatttggctgaaactgcgcgatagctatacgcaggtttgcgaccaccggcttatgtctgccgctatcaaggattccaaagccgtgcacgccgacatgggctactggattgaaagcgagaagaatgaaacatggaagctcgctagagcctctttcatcgaggtgaaaacctgtatctggcctaagtcccatacactgtggagcaacggggtcctggaatctgagatgattatccccaaaatttatggaggcccgatcagccagcacaattaccgccctgggtactttacccaaacagcgggaccctggcatctcggcaagctggagcttgatttcgacctgtgcgaagggaccacggtggttgtggatgagcactgcggaaaccggggcccttccctcagaaccacaaccgtcacaggcaaaattatccacgaatggtgttgccggagctgtaccctgccccctctgcgctttaagggggaggacggatgctggtatggcatggagatcagacccgtgaaggaaaaagaggaaaatcttgttaagtctatggtgtccgctgggagcggagaggtcgactccttctctctcggcctgctgtgtattagcatcatgattgaagaggtgatgcggtccagatggtctcgcaaaatgctcatgacggggacactggccgtctttttccttctgatcatgggacagctcacctggaacgatctgattcggctgtgcatcatggtgggcgccaatgctagcgacagaatgggcatggggacaacctaccttgccctgatggcgacctttaagatgcgcccgatgttcgctgtcggactcctgtttagacggctcacatcccgcgaggtgctgcttctgacgattggcctctctctggtggccagcgtcgaactgcctaactcccttgaggaactgggggatggactcgccatgggcatcatgatcctgaaactcctgaccgacttccagagccatcaactttgggctacactgctctctctgacctttattaagacaaccttctccctgcactatgcctggaagacgatggctatggttcttagcatcgtgtctctgtttcccctctgtctgtccacaaccagccagaaaaccacatggctccccgtgctgcttgggtctctgggatgcaagcctctgaccatgttcctcattgccgagaatagaatctggggccggaaatcctggccgctgaacgaaggcattatggcggtcgggatcgtgagcatccttctgtccagcctcctgaagaacgatgttcccctcgccggacctctgattgctggcgggatgcttatcgcctgttacgtgatttctggaagctccgctgacctgtctctggagaaagccgccgaggtcagctgggaagaggaagctgagcattccggcgcgtctcacaatatcctcgtggaagttcaggatgacgggacaatgaagattaaagatgaggagcgcgacgatacgctgaccatccttctgaaggccacactcctggctgtgagcggagtctatcccctctccatccctgccaccctgttcgtgtggtacttttggcagaagaaaaagcaaagatctggcgtcctttgggacacacccagccctcccgaagtggagcgggccgttctggatgacggcatttatcgcatcatgcagagagggctgctcggacggtcccaggtgggcgtcggggtgttccaggaaaacgtttttcataccatgtggcacgtgacgcgcggagctgtcctgatgtaccaaggcaaaagacttgagccgagctgggcctctgtgaagaaagacctgatttcctacgggggaggctggcggctccagggcagctggaataccggggaggaagtgcaggttatcgcggtcgagcctggaaagaaccccaagaatgtgcagacagctcctggcaccttcaaaacatctgaaggggaggtgggagccattgccctggattttaagcccggcacctccgggagcccgatcgtcaacagagaaggaaaaattgtgggcctctatggcaatggggttgtgacaacgtccggaacctacgtctctgctatcgcccaagcgaaggctagccaggagggccctctgcccgagatcgaagacgaggtgttccgcaaacggaaccttacaattatggatctgcaccctgggtccggaaagaccagacgctatctgcccgccatcgttcgggaagccattaagagaaaactccgcaccctgatccttgctcccacacgggtggtcgccagcgagatggctgaagccctgaagggcatgcctattagataccagacgaccgcggtgaaatctgagcatacagggaaggagatcgttgacctcatgtgccacgccacctttacaatgcgcctgctgtccccggtgcgggtccccaattataacatgatcattatggatgaagctcatttcaccgaccctagctctatcgccgctagaggctacattagcacgcgggtgggaatgggcgaggccgccgctatctttatgacagcgacaccccctgggtccgtggaagccttcccccaatctaatgctgtcattcaggatgaggaacgcgacatccctgagagaagctggaactccggatatgagtggatcaccgattttccgggcaaaacagtttggttcgtgccctctattaagagcgggaatgacatcgccaactgtctccggaagaatggaaaacgcgtgattcagctttccagaaagaccttcgatacagaataccagaaaaccaagaacaacgactgggactacgtcgtgacgacagatatcagcgagatgggcgccaattttcgggctgacagagttattgatcctcgccggtgcctgaaacccgtgatcctgaaggacgggcctgaaagagtcattctcgccggccccatgccggtgaccgttgcgtctgctgcccaacgccggggaagaatcggccgcaaccacaataaggagggggatcagtatatctacatgggacagcctctgaacaatgacgaggatcatgcccactggacagaagctaaaatgcttctggacaacattaatacccccgagggcatcattcccgccctcttcgaacctgagcgggaaaagtccgcggccatcgatggggagtatagactgcgcggagaggctagaaaaacgtttgtggaactgatgcggcgcggcgacctccccgtctggcttagctacaaggtggcctccgaggggttccagtattctgatagacggtggtgctttgacggcgaacgcaacaatcaagtcctggaggaaaacatggatgtggagatttggaccaaagagggagaaagaaagaaactgcggcctagatggctcgacgctcgcacatacagcgacccgctggcccttcgggagttcaaggaatttgctgccggcagacgctccgtttctggggatctgatcctcgagatcggaaagctgccccagcacctgacccagcgggcgcagaatgccctcgacaaccttgtgatgctgcataatagcgaacaaggcgggagagcttatcggcacgccatggaggagctgcctgatacaattgaaaccctcatgctgcttgctctgatcgccgtgctcacaggaggcgtcaccctgttctttctgtccggccgcgggctcggaaaaacgagcattggccttctgtgtgttatggcctcttccgtgctgctctggatggctagcgtggagccccattggatcgcggcctctattatcctggagttctttcttatggtcctgctcatccctgagcccgacagacagcggacaccgcaggataaccagctggcttacgtggttattgggctcctcttcatgatccttaccgtggccgccaatgagatgggactgctggaaaccacaaagaaagacctcggcattgggcacgtcgctgtggagaaccaccatcacgccgcgatgctggatgtcgaccttcatcctgcctccgcttggaccctgtacgccgtggctacaacgatcattacccccatgatgcgccacacaatcgaaaacaccacagccaatattagcctcaccgcgatcgccaaccaagctgccatcctgatgggactggataagggctggcctatttctaaaatggacatcggcgttcccctccttgctctggggtgctatagccaggtgaatcctctgacgctcaccgccgctgtcctgatgcttgtggcccattacgcgattatcggacccggcctgcaggccaaggctacaagagaggcccaaaagcggaccgctgccgggattatgaaaaacccgacagttgatggaatcgtggccatcgacctcgatcctgtcgtgtatgacgcgaagtttgaaaaacagctgggccagattatgctgctcatcctttgtacctcccagattctgctgatgcgcacgacatgggctctctgcgagtctatcaccctggccacagggccccttaccaccctgtgggagggaagccccggcaagttctggaatacaacgattgctgtgtccatggccaacatcttcagaggcagctacctcgccggggctggactggccttttccctgatgaaatctctcggcgggggacggcgcggcaccggggcgcaaggagaaacacttggcgagaagtggaagagacagctgaatcagctgagcaaatccgagttcaacacctataagcggtctggcatcatggaggttgacagaagcgaagccaaagaggggctcaagcgcggagagacaaccaaacacgctgtctcccggggcacggccaagctgagatggtttgtggaacgcaatcttgtgaagcctgaggggaaagtcattgatctgggatgtggcagagggggatggtcttactattgcgctggcctcaagaaagttacagaagtgaagggctacaccaaagggggaccgggccacgaggaacccatccctatggccacctacgggtggaacctggtgaagctgcatagcggaaaagacgtcttctttacaccccctgagaagtgtgataccctcctttgcgacattggcgagtccagccccaatcctacaatcgaagaggggagaacgctgcgcgtgctgaagatggttgaaccgtggctccggggaaaccagttctgtattaaaatcctgaatccctatatgccttctgtggtcgagacccttgagcaaatgcagagaaagcacggcggcatgctggtgcgcaaccccctctcccggaatagcacacatgaaatgtactgggtttcttgcgggaccggaaacattgtgtccgcggtcaatatgacaagcagaatgctgctgaaccgctttaccatggcccaccggaaacctacgtatgagagagatgtggacctcggcgctgggacccgccacgtggccgtcgaacccgaggttgctaacctggatatcatcggacagagaattgaaaatatcaagcatgagcacaaatctacatggcattacgacgaggataacccgtataagacctgggcctaccacggctcctatgaagtgaagcctagcgggtccgctagctctatggtgaatggagtcgtgaaacttctgacaaagccctgggacgttattcccatggtgacccagatcgccatgacagataccacgcctttcggccaacagcgggtctttaaagagaaggtggacacacgcacccccaaagcgaagagaggcaccgcccagattatggaagttacagctaagtggctctgggggttcctgagccggaacaaaaagcctagaatctgtacgcgggaggaatttacccgcaaagtgagatccaatgccgctatcggagccgtcttcgtggacgagaaccaatggaactctgccaaggaggcggttgaagatgagcggttttgggaccttgtgcatcgcgaaagagagctgcacaaacagggcaagtgcgctacatgcgtctacaacatgatggggaagcgggagaagaaactcggagagttcggcaaagccaaagggagccgcgccatttggtacatgtggctgggcgctagattcctggagtttgaagccctcggattcatgaatgaggatcactggttttcccgggaaaactctctgagcggcgtggagggggagggacttcataaactgggctatatcctccgcgacatttccaagatccccgggggaaatatgtacgctgatgacaccgccggctgggatacaagaattaccgaagacgatctgcagaacgaggcgaaaatcacagacatcatggaacccgagcacgcccttctggctaagtctattttcaagctcacctatcagaataaagtcgtgcgggttcaacgccctgccaagaacgggacggtgatggatgtcatcagcagacgggaccagcgcggctccggacaggtgggcacctacgggctgaatacatttaccaacatggaagctcagctgattagacaaatggagagcgagggaatcttctctccctccgaactcgagacacctaacctggccggccgggtgcttgattggctggaaaaacatggggttgagagactcaagcgcatggcgattagcggagacgactgtgtggtcaaacccatcgatgaccggtttgccaccgctctgacggcccttaatgatatgggcaaggtgagaaaggacatcccgcagtgggaaccttctaaagggtggaacgattggcagcaggttcccttctgctcccaccactttcatcaactgattatgaaggacggccgcgagatcgtggtcccttgtcggaatcaggatgagctcgtgggcagagctcgcgtcagccagggagccgggtggtccctgcgggaaacagcttgcctgggaaaatcttatgcccagatgtggcaactcatgtacttccacagacgcgacctgcggcttgcggccaacgctatttgtagcgccgtgcccgttgattgggtgcctacctccagaacaacctggagcatccatgcccaccatcagtggatgacgaccgaggacatgctgtctgtctggaatcgcgtgtggattgaagagaacccctggatggaagataagacacacatctccagctggggcgacgttccgtatctcgggaaacgggaggaccagtggtgcggatctctgattggccttaccgctagagccacatgggcgaccaatatccaagtggctatcaaccaggtccggagactgattgggaatgagaactacctcgattacatgacaagcatgaagcgctttaagaatgaatccgaccctgagggcgccctgtggtga

SEQ ID NO: 18909 - RNA, 9879 nt, synthetic construct
  misc_feature 1..9879: note = derived and/or modified CDS sequence (opt5) from DENV-1__FJ432744__SS-prME
  source 1..9879: mol_type = other RNA
agcgtgaccatgctgctgatgctgatgcccacagcccttgctttccacctgacgacccggggcggggaacctcatatgatcgtctccaagcaggaacggggaaagtctctcctgtttaagacaagcgccggcgttaacatgtgcacccttattgccatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttaaagggatgagctatgtgatgtgtacaggctctttcaagctggagaaggaagtcgcggagacccagcacggaaccgtgctcgttcagatcaaatacgagggcacagacgctccgtgcaagattcctttttccacccaggatgaaaaaggggtgacacaaaacggacggctgatcacggccaatcccatcgtcaccgacaaggagaaacctgtgaacattgaagccgagccgcccttcggcgagagctatatcgtgattggggctggagaaaaggccctgaaactttcttggtttaaaaagggcagctccatcgggaaaatgttcgaggctacagccagaggcgcgcgccggatggccattctcggagataccgcttgggactttggctctatcgggggagttttcacaagcgtcggcaagctggtgcatcagatctttgggaccgcctacggagtgctgttctccggcgtcagctggacgatgaaaattgggatcggcgtgctcctgacctggcttggactcaattctagatccacaagcctctctatgacctgtattgctgttggcctggtgacactgtaccttggggtcatggtgcaggccgattccggatgcgttatcaactggaagggccgcgaactcaagtgtgggagcggaatttttgtgaccaatgaggtccacacatggaccgaacagtataaattccaagcggactcccctaagcggctgtctgccgctatcggcaaagcctgggaggagggggtgtgcggcattagaagcgctacgcgcctggaaaacatcatgtggaagcagatctccaacgagctcaatcatattctgcttgaaaacgacatgaaatttacagttgtggtcggagatgtggccggcatcctggcccaggggaagaaaatgattcggccgcagcccatggagtacaagtattcttggaaaagctggggaaaggctaagatcattggcgcggacgtgcaaaatgccaccttcatcatcgatgggcctaacacccccgaatgtcctgacgatcagagagcttggaatatttgggaggtcgaggactacggatttggcatcttcacaaccaacatttggctcaaactgcgcgattcctatacgcaggtttgcgaccaccggctgatgagcgccgccatcaaggattctaaagctgtgcacgccgacatgggctactggattgaatccgagaagaatgaaacatggaaacttgcgagagctagcttcatcgaggtgaaaacctgtatctggcccaagtctcatacactctggtccaacggggtcctggaaagcgagatgattatcccgaaaatttatggaggccctatctctcagcacaattaccgccccgggtactttacccaaacagccggaccttggcatctgggcaagctcgagctggatttcgacctttgcgaagggaccacggtggttgtggatgagcactgcggaaaccggggccccagcctgagaaccacaaccgtcacaggcaaaattatccacgaatggtgttgccggtcctgtaccctccctcccctgcgctttaagggggaggacggatgctggtatggcatggagatcagaccggtgaaggaaaaagaggaaaatctggttaagagcatggtgtctgccgggtccggagaggtcgacagcttctcccttggcctcctgtgtatttctatcatgattgaagaggtgatgcggagcagatggtcccgcaaaatgctgatgacggggatcctcgctgtctttttcctgcttattatgggacagctgacatggaacgatctcatccggctgtgcattatggtgggcgccaatgcgtctgacagaatgggcatggggaccacatacctggctcttatggccacctttaagatgcgccctatgttcgccgtcggactgctctttagacggctgaccagccgcgaggtgctcctgcttacaatcggcctgtccctcgtggcttctgtcgaactgcccaacagcctggaggaacttggggatggactggccatgggcatcatgattctcaaactgctcacggacttccagtcccatcaactgtgggctacccttctgagcctcacatttatcaagaccacattctctctgcactatgcctggaagaccatggcgatggttctgtccattgtgagcctttttcccctgtgtctctctacgacatcccagaaaaccacctggctgcctgtgctcctggggagccttggatgcaagccgctgacaatgttcctgatcgccgagaataaaatttggggcagaaagtcttggcccctcaacgaaggcatcatggctgtcgggatcgtgtccattctgcttagctccctgctcaaaaacgatgttcctctggccggacccctcatcgctggcgggatgctgattgcctgttacgtgatcagcggatctagcgccgacctttccctggagaaggctgcggaggtctcttgggaagaggaagccgagcatagcggcgcttcccacaatattctggtggaagttcaggatgacgggaccatgaaaatcaaggatgaggagcgggacgatacactcacgatcctgcttaaggccaccctgctcgccgtgtctggagtctatcctctgagcattcccgctacactcttcgtgtggtacttttggcagaaaaagaaacgcagatccggcgtcctgtgggacaccccttctcccccggaagtggagcgggccgttcttgatgacggcatctatcgcattatgcaaagagggctgctgggacggagccaggtgggcgtcggggtgttccaggaaaacgtttttcatacaatgtggcacgtgacccgcggagcggtcctcatgtaccagggcaagagactggagccttcctgggctagcgtgaaaaaggaccttatctcttacgggggaggctggcggctgcaaggctcctggaatacgggggaggaagtgcaggttattgccgtcgagcccggaaagaaccctaaaaatgtgcagaccgcccccggcacattcaagaccagcgaaggggaggtgggagctatcgccctcgattttaaaccgggcacatctgggtcccctattgtcaacagagaaggaaagatcgtgggcctgtatggcaatggggttgtgaccacaagcggaacgtacgtctccgcgatcgctcaggccaaagcctctcaagagggccccctccctgagattgaagacgaggtgttccgcaagcggaacctgaccatcatggatcttcaccccgggagcggaaagacaagacgctatctgcccgctattgttcgggaagccatcaaaagaaagctgcgcaccctcattctggctcctacccgggtggtcgcctccgagatggcggaagcccttaaaggcatgccgatcagataccagacaacggctgtgaagtccgagcataccgggaaagagatcgttgacctgatgtgccacgccacatttaccatgcgcctcctgtctcccgtgcgggtccctaattataacatgattatcatggatgaagctcatttcacagacccctccagcattgccgccagaggctacatctctacccgggtgggaatgggcgaggctgcggccatttttatgacggctacacctcccgggagcgtggaagccttccctcagtccaatgccgtcatccaagatgaggaacgcgacatcccggagagatcttggaacagcggatatgagtggattaccgattttcccggcaagaccgtttggttcgtgccttccatcaagtctgggaatgacattgctaactgtctgcggaaaaatggaaagcgcgtgatccagctcagcagaaaaacattcgataccgaataccagaagaccaagaataacgactgggactacgtcgtgaccacggatatttccgagatgggcgccaattttcgggcggacagagttatcgatccccgccggtgccttaagcctgtgattctgaaggacgggcccgaaagagtcatcctggctggcccgatgcctgtgacagttgccagcgccgctcagcgccggggaagaatcggccgcaaccacaataaagagggggatcaatatatttacatgggacagcccctcaacaatgacgaggatcatgcccactggaccgaagcgaagatgctgcttgacaacatcaatacacccgagggcattatccctgccctgttcgaacccgagcgggaaaaatctgctgccattgatggggagtatagactccgcggagaggctagaaagacctttgtggaactgatgcggcgcggcgacctgcctgtctggctctcctacaaagtggccagcgaggggttccagtattccgatagacggtggtgctttgacggcgaacgcaacaatcaggtccttgaggaaaacatggatgtggagatctggacgaaggagggagaacgcaagaagctgcggccgagatggctggacgctcgcacctactctgaccccctcgccctgcgggagttcaaggaatttgcggccggcagacgcagcgtttccggggatcttatcctggagattggaaaactccctcaacacctgacacagcgggctcagaatgccctggacaacctcgtgatgcttcataattctgaacagggcgggagagcttatcggcacgccatggaggagctgcccgataccatcgaaacactgatgctcctggcccttattgctgtgctgaccggaggcgtcacactcttctttctgagcggccgcgggctgggaaagacctccatcggcctcctttgtgttatggcgagctctgtgctgctgtggatggcctccgtggagcctcattggattgctgccagcatcatcctcgagttctttctgatggtccttctgattcccgagccggacagacaacggacgcctcaggataaccagctcgcctacgtggttatcgggctgctgttcatgattctcacagtggctgccaatgagatgggacttctggaaaccaccaaaaaggacctgggcatcgggcacgtcgcggtggagaaccaccatcacgccgctatgctcgatgtcgacctgcatcccgcctctgcttggacactttacgccgtggcgaccacaattatcacgcctatgatgcgccacaccattgaaaacacaaccgccaatatctccctgacagctatcgccaaccaggctgccattctcatgggactggataaaggctggcccatcagcaagatggacattggcgttcctctgctcgctcttgggtgctattctcaagtgaatcccctgaccctgacggccgcggtcctcatgctggtggcccattacgctatcattggaccgggccttcaggccaaggctaccagagaggcccagaaacggacagccgcggggatcatgaagaaccctaccgttgatggaatcgtggctattgacctggatcccgtcgtgtatgacacaaaatttgaaaagcaactcggccagatcatgctgctgattctctgtaccagccagatccttctgatgcgcacgacatgggccctgtgcgagtccattaccctcgctacagggcccctgaccaccctttgggagggatctcctggcaaattctggaatacaacgatcgccgtgagcatggccaacatcttcagaggctcctacctggctggggccggactcgcgtttagcctgatgaagtccctgggcgggggacggcgcggcaccggggcccagggagaaacactcggcgagaagtggaaaagacaacttaatcagctgtctaagagcgagttcaacacctataaacggtccggcattatggaggttgacagatctgaagctaaggaggggctgaaacgcggagagacaaccaagcacgccgtcagccggggcacggctaagctcagatggtttgtggaacgcaatctggtgaaaccggaggggaaggtcatcgatcttggatgtggcagagggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggagaacacttcgcgtgctgaaaatggttgaaccctggctgcggggaaaccagttctgtattaagatcctcaatccttatatgcccagcgtggtcgagacgctggagcagatgcaaagaaaacacggcggcatgcttgtgcgcaaccctctgtctagaaattccacccatgaaatgtactgggttagctgcgggacaggaaacatcgtgtctgccgtcaatatgacctccagaatgctcctgaaccgctttacaatggctcaccggaagcccacctatgagagagatgtggacctgggcgccgggacgcgccacgtggctgtcgaaccggaggttgccaacctcgatattatcggacagagaattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccagcaacgggtctttaaggagaaagtggacacgcgcacacctaaggccaagagaggcaccgctcagatcatggaagttaccgccaaatggctgtgggggttcctctctcggaacaagaaaccgagaatttgtacacgggaggaatttacgcgcaaggtgagaagcaatgctgccatcggagccgtcttcgtggacgagaaccagtggaactccgcgaaagaggctgttgaagatgagcggttttgggacctggtgcatcgcgaaagagagcttcacaagcaaggcaagtgcgcgacctgcgtctacaacatgatggggaaacgggaaaagaaactgggagagttcggcaaggccaaagggtctcgcgctatttggtacatgtggctcggcgccagattcctggagtttgaagctctgggattcatgaatgaggatcactggtttagccgggaaaactccctctctggcgtggagggggagggactgcataaacttggctatatcctgcgcgacattagcaaaatccccgggggaaatatgtacgccgatgacacagcgggctgggataccagaatcacagaagacgatctccagaacgaggccaagattaccgacatcatggaacctgagcacgctctgcttgccaagtccattttcaaactgacatatcagaataaggtcgtgcgggttcagcgccccgctaaaaacgggaccgtgatggatgtcatctctagacgggaccaacgcggcagcggacaggtgggcacgtacgggctcaatacctttacaaacatggaagcccagctgattagacagatggagtccgagggaatcttcagcccttctgaactggagacccccaacctcgcgggccgggtgctggattggcttgaaaagcatggggttgagagactgaaacgcatggccatctccggagacgactgtgtggtcaagccgattgatgaccggtttgctacagccctcaccgctctgaatgatatgggcaaggtgagaaaagacatccctcaatgggaacccagcaaggggtggaacgattggcagcaggttcctttctgctctcaccactttcatcagcttattatgaaagacggccgcgagatcgtggtcccctgtcggaatcaagatgagctggtgggacgggcccgcgtctcccagggcgctgggtggagcctccgggaaacggcctgcctgggaaagtcctatgcgcagatgtggcagctgatgtacttccacagacgcgacctccggctggccgctaacgccatttgttctgccgtgcctgttgattgggtgcccacaagcagaaccacatggtccatccatgctcaccatcaatggatgaccacggaggacatgcttagcgtctggaatcgcgtgtggattgaagagaacccgtggatggaagataaaacccacatctcttcctggggcgacgttccttatctggggaagcgggaggaccagtggtgcggaagcctcatcggcctgacagccagagcgacctgggctacaaatattcaggtggccatcaaccaagtccggagacttattgggaatgagaactacctggattacatgacctctatgaagcgctttaaaaatgaaatcgaccccgagggcgccctctggtga

SEQ ID NO: 18910 - RNA, 9879 nt, synthetic construct
  misc_feature 1..9879: note = derived and/or modified CDS sequence (opt5) from DENV-1__FJ547060__SS-prME
  source 1..9879: mol_type = other RNA
agcgtgaccatgctgctcatgctgatgcccaccgcccttgctttccacctgacgacccggggcggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtaccctcttagcatccccgctacactgttcgtctggtatttttggcaaaagaaaaagcagcgctccggcgtgctgtgggacaccccttctcccccggaagttgagagagccgtgctcgatgacggcatttaccggatcatgcagcgcgggctgcttggaagaagccaggtcggcgtgggggttttccaagaaaacgtgttccacacgatgtggcacgtcacccggggagccgtgctgatgtatcagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacatttaaaaccccggaaggggaggtcggagctattgccctggatttcaagcctggcacaagcgggtctcccatcgtgaaccgggaaggaaaaattgttggcctttacggcaatggggtggtcacgacctccggaacatatgtgagcgccatcgctcagaccaaggcctcccaggagggccctctgcccgagatcgaagacgaggtttttagaaaacgcaacctgaccattatggatctccatcccgggtctggaaagacacggagatacctgcctgcgatcgtgcgcgaagctattaagcggaaacttagaacgctgatcctcgccccgacccgcgtcgtggccagcgagatggctgaagccctgaagggcatgcccattcggtatcaaacaaccgctgttaaatccgagcacacagggaaggagatcgtggacctgatgtgccatgccaccttcacgatgagactccttagccctgtccgcgtgcccaattacaacatgatcattatggatgaagcgcactttacagacccttcttccatcgccgctcggggctatattagcaccagagtgggaatgggcgaggccgctgccatcttcatgaccgccacaccccctgggtctgtcgaggcttttccgcagagcaatgcggttattcaggatgaggaacgggacatccccgagcgctcctggaactctggatacgagtggatcaccgatttccctggcaaaacagtgtggtttgtgcccagcattaagtccgggaatgacatcgccaactgtctgagaaagaatggaaaacgggtcattcagctgtctcgcaagaccttcgatacggaatatcagaagaccaagaacaacgactgggactacgtggttaccacagatatcagcgagatgggcgctaattttagagccgaccgggtgattgatcctagacgctgcctcaaacccgtcatcctgaaggacgggccggaacgggtgattcttgccggccctatgcccgttaccgtggcttccgccgcgcagagacgcggacggatcggcagaaaccataataaggagggggatcagtacatctatatgggacagcccctgaacaatgacgaggatcacgctcactggacggaagccaaaatgctcctggacaacattaatacccctgagggcatcattcccgccctgttcgaacctgagcgcgaaaagagcgctgccatcgatggggagtaccggctcagaggagaggcgcgcaaaacattcgtcgaacttatgagacggggcgacctgccggtgtggctgtcttataaggtcgcctccgaggggtttcaatacagcgatcgcagatggtgcttcgacggcgaacggaacaatcaggtgctcgaggaaaacatggatgttgagatttggaccaaagagggagaacgcaagaaactgagaccccggtggcttgacgctagaacatattccgaccctctggccctccgcgagtttaaggagttcgctgccggccggagatctgtgagcggggatctgatcctggagatcggaaagctcccccagcatcttacccagcgcgctcaaaatgccctggacaacctggtgatgctccacaattccgaacagggcgggcgggcgtacagacatgccatggaggagctgcctgatacaattgaaacccttatgctgctcgctctgatcgccgtcctgacgggaggcgttacactctttttcctttctggccgggggctgggaaaaaccagcattggcctgctctgtgtgatggcttccagcgtgctgctttggatggcctctgtcgagccccactggatcgccgcttccattatcctggaatttttcctcatggtgctgctgatcccggagcctgaccgccagagaacaccccaggataaccaactcgcgtatgttgtgattgggcttctgtttatgatcctgacagtcgccgctaatgagatgggactcctggaaaccacaaagaaagaccttggcattgggcacgtggccgtcgagaaccatcaccatgccacgatgctggatgtggacctccaccctgctagcgcctggaccctgtacgcggttgccacaaccatcattacacccatgatgcggcataccatcgaaaacacgaccgctaatatttctctgacagccatcgctaaccaggccgcgatcctcatgggacttgataagggctggcctatttccaaaatggacatcggcgtgcccctgctggccctcgggtgctacagccaggtcaatccgctgacccttacagctgccgtgctgatgctcgttgctcactatgccattatcggacctggcctgcaagctaaggccacccgcgaggcgcagaagagaacggccgctgggattatgaaaaaccccacagtggatggaatcgtcgccatcgacctggatcccgtggtgtacgacgctaagttcgaaaaacagctcggccagattatgcttctgatcctgtgtacctctcaaattctcctgatgcggacaacctgggccctttgcgagagcatcaccctggccacagggcctctcacgaccctgtgggagggatccccgggcaagttttggaatacaaccattgcggtttctatggctaacatcttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcattatggaggtcgaccggtccgaagctaaagaggggcttaagagaggagagacgacacgccacgccgtgtctcggggcaccgcgaaactgagatggttcgtggaacgcaatctcgtcaagcccgaggggaaggttatcgatctgggatgtggcagagggggatggagctattactgcgccggcctgaaaaaggtgaccgaagtgaaaggctatacaaaagggggacctggccatgaggaacccattcctatggctacctacgggtggaacctcgtcaaacttcactccggaaaggacgtgtttttcacaccccctgagaaatgtgatacgctgctgtgcgacatcggcgagtctagcccgaatcccaccattgaagaggggagaacactccgcgttctgaagatggtggaaccttggcttcggggaaaccaattttgtatcaagattctgaatccctacatgccttccgtcgtggagaccctcgagcagatgcagagaaaacatggcggcatgctggttcgcaaccccctgagcagaaattctacacacgaaatgtattgggtgtcctgcgggaccggaaacatcgtcagcgccgtgaatatgacgtctagaatgctcctgaaccgcttcaccatggctcaccggaagccgacatacgagagagatgtggaccttggcgccgggacccgccatgtcgcggttgaacctgaggtggccaacctggatatcattggacagagaatcgaaaatattaaacacgagcataagtccacatggcactatgacgaggataacccctacaaaacctgggcttatcatggcagctacgaagtgaagccctctgggtccgccagctccatggtcaatggagtggttaagctcctgacaaaaccttgggacgtgatccccatggtcacccaaattgctatgacggatacaaccccttttggccagcagcgggtgttcaaggagaaagttgacacccgcacaccgaaggccaaaagaggcacggctcaaatcatggaagtgaccgcccggtggctttgggggtttctgagcagaaacaagaagccccggatctgtacacgcgaggagttcaccagaaaagtccggtctaatgcggccattggagctgtgtttgttgacgagaaccagtggaatagcgccaaggaggctgtggaagatgagcgcttctgggacctcgtccagaaagaaagagagctgcacaagcagggcaaatgcgccacatgcgtgtataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtcgagggggagggactccataagctgggctacattcttcgcgacatctctaaaattcctgggggaaatatgtatgccgatgacaccgctggctgggatacaagaatcaccgaagacgatctgcaaaacgaggccaagatcacggacattatggaacccgagcacgctctcctggccaccagcatctttaaactgacataccagaataaggtggttcgggtgcagcgccctgcgaagaacgggaccgtcatggatgtgatttccagacgggaccagcgcggctctggacaagtgggcacatatgggctcaataccttcacgaacatggaagcccagctggttagacagatggagagcgagggaatcttttccccctgtgaacttgagattccgaacctggctgaacgggtgctcgattggctggagaaatacggcgtcgaaagacttaagcgcatggccatcagcggggacgactgcgtggttaaacctatcgatgaccggttcgctacagccctgaccgcgctcaatgatatgggaaaggtgagaaaagacgtcccccagtgggagccttctaagggctggaacgattggcaacaggtgcccttttgttcccatcacttccaccagctgattatgaaggacgggcgcgagatcgtcgtgccttgccggaatcaggatgaactggttggcagagcccgcgtgagccaaggagctggctggtctctccgggagacagcctgtctggggaaatcctatgctcagatgtggcagcttatgtactttcatagacgcgacctgcggctcgccgctaacgccatttgcagcgcggtccccgtggattgggttccgacctccagaacgacctggtctatccacgcccatcaccaatggatgacaaccgaagacatgctgagcgtgtggaatcgcgtctggattgaggaaaacccttggatggaggataagacacatgtgtccagctggggagacgtgccctatcttggcaaacgggaggaccagtggtgtgggtctctgatcggactcaccgctagagccacatgggcctccaatattcaggttgctatcaaccaggtccggagactgatcggcaatgaaaactacctggattacatgaccagcatgaagcgcttcaaaaatgagggggaccccgaaggcgccctctggtga

SEQ ID NO: 18911 - RNA, 9879 nt, synthetic construct
  misc_feature 1..9879: note = derived and/or modified CDS sequence (opt5) from DENV-1__FJ432745__SS-prME
  source 1..9879: mol_type = other RNA
agcgtgaccatgctgctgatgctgatgcccacagcccttgctttccacctgacgaccagaggcggggagcctcatatggtggtttccaagcaggaacggggaaagtctctcctgtttaagaccagcgccggcgtgaacatgtgcacccttatcgcgatggacctgggggagctctgtgaagatacaatgacctacaaatgcccccgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggctgggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacgttatgtggaaacagatctccaacgagcttaatcatatcctgctcgaaaacgacatgaagttcacagtggtcgtgggagatgtggctggcattctggcccaggggaaaaagatgatccggccgcaacccatggagtacaaatattcttggaaaagctggggaaaggccaagattatcggcgctgacgtccagaataccacctttattatcgatgggcctaacacacccgaatgtcctgacgatcagagagcgtggaatatctgggaggttgaggactacggattcggcatttttaccacgaacatctggctgaaacttcgcgattcctatacacaggtgtgcgaccaccggctcatgagcgccgctattaaagattctaaggccgtgcacgccgacatgggctactggatcgaatccgagaaaaatgaaacctggaagctggctagagccagcttcattgaggtcaagacatgtatctggcccaaatctcataccctgtggtccaacggggtgctcgaaagcgagatgatcattccgaagatctatggaggccctatttctcaacacaattaccgccccgggtacttcacacagaccgcgggaccttggcatctgggcaaacttgagctggattttgacctctgcgaagggacgaccgttgtggtcgatgagcactgcggaaaccggggccccagcctgagaacaaccacagtgaccggcaagatcattcacgaatggtgttgccggtcctgtacgctgcctccccttcgcttcagaggggaggacggatgctggtatggcatggagatccggccggttaaagaaaaggaggaaaatctcgtcaagagcatggtctctgctgggtccggagaggtggacagcttttccctgggcctgctctgtatctctattatgatcgaagaggttatgagaagccgctggtcccggaaaatgctgatgacagggacccttgccgtgttcctgctcctgattatgggacagctgacatggaacgatcttatcagactgtgcattatggtcggcgccaatgcttctgaccgcatgggcatggggaccacctacctcgccctgatggcgacatttaagatgagacctatgttcgctgtgggactcctgtttcggcgccttacgagcagagaggtgctgctcctgaccatcggcctgtcccttgtcgcctctgttgaactgcccaacagcctcgaggaactgggggatggactcgccatgggcattatgatcctgaaacttctgacagacttccaatcccatcagctctgggctaccctgctgagccttacatttatcaagaccacgttctctctgcactatgcctggaaaacaatggctatggtgctctccattgtgagcctgtttcccctctgtctgtctaccacctcccagaagacaacctggcttcctgtcctgctggggagcctcggatgcaagccgctgacaatgttccttatcgccgagaataaaatttggggccggcgctcttggcccctgaacgaaggcatcatggcggtggggattgtttccatcctcctgagctccctcctgaagaacgatgtgcctcttgccggacccctgatcgctggcgggatgctgattgcctgttacgtcatcagcggatctagcgctgacctctccctggagaaagccgccgaggtgtcttgggaagaggaagctgagcatagcggcgcgtcccacaatattcttgttgaagtgcaggatgacgggacgatgaagatcaaagatgaggagagagacgataccctgacaattctcctgaaggccaccctcctggctgtctctggagtgtatcctcttagcatccccgccacactgtttgtctggtacttctggcagaagaagaagcagcggtccggcgtgctgtgggacaccccttctcccccggaagttgagcgcgccgtgctcgatgacggcatctatagaattatgcagcgggggctgcttggacgcagccaggtcggcgtgggggttttccaagaaaacgtgtttcatacgatgtggcacgtcaccagaggagctgtgctgatgtaccagggcaaacggctcgagccttcctgggccagcgtgaagaaagacctgatctcttacgggggaggctggagactccagggctcctggaatacaggggaggaagttcaggtcattgcggtggagcccggaaagaaccctaaaaatgtgcaaaccgctcccggcacattcaagaccccggaaggggaggtcggagccatcgccctggattttaagcctggcacaagcgggtctcccattgtgaaccgcgaaggaaaaatcgttggcctttatggcaatggggtggtcacgacctccggaacatacgtgagcgctattgcccaggcgaaggcttcccaggagggccctctgcccgagatcgaagacgaggttttccggaaaagaaacctgaccatcatggatctccaccccgggtctggaaagacccgccggtatctgcctgccattgtgagagaagccatcaaacgcaaacttcggacactgattctcgctccgacgagagtcgtggccagcgagatggctgaagccctgaagggcatgcccatccgctaccaaaccacagcggttaaatccgagcataccgggaaggagattgtggacctgatgtgccacgccacatttaccatgcggctccttagccctgtcagagtgcccaattataacatgatcatcatggatgaagctcatttcacggacccttcttccattgccgctcggggctacatcagcacacgcgtgggaatgggcgaggccgccgctatttttatgaccgcgacaccccctgggtctgtcgaagccttcccgcagagcaatgctgttatccaggatgaggaaagagacattcccgagcggtcctggaactctggatatgagtggatcacagattttcctggcaaaaccgtgtggttcgtgcccagcatcaagtccgggaatgacattgccaactgtctgcgcaaaaatggaaagagagtcatccagctgtctcggaagacatttgataccgaataccagaagacgaagaacaacgactgggactacgtggttacaaccgatattagcgagatgggcgccaatttcagagctgaccgcgtgatcgatcctcggagatgcctcaaacccgtcattctgaaggacgggccggaacgcgtgatccttgccggccctatgcccgttacagtggcgtccgctgcccagcggagaggacgcattggccggaaccacaataaagagggggatcagtatatctacatgggacagcccctgaacaatgacgaggatcatgcccactggaccgaagctaagatgctcctggacaacatcaatacgcctgagggcattatccccgccctgttcgaacctgagagagaaaagagcgcggccattgatggggagtatcgcctcagaggagaggctcggaaaacctttgtcgaacttatgcgcagaggcgacctgccggtgtggctgtcttacaaggtcgcctccgaggggttccaatatagcgatcggcgctggtgctttgacggcgaaagaaacaatcaggtgctcgaggaaaacatggatgttgagatctggacaaaagagggagaacggaagaaactgagaccccgctggcttgacgctcggacctactccgaccctctggccctcagagagttcaaggaatttgctgccggccgccggtctgtgagcggggatctgattctggagatcggaaaactcccccagcaccttacacagagagcgcaaaatgccctggacaacctggtgatgctccataattccgaacagggcgggcgggcttatcgccacgccatggaggagctgcctgataccatcgaaacacttatgctgctcgctctgattgccgtcctgaccggaggcgttacgctgttctttctttctggcagagggctgggaaagacaagcatcggcctgctctgtgtgatggcctccagcgtgctgctttggatggcttctgtcgagccccattggattgcggcctccatcattctggagttctttctcatggtgctgctgatcccggagcctgaccggcagcgcacaccccaagataaccaactcgcttacgttgtgatcgggcttctgttcatgattctgaccgtcgccgccaatgagatgggactcctggaaaccaccaagaaagaccttggcatcgggcacgctgccgtgggaaaccaccatcacgcggccatgctggatgtcgacctccatcctgctagcgcctggacactgtacgctgtggccacgaccattatcacacccatgatgagacacaccattgagaacacaaccgcgaatatctctctgacggccattgctaaccaggccgctatcctcatgggccttgataagggctggcctatctccaaaatggacattggggttcccctgctggccctcggatgctatagccaggtgaatccgctgacccttacagctgccgtcctgatgctcgtggcgcattacgccatcattggccctgggctgcaagctaaggccacccgggaagctcagaaacgcacagccgccggaatcatgaagaaccccaccgttgatggcattgtggcgatcgacctggatcccgtcgtgtatgacgctaagtttgagaaacagctcgggcagatcatgcttctgattctgtgtacgtctcaaatcctcctgatgagaacaacctgggccctttgcgaaagcattacactggctaccggacctctcaccacactgtgggagggctccccgggcaagttctggaatacgaccatcgccgtgtctatggccaacatttttcgggggagctacctggctggagccggcctcgcgttctcccttatgaaaagcctcgggggaggccgcagagggacaggagcccagggcgagaccctgggcgaaaagtggaaacggcagctcaatcagctgtccaagtctgagttcaacacatataagagaagcgggatcatggaagttgaccgctccgaggctaaagaaggacttaagcggggcgagaccacgaaacacgccgtctctagagggacagctaagctgcgctggtttgtggagcggaatctcgtgaaacccgaaggaaaggtcatcgatctgggctgtgggagaggaggctggagctactattgcgccggcctgaagaaagttaccgaggtgaaggggtacaccaaaggaggccctgggcacgaagaacccattcctatggcgacatacggatggaacctcgtgaaacttcattccggcaaagacgtcttctttattccccctgaaaagtgtgataccctgctgtgcgacatcggggagtctagcccgaatcccacaatcgaggaaggacgcacgctccgggtgctgaaaatggttgagccttggcttagaggcaaccaattctgtattaagatcctgaatccctatatgccttccgtggtcgaaaccctcgagcagatgcagcgcaagcacggcgggatgctggtgcggaaccccctgagcagaaattctacacatgagatgtactgggtttcctgcggaaccggcaacattgtgagcgccgtcaatatgacatctcgcatgctcctgaaccggtttaccatggctcacagaaaaccgacgtatgaacgcgatgtggaccttggggccggaaccagacacgtggctgtcgagcctgaagttgccaacctggatatcatcggccagcggattgagaatatcaagcatgaacacaaatccacatggcattacgacgaggataacccctataagacctgggcttaccacgggagctatgaggtgaaaccctctggatccgccagctccatggtgaatggcgtcgtgaagctcctgacaaagccttgggacgttattcccatggtgacccaaatcgcgatgacagataccacgcctttcggccagcagcgcgtctttaaagaaaaggtggacacaagaaccccgaaagccaagcgggggaccgctcaaattatggaggttacagccaaatggctttggggattcctgagcagaaacaagaagccccggatctgtacgcgcgaagagtttaccagaaaagtgcggtctaatgctgccatcggcgccgtcttcgtggacgaaaaccagtggaatagcgcgaaggaggctgttgaggatgaacgcttttgggacctcgtgcatagagagcgggaactgcacaaacaggggaagtgcgccacatgcgtctacaacatgatgggaaaacgcgagaagaagctgggcgagttcgggaaagccaagggctccagagctatttggtacatgtggctcggagcccggtttctggagttcgaggctcttggcttcatgaatgaagatcactggttttctcgcgagaacagcctgtccggggtggaaggagagggcctccataaactggggtatatccttagagacatttctaagatccctggaggcaatatgtacgccgatgacaccgcggggtgggatacacggattaccgaggacgatctgcagaacgaagcccgcatcacagacatcatggagcccgaacacgctctcctggccaaaagcattttcaagctgacctatcaaaataaagtcgtgagagttcagcggcctgctaagaacggcacggtgatggatgtcatctcccgcagagaccagcggggatctggccaggtggggacctacggactcaatacatttaccaacatggaggcccaactgattagacagatggaaagcgagggcatcttctcccccagcgagcttgaaacaccgaacctggcggagcgcgtgctcgattggctggaaaagtatggggttgagcggcttaaaagaatggccatttctggagacgactgtgtggtcaagcctatcgatgaccgctttgctaccgccctgacggctctcaatgatatgggcaaagtgcggaaggacatcccccagtgggaaccttccaaagggtggaacgattggcagcaagttcccttctgcagccatcactttcaccagctgattatgaaggacggcagagagatcgtggtcccttgtcgcaatcaggatgagctggtgggacgggccagagtctctcagggcgctgggtggtccctccgcgaaacagcctgcctgggaaagagctacgcgcaaatgtggcagcttatgtatttccatcggagagacctgcgcctcgccgctaacgccatttgttccgccgtgcccgttgattggatcccgacctctcggacaacctggagcattcacgctcatcaccagtggatgacgaccgaggacatgctgtccgtgtggaatagagtctggatcgaagagaacccttggatggaagataaaacacatattagctcttggggcgacgtgccctaccttgggaagcgggaggaccaatggtgcggatccctgatcggcctcaccgccagagcgacatgggctaccaatatccaggttgccattaaccaggtgcgccggctgatcgggaatgagaactacctggattatatgacaagcatgaaaagatttaagaatgaatctgaccccgagggcgccctctggtga

SEQ ID NO: 18912 - RNA, 9879 nt, synthetic construct
  misc_feature 1..9879: note = derived and/or modified CDS sequence (opt5) from DENV-1__FJ432746__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactgaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaattacatcctgcttgaaaacgacatgaagctgacggttgtggtcggagatgtggctggcattctcgcccaggggaaaaagatgatccggccgcaacccatggagtataaatacagctggaagtcctggggaaaggccaaaattatcggcgctgacgtgcagaatacaacctttatcattgatgggcctaacacccccgaatgtcctgacgatcagagagcgtggaatatctgggaggtcgaggactatggattcggcatttttacaaccaacatctggctgaagctgcgcgatagctacacgcaggtttgcgaccatcggcttatgtctgccgctattaaagatacaaaggccgtgcacgccgacatgggctattggatcgaatccgagaaaaatgaaacctggaagctcgctagagccagcttcatcgaggtgaagacatgtatttggcccaaatctcacaccctgtggtccaacggggtcctggaaagcgagatgatcattccgaagatctacggaggccctatttctcaacataattaccgccccgggtatttcacacagaccgcgggaccttggcacctcggcaaactggagcttgattttgacctgtgcgaagggacgaccgtggttgtggatgagcattgcggaaaccggggccccagcctcagaacaaccacagtcaccggcaagatcatccacgaatggtgttgccggtcctgtacgctgcctcccctgcgcttcaaaggggaggacggatgctggtacggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgcaagatgctcatgacagggaccctggccgttttctttcttctgattatgggacagctcacatggaacgatctgatccggctgtgcattatggtgggcgccaatgcttctgacagaatgggcatggggaccacctatcttgccctgatggcgacattcaaaatgcgccctatgtttgctgtcggactcctgttcagacggctcacgagccgcgaggtgctgcttctgaccatcggcctctccctggtggcctctgtcgaactgcccaacagccttgaggaactgggggatggactcgccatgggcatcatgattctgaagctcctgacagactttcaatcccaccagctttgggctaccctgctcagcctgacattcgttagaaccacgttttctctgcattacgcctggaaaacaatggctatggtgctttccatcgtgagcctgttccccctctgtctgtctaccacctcccagaagacaacctggctccctgtcctgcttgggagcctgggatgcaagccgctgacaatgtttctcattgccgagaataaaatctggggccggaagtcttggcccctgaacgaaggcattatggcggtggggatcgtttccatccttctgagctccctcctgaaaaacgatgtgcctctcgccggacccctgattgctggcgggatgcttatcgcctgttatgtcattagcggatctagcgctgacctgtccctggagaaggccgccgtggtttcttgggaggaagaggctgaacacagcggcgcgtcccataatatcctcgtggaggtccaggatgacgggacgatgaaaattaaggatgaagagcgcgacgataccctgacaatccttctgaaagccaccctcctggctgtgtctggagtctaccctctcagcatccccgccacactgttcgtgtggtatttctggcaaaagaagaaacagagatccggcgttctttgggacaccccttctcccccggaggtggaacgggccgtcctggatgacggcatttaccgcatcatgcagagagggctgctcggacggagccaggtgggcgttggggtgtttcaagagaacgtcttccacacgatgtggcatgtgacccgcggagctgtgctgatgtaccagggcaagagacttgaaccttcctgggccagcgttaaaaaggacctgatttcttatgggggaggctggcggctccagggctcctggaatacaggggaggaggtccaggtgatcgcggtggaacccggaaaaaaccctaagaatgtccaaaccgctcccggcacatttaagaccagcgagggggaagtgggagccattgccctggatttcaaaccgggcacatctgggtcccctatcgttaacagagagggaaagattgtgggcctctacggcaatggggtcgtgacgaccagcggaacatatgtttccgctatcgcccaggcgaaagcttctcaggaaggccccctgcctgagatcgaggacgaagtgtttcgcaagcggaaccttaccattatggatctgcaccccgggagcggaaaaaccagacgctacctgcccgccatcgtccgggaggccattaagagaaagctccgcacactgatccttgctcctacgcgggtggttgcctccgaaatggctgaggccctgaaaggcatgccgattagatatcaaaccacagcggtgaagagcgaacacaccgggaaagagatcgtcgacctcatgtgccatgccacattcaccatgcgcctgctgtctcccgtgcgggtgcctaattacaacatgatcattatggatgaggctcactttacggacccctccagcatcgccgctagaggctatatttctacacgggtcggaatgggcgaagccgccgctatcttcatgaccgcgacccctcccgggagcgttgaggcctttcctcagtccaatgctgtgattcaggatgaagagcgcgacatcccggaaagatcttggaacagcggatacgagtggatcacagatttccccggcaagaccgtgtggtttgtcccttccattaaatctgggaatgacatcgccaactgtctccggaagaatggaaagcgcgtgattcagcttagcagaaaaacattcgataccgagtaccaaaagacgaaaaacaacgactgggactatgttgtgacaaccgatatctccgaaatgggcgccaatttccgggctgacagagtcattgatccccgccggtgcctgaagcctgtgatcctgaaagacgggcccgagagagttattctcgccggcccgatgcctgtgacagtcgcgagcgctgcccagcgccggggaagaatcggccgcaaccataataaggaaggggatcagtacatctatatgggacagcccctgaacaatgacgaggatcacgcccattggaccgaggctaagatgcttctggacaacattaatacgcccgaaggcatcattcctgccctctttgagcccgaacgggagaaatctgcggccatcgatggggaatacagactgcgcggagaggctagaaagaccttcgtggagctgatgcggcgcggcgacctccctgtctggctttcctataaagtggccagcgaagggtttcaatactccgatagacggtggtgcttcgacggcgagcgcaacaatcaggttctggaagagaacatggatgtggaaatttggacaaaggagggagagagaaaaaagctgcggccgagatggctcgacgctcgcacctattctgaccccctggcccttcgggaatttaaagagttcgctgccggcagacgcagcgtgtccggggatctgatcctcgaaatcggaaagctgcctcagcacctgacacagcgggcgcaaaatgccctcgacaaccttgtcatgctgcacaattctgagcagggcgggagagcttaccggcatgccatggaagagctgcccgataccattgagacactcatgctgcttgctctgatcgccgttctcaccggaggcgtgacgctgtttttcctgagcggccgcgggctcggaaagacatccattggccttctgtgtgtgatggccagctctgtcctgctctggatggcttccgtggaacctcactggatcgcggccagcattatcctggagtttttccttatggttctgctcatccccgaaccggacagacagcggacccctcaggataaccaactggcttacgtggtcattgggctgctctttatgatccttaccgtggccgccaatgagatgggactgctggagacaaccaaaaaggacctcggcattgggcatgtcgctgtggaaaaccaccaccatgccgcgatgctggatgttgaccttcaccccgcctctgcttggacactgtatgccgtggctacgaccatcattacacctatgatgcgccataccatcgagaacacaaccgccaatatttccctcacggcgatcgccaaccaggctgccatcctgatgggactggataaaggctggcccattagcaagatggacatcggcgtccctctccttgctctggggtgctactctcaggtgaatcccctgaccctcacagccgctgttctgatgcttgtggcccactatgcgattatcggaccgggcctgcaagccaaagctaccagagaagcccagaagcggacagctgccgggattatgaagaaccctaccgtcgatggaatcgtggccatcgacctcgatcccgtggtttacgacgcgaaattcgagaagcagctgggccagattatgctgctcatcctttgtacgagccaaattctgctgatgcgcacaacctgggctctctgcgaatccatcacactggccaccgggccccttaccacactgtgggagggatctcctggcaaattttggaatacgaccattgctgtcagcatggccaacatcttcagaggctcctatctcgccggggctggactggccttcagcctgatgaagtccctcggcgggggacggcgcggcacaggggcgcagggagagacccttggcgaaaaatggaagagacagctgaatcagctgtctaagagcgagtttaacacatacaaacggtccggcatcatggaagtggacagatctgaggccaaggaagggctcaaacgcggagagaccacgaagcatgctgtgagccggggcacagccaaactgagatggttcgtcgagcgcaatcttgttaagccggaagggaaggtgattgatctgggatgtggccgggggggatggtcctattactgcgctggcctcaaaaaggtgaccgaggtcaaaggctacaccaaggggggacccggccacgaagagcctatccccatggccacatatgggtggaacctggtgaaactgcactctggaaaggacgtttttttcattcctcccgaaaaatgtgataccctcctttgcgacatcggcgagagctcccctaatccgacaattgaggaagggagaacgctgcgcgtgctgaagatggtcgagccctggctccggggaaaccaattttgtatcaagattctgaatccttacatgcccagcgtggttgaaacccttgagcagatgcagagaaaacatggcggcatgctggtgcgcaaccctctctctcggaattccacacacgagatgtattgggtcagctgcgggaccggaaacatcgtgtctgcggtgaatatgacatccagaatgctgctgaaccgcttcaccatggcccatcggaagcccacgtacgaaagagatgtcgacctcggcgctgggacccgccacgttgccgtggagccggaagtggctaacctggatatcattggacagagaatcgagaatattaaacacgaacataagagcacatggcactatgacgaggataacccttacaaaacctgggcctatcatggctcttacgaggtcaagccctccgggagcgcttccagcatggtgaatggagttgtgaagcttctgacaaaaccctgggacgtcatccctatggtgacccaaattgccatgacagataccacgccctttggccagcagcgggttttcaaggaaaaagtggacacacgcacccctaaggcgaaaagaggcaccgcccaaatcatggaggtcacagctaagtggctctgggggtttctgtctcggaacaagaaaccgagaatctgtacgcgggaagagttcacccgcaaggtgagaagcaatgccgctattggagccgtttttgtggacgaaaaccagtggaattccgccaaagaggcggtcgaggatgaacggttctgggaccttgtgcaccgcgagagagaactgcataagcagggcaaatgcgctacatgcgtctacaacatgatggggaagcgggagaagaaactcggagaatttggcaaggccaaagggtctcgcgccatctggtatatgtggctgggcgctagattcctggagttcgaggccctcggatttatgaatgaagatcactggttcagccgggagaactccctgtctggcgtggaaggggagggacttcacaagctgggctacattctccgcgacatcagcaaaattcccgggggaaatatgtatgctgatgacaccgccggctgggatacaagaatcaccgaggacgatctgcagaacgaagcgaagatcacagacattatggagcctgaacatgcccttctggctaaatccatctttaagctcacctaccaaaataaggttgtgcgggtccagcgccccgccaaaaacgggacggtgatggatgtgatttctagacgggaccagcgcggcagcggacaggttggcacctatgggctgaatacattcaccaacatggaggctcaactgatcagacagatggaatccgagggaatttttagcccttctgagctcgaaacacccaacctggccggccgggtgcttgattggctggagaagcacggggtcgaaagactcaaacgcatggcgatctccggagacgactgtgtggttaagccgatcgatgaccggttcgccaccgctctgacggcccttaatgatatgggcaaagtgagaaaggacattcctcagtgggagcccagcaaggggtggaacgattggcagcaagtccctttttgctctcatcacttccaccagctgatcatgaaagacggccgcgaaattgtggtcccctgtcggaatcaggatgagctcgtgggaagagctcgcgtttcccagggcgccgggtggagcctgcgggagacagcttgcctgggaaagtcctacgcccaaatgtggcagctcatgtattttcatagacgcgacctgcggcttgcggccaacgctatctgttctgccgtgcctgtcgattgggtgcccaccagcagaacaacctggtccattcacgcccatcaccagtggatgacgaccgaagacatgctgagcgtttggaatcgcgtgtggatcgaggaaaacccgtggatggaggataaaacacatatttcttcctggggcgacgtcccttacctcgggaagcgggaagaccaatggtgcggaagcctgatcggccttaccgctagagccacatgggcgaccaatatccaggtggctattaaccaggtgcggagactgctcgggaatgagaactacctggattatatgacatctatgaaacgcttcaagaatgagagcgaccccgaaggcgccctgtggtga

SEQ ID NO: 18913 - RNA, 9879 nt, synthetic construct
  misc_feature 1..9879: note = derived and/or modified CDS sequence (opt5) from DENV-1__FJ432748__SS-prME
  source 1..9879: mol_type = other RNA
agcgtgaccatgctgctcatgctgatgcccaccgcccttgctttccacctgacgaccagaggcggggaacctcatatgattgtctccaagcaggaacgggggaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaagtgcctttctccacacaagatgaaaagggggtcacgcagaacggacggctgatcaccgcgaatcccatcgtgacagacaaagagaagcctgtgaacattgaagctgagccgccctttggcgagagctatatcgttattggggccggagaaaaagcccttaagctctcttggttcaagaaaggcagctccatcgggaagatgtttgaggctaccgccagaggcgctcgccggatggccattctgggagatacagcgtgggacttcggctctatcgggggagtctttaccagcgtgggcaaactggtgcatcagatcttcgggacggcctacggagtcctcttttccggcgtgagctggaccatgaagattgggatcggcgttctgcttacatggctgggactcaattctagatccaccagcctgtctatgacatgtattgctgtgggcctggtcaccctttacctcggggtgatggttcaggccgattccggatgcgtgatcaactggaaaggccgcgaactgaagtgtgggagcggaattttcgtcacaaatgaggtgcacacctggacggaacaatataagtttcaggctgactcccctaaacggctgtctgccgcgatcggcaaggcctgggaggagggggtttgcggcattagaagcgctacacgcctcgaaaacatcatgtggaaacagatctccaacgagctgaatcatattcttctggaaaacgacatgaagttcaccgtggtcgtgggagatgtggccggcatcctcgctcaggggaaaaagatgattcggccgcaacccatggagtacaaatattcttggaaaagctggggaaaggccaagatcattggcgccgacgtccagaataccacatttatcatcgatgggcctaacacccccgaatgtcctgacgatcagagagcttggaatatttgggaggttgaggactacggattcggcatctttacgacaaacatttggctgaagctgcgcgattcctatacccaggtgtgcgaccaccggcttatgagcgcggccatcaaagattctaaggctgtgcacgccgacatgggctactggattgaatccgagaaaaatgaaacatggaagctcgccagagctagcttcatcgaggtcaagacctgtatctggcccaaatctcatacactgtggtccaacggggtgctggaaagcgagatgattatcccgaagatttatggaggccctatctctcaacacaattaccgccccgggtacttcacccaggccgcgggaccttggcatctcggcaaactggagcttgattttgacctgtgcgaagggacgaccgttgtggtcgatgagcactgcggaaaccggggccccagcctcagaacaaccacagtgaccggcaagattatccacgaatggtgttgccggtcctgtacgctgcctcccctgcgcttcaaaggggaggacggatgctggtatggcatggagatcagaccggttaaggaaaaggaggaaaatcttgtgaaaagcatggtctctgctgggtccggagaggtggacagcttttccctcggcctgctgtgtatttctatcatgattgaagaggttatgcggagcagatggtcccgccggatgctcatgacagggaccctggccgtgttctttcttctgatcatgggacagctcacatggaacgatctgattagactgtgcatcatggtcggcgccaatgcttctgaccgcatgggcatggggaccacctaccttgccctgatggcgacattcaagatgagacctatgtttgctgtgggactcctgttccggcgcctcacgagcagagaggtgctgcttctgaccattggcctctccctggtcgcctctgttgaactgcccaacagccttgaggaactgggggatggactcgccatgggcatcatgatcctgaaactcctgacagactttcaatcccatcagctttgggctaccctgctcagcctgacattcattaagaccacgttttctctgcactatgcctggaaaacaatggctatggtgctttccatcgtgagcctgttccccctctgtctgtctaccacctcccagaagacaacctggctccctgtcctgcttgggagcctgggatgcaagccgctgacaatgtttctcattgccgagaataaaatctggggccggcgctcttggcccctgaacgaaggcattatggcggtggggatcgtttccatccttctgagctccctcctgaagaacgatgtgcctctcgccggacccctgattgctggcgggatgcttatcgcctgttacgtcattagcggatctagcgctgacctgtccctggagaaagccgccgaggtgtcttgggaagaggaagctgagcatagcggcgcgtcccacaatatcctcgttgaagtgcaggatgacgggacgatgaagattaaagatgaggagagagacgataccctgacaatccttctgaaggccaccctcctggctgtctctggagtgtatcctctcagcatccccgccacactgttcgtctggtacttctggcagaagaagaagcagcggtccggcgtgctttgggacaccccttctcccccggaagttgagcgcgccgtgctggatgacggcatttatagaatcatgcagcgggggctgctcggacgcagccaggtcggcgtgggggtttttcaagaaaacgtgttccatacgatgtggcacgtcaccagaggagctgtgctgatgtaccagggcaaacggcttgagccttcctgggccagcgtgaagaaagacctgatttcttacgggggaggctggagactccagggctcctggaatacaggggaggaagttcaggtcatcgcggtggagcccggaaagaaccctaaaaatgtgcaaaccgctcccggcacatttaagaccccggaaggggaggtcggagccattgccctggatttcaagcctggcacaagcgggtctcccatcgtgaaccgcgaaggaaaaattgttggcctctatggcaatggggtggtcacgacctccggaacatacgtgagcgctatcgcccaggcgaaggcttcccaggagggccctctgcccgagatcgaagacgaggtttttcggaaaagaaaccttaccattatggatctgcaccccgggtctggaaagacccgccggtatctgcctgccatcgtgagagaagccattaaacgcaagctccggacactgatccttgctccgacgagagtcgtggccagcgagatggctgaagccctgaagggcatgcccattcgctaccaaaccacagcggttaaatccgagcataccgggaaggagatcgtggacctcatgtgccacgccacattcaccatgcggctgctgagccctgtcagagtgcccaattataacatgatcattatggatgaagctcattttacggacccttcttccatcgccgctcggggctacattagcacacgcgtgggaatgggcgaggccgccgctatcttcatgaccgcgacaccccctgggtctgtcgaagcctttccgcagagcaatgctgttattcaggatgaggaaagagacatccccgagcggtcctggaactctggatatgagtggatcacagatttccctggcaaaaccgtgtggtttgtgcccagcattaagtccgggaatgacatcgccaactgtctccgcaaaaatggaaagagagtcattcagctttctcggaagacattcgataccgaataccagaaaacgaagaacaacgactgggactacgtggttacaaccgatatcagcgagatgggcgccaatttcagagctgaccgcgtgattgatcctcggagatgcctgaaacccgtcatcctgaaggacgggccggaacgcgtgattctcgccggccctatgcccgttacagtggcgtccgctgcccagcggagaggacgcatcggccggaaccacaataaagagggggatcagtatatctacatgggacagcccctgaacaatgacgaggatcatgcccactggaccgaagctaagatgcttctggacaacattaatacgcctgagggcatcattcccgccctctttgaacctgagagagaaaagagcgcggccatcgatggggagtatcgcctgagaggagaggctcggaaaaccttcgtcgaactgatgcgcagaggcgacctcccggtgtggctttcttacaaggtcgcctccgaggggtttcaatatagcgatcggcgctggtgcttcgacggcgaaagaaacaatcaggtgctggaggaaaacatggatgttgagatttggacaaaagagggagaacggaagaaactgagaccccgctggctcgacgctcggacctactccgaccctctggcccttagagagtttaaggagttcgctgccggccgccggtctgtgagcggggatctgatcctcgagatcggaaaactgccccagcacctgacacagagagcgcaaaatgccctcgacaaccttgtgatgctgcataattccgaacagggcgggcgggcttatcgccacgccatggaggagctgcctgataccattgaaacactcatgctgcttgctctgatcgccgtcctcaccggaggcgttacgctgtttttcctgtctggcagagggctcggaaagacaagcattggccttctgtgtgtgatggcctccagcgtgctgctctggatggcttctgtcgagccccattggatcgcggcctccattatcctggaatttttccttatggtgctgctcatcccggagcctgaccggcagcgcacaccccaggataaccaactggcttacgttgtgattgggctgctctttatgatccttaccgtcgccgccaatgagatgggactgctggaaacaaccaagaaagacctcggcattgggcacgtggctgtcgagaaccaccatcacgccgcgatgctggatgtggaccttcatcctgccagcgcttggacactgtacgccgttgctacgaccatcattacacccatgatgagacacaccatcgaaaacacaaccgccaatatttctctcacggcgatcgccaaccaggctgccatcctgatgggactggataagggctggcctatttccaaaatggacatcggcgtgcccctccttgctctggggtgctatagccaggtcaatccgctgaccctcacagccgctgtgctgatgcttgttgcccattacgcgattatcggacctggcctgcaagccaaggctacccgggaggcccagaaacgcacagctgccgggattatgaagaaccccaccgtggatggaatcgtcgccatcgacctcgatcccgtggtgtatgacgcgaagttcgaaaaacagctgggccagattatgctgctcatcctttgtacgtctcaaattctgctgatgagaacaacctgggctctctgcgagagcatcacactggccaccgggcctcttaccacactgtgggagggatccccgggcaagttttggaatacgaccattgctgtttctatggccaacatcttccggggcagctacctcgccggggctggactggccttctccctgatgaaaagcctcggcgggggacgcagaggcacaggggcgcagggagaaacccttggcgagaagtggaaacggcagctgaatcagctgtccaagtctgaatttaacacatataagagaagcggcatcatggaggtcgaccgctccgaagccaaagaggggctcaagcggggagagaccacgaaacacgctgtgtctagaggcacagccaagctgcgctggttcgtggaacggaatcttgtcaaacccgaggggaaggttattgatctgggatgtggcagagggggatggagctactattgcgctggcctcaagaaagtgaccgaagtgaagggctacaccaaagggggacctggccacgaggaacccatccctatggccacatacgggtggaacctggtcaagctgcattccggaaaagacgtgtttttcattccccctgagaagtgtgataccctcctttgcgacatcggcgagtctagcccgaatcccacaattgaagaggggcgcacgctgcgggttctgaaaatggtggaaccttggctcagaggaaaccaattttgtatcaagattctgaatccctatatgccttccgtcgtggagacccttgagcagatgcagcgcaagcacggcggcatgctggttcggaaccccctcagcagaaattctacacatgaaatgtactgggtgtcctgcgggaccggaaacatcgtcagcgcggtgaatatgacatctcgcatgctgctgaaccggttcaccatggcccacagaaaaccgacgtatgagcgcgatgtggacctcggcgctgggaccagacacgtcgccgttgaacctgaggtggctaacctggatatcattggacagcggatcgaaaatattaagcatgagcacaaatccacatggcattacgacgaggataacccctataagacctgggcctaccacggcagctatgaagtgaaaccctctgggtccgctagctccatggtcaatggagtggttaaacttctgacaaagccttgggacgtgatccccatggtcacccaaattgccatgacagataccacgccttttggccagcagcgcgtgttcaaagagaaggttgacacaagaaccccgaaagcgaagcggggcaccgcccaaatcatggaagtgacagctaaatggctctgggggtttctgagcagaaacaagaagccccggatctgtacgcgcgaggagttcaccagaaaagtccggtctaatgccgctattggagccgtgtttgttgacgagaaccagtggaatagcgccaaggaggcggtggaagatgagcgcttctgggaccttgtccatagagaacgggagctgcacaaacagggcaagtgcgctacatgcgtgtacaacatgatggggaaacgcgaaaagaagctcggagagtttggcaaagccaaggggtccagagccatctggtacatgtggctgggcgctcggttcctggagttcgaagccctcggatttatgaatgaggatcactggttctctcgcgaaaacagcctgtccggcgtcgagggggagggacttcataaactgggctatattctcagagacatctctaagattcctgggggaaatatgtacgctgatgacaccgccggctgggatacacggatcaccgaagacgatctgcagaacgaggcgcgcatcacagacattatggaacccgagcacgcccttctggctaaaagcatctttaagctcacctatcaaaataaagtggttagagtgcagcggcctgccaagaacgggacggtcatggatgtgatttcccgcagagaccagcggggctctggacaggtgggcacctacgggctgaatacattcaccaacatggaagctcaactgatcagacagatggagagcgagggaatcttttcccccagcgaactcgagacaccgaacctggccgaacgcgttcttgattggctggagaagtatggcgtggaacggctcaaaagaatggcgatctctggggacgactgtgtcgtgaagcctatcgatgaccgcttcgccaccgctctgacggcccttaatgatatgggaaaagttcggaaggacattccccagtgggagccttccaaaggctggaacgattggcagcaagtgcccttttgcagccatcacttccaccagctgatcatgaaggacgggagagagattgtcgtgccttgtcgcaatcaggatgaactcgtcggccgggctagagtgtctcagggagccggctggtccctgcgcgagacagcttgcctgggaaagagctacgcccaaatgtggcagctcatgtattttcatcggagagacctgcgccttgcggccaacgctatctgttccgccgttcccgtggattggattccgacctctcggacaacctggagcatccacgcccatcaccagtggatgacgaccgaagacatgctgtccgtctggaatagagtgtggattgaggaaaacccttggatggaggataaaacacatatcagctcttggggagacgttccctacctcggcaagcgggaggaccaatggtgcgggtccctgatcggacttaccgctagagccacatgggcgaccaatattcaggtggctatcaaccaggtccgccggctgattggcaatgaaaactacctcgattatatgacaagcatgaaaagattcaagaatgagtctgaccccgaaggggccctgtggtga

SEQ ID NO: 18914 - RNA, 9879 nt, synthetic construct
  misc_feature 1..9879: note = derived and/or modified CDS sequence (opt5) from DENV-1__FJ432749__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaagtcccttctgtttaagacctctgccggcgttaatatgtgcacccttattgccatggacctgggggaactctgtgaagataccatgacatacaagtgcccgcgcatcaccgaagctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttcctgacccaagatgaaaagggggttacacagaacggacggcttatcacggctaatcccattgtgaccgacaaagagaagcctgtcaacatcgaagccgagccgccctttggcgagtcctatattgtgatcggggccggagaaaaagctctcaagctgagctggttcaagaaaggctctagcattgggaagatgtttgaggccacagctagaggcgcccgccggatggcgatcctgggagataccgcctgggacttcggctccatcgggggagtgtttacatctgttggcaaactcgtccatcagattttcgggaccgcttacggagtgctgtttagcggcgtgtcctggacgatgaagatcgggattggcgtccttctgacctggctcggactgaatagcagatctacatccctgagcatgacctgtatcgccgtgggccttgttacactctacctgggggtgatggtccaggctgattctggatgcgtgattaactggaaaggccgcgaactgaagtgtgggtccggaatcttcgttaccaatgaggtgcacacatggaccgaacaatataagtttcaggccgacagccctaaacggctctccgcggccattggcaaggcttgggaggagggggtctgcggcatcagatctgccacgcgcctggaaaacatcatgtggaaacagattagcaacgagcttaatcatatcctgctcgaaaacgacatgaagttcacagtggttgtgggagatgtcgtgggcattctggctcaggggaaaaagatgatccggccgcaacccatggagcacaaatactcctggaagtcttggggaaaggccaaaattatcggcgccgacgtgcagaataccacctttatcattgatgggcctaacacacccgaatgtcctgacgatcagagagcttggaatatctgggaggtcgaggactatggattcggcatttttaccacgaacatctggctgaaacttcgcgatagctacacacaggtttgcgaccaccggctcatgtccgcggccattaaagatagcaaggctgtgcatgccgacatgggctattggatcgaatctgagaaaaatgaaacctggaagctggccagagcttccttcatcgaggtgaagacatgtatttggcccaaaagccacaccctgtggtctaacggggtcctcgaatccgagatgatcattccgaagatctacggaggccctattagccaacataattatcgccccgggtacttcacacagaccgccggaccttggcacctgggcaaacttgagctggattttgacctctgcgaagggacgaccgtggttgtggatgagcactgcggaaaccggggcccctctctgagaacaaccacagtcaccggcaagatcatccatgaatggtgttgccggagctgtacgctgcctccccttcgcttcaaaggggaggacggatgctggtacggcatggagattagaccggtgaaggaaaaggaggaaaatctcgttaaatccatggtgagcgcggggtctggagaggtcgactcctttagcctgggcctgctctgtatctccattatgatcgaagaggtgatgcggtctagatggagccgcaagatgctgatgacagggacccttgctgttttcctgctcctgattatgggacagctgacatggaacgatcttatccggctgtgcattatggtgggcgccaatgcctccgacagaatgggcatggggaccacctatctcgctctgatggccacatttaaaatgcgccctatgttcgcggtcggactcctgtttagacggcttacgtctcgcgaggtgctgctcctgaccatcggcctgagccttgtggcttccgtcgaactgcccaactctctcgaggaactgggggatggactcgccatgggcatcatgattctgaaacttctgacagacttccaaagccaccagctctgggccaccctgctgtcccttacatttatcaaaaccacgctgagcctccattacgcttggaagacaatggccatggttctgtctattgtgtccctcttccccctgtgtcttagcaccacctctcagaagacaacctggctgcctgtgctgctcgggtccctgggatgcaaaccgcttacaatgtttctgatcgctgagaataagatttggggcagaaaaagctggcccctcaacgaaggcatcatggccgtcggggtggtttctatcctgctctccagcctgcttaagaacgatgtgcctctggcgggacccctgattgccggcgggatgctcatcgcttgttatgtcatttccggaagctctgccgacctgagccttgagaaagctgccgaggtgtcctgggaagaggaagccgagcactctggcgctagccataatatcctggttgaagtgcaggatgacgggacgatgaagattaaagatgaggagcgggacgataccctcacaatcctgctcaaggcgaccctgcttgccgtctccggagtgtaccctctgtctatccccgctacactgttcgtctggtatttttggcaaaagaaaaagcagcgcagcggcgtgctctgggacacccctagccctcccgaagttgagaaagccgtgctggatgacggcatttacagaatcatgcagcgggggcttctgggacgctctcaggtcggcgtgggggttttccaagaaaacgtgttccacacgatgtggcacgtcaccagaggagccgtgctcatgtatcagggcaagcggctggagcccagctgggcttccgtgaaaaaggacctcattagctacgggggaggctggcgcctgcagggctcttggaatacaggggaggaagttcaggtcatcgccgtggagcccggaaagaaccctaaaaatgtgcaaaccgcgcccggcacatttaagaccccggaaggggaggtcggagctattgcccttgatttcaaacctggcacatccgggagccccatcgtgaacagagaaggaaagattgttggcctgtacggcaatggggtggtcacgacctctggaacatatgtgtccgccatcgctcaggccaaagcgagccaggagggccctctgcccgagatcgaagacgaggtttttcggaagagaaacctcaccattatggatctgcatcccgggtccggaaagacccgccggtaccttcctgctatcgtgagagaagccattaaacgcaagctgcggacactcatcctggccccgacgagagtcgtggcttctgagatggccgaagctctgaaaggcatgcccattcgctatcaaaccacagccgttaagagcgagcacaccgggaaagagatcgtggacctcatgtgccatgcgacattcaccatgcggcttctgtcccctgtcagagtgcccaattacaacatgatcattatggatgaagcccactttacggaccctagctctatcgctgcccgcggctatatttccacacgggtgggaatgggcgaggctgccgccatcttcatgaccgctacaccccctgggagcgtcgaagcgtttccgcagtctaatgccgttattcaggatgaggaaagagacatccccgagcggagctggaactccggatacgagtggatcacagatttccctggcaagaccgtgtggtttgtgccctctattaagagcgggaatgacatcgctaactgtctgcgcaaaaatggaaagagagtcattcagctctcccggaaaacattcgataccgaatatcaaaagacgaaaaacaacgactgggactacgtggttacaaccgatatctctgagatgggcgccaattttcgcgccgacagagtgattgatcctcggagatgcctgaagcccgtcatccttaaggacgggccggaacgcgtgattctggctggccctatgcccgttacagtggccagcgcggctcagcggagaggacgcatcggccggaaccataataaagagggggatcagtacatctatatgggacagcccctcaacaatgacgaggatcacgcccactggaccgaagccaagatgctgctggacaacattaatacgcctgagggcatcattcccgctctcttcgaacctgagagagaaaaatccgccgcgatcgatggggagtaccgccttcggggagaggccagaaagaccttcgtcgaactgatgcgcagaggcgacctgccggtgtggctcagctataaagtcgcttctgaggggtttcaatactccgatcggcgctggtgcttcgacggcgaaagaaacaatcaggtgctggaggaaaacatggatgttgagatttggacaaaggagggagaacggaagaaacttcgccccagatggctggacgcccggacctatagcgaccctctcgctctgagagagtttaaagagttcgccgctggccgccggtccgtgtctggggatctgatcctcgagatcggaaaacttccccagcatctgacacagagagcccaaaatgcgctggacaacctcgtgatgctgcacaatagcgaacagggcgggcgcgcctaccggcatgctatggaggagcttcctgataccattgaaacactgatgctcctggccctgatcgctgtcctcaccggaggcgttacgctctttttcctgtccggcagagggctgggaaagacatctattggcgtgctctgtgtgatggccagctccgtcctgctttggatggccagcgtggagccccactggatcgctgcgtctattatcctggaatttttcctcatggttctgctgatcccggagcctgaccggcagcgcacaccccaggataaccaactcgcctatgtggtcattgggcttctgtttatgatcctgaccgtggctgccaatgagatgggactcctggaaacaaccaaaaaggaccttggcattgggcacgtcgccgtggagaaccatcaccatgctacaatgctggatgttgacctccaccctgcctccgcgtggacgctgtacgccgtggctaccacaatcattacccccatgatgagacatacaatcgaaaacaccacggccaatattagcctgaccgctatcgccaaccaggcggccatcctcatgggacttgataaaggctggcctatttctaagatggacatcggcgtccccctgctggctctcgggtgctactcccaggtgaatccgctgacacttaccgccgctgttctgatgctcgtggcccactatgctattatcggacctggcctgcaagccaaggcgacacgggaggcccagaaacgcaccgctgccgggattatgaagaaccccacggtcgatggaatcgtggctatcgacctggatcccgtggtttacgacgccaaattcgaaaagcagctcggccagattatgcttctgatcctgtgtacaagccaaattctcctgatgagaaccacatgggccctttgcgagtctatcaccctggcgaccgggcctctcacaacgctgtgggagggaagcccgggcaaattttggaataccacaattgctgtctccatggccaacatcttccggggctcttatctggctggggccggactcgcctttagccttatgaagtccctgggcgggggacgcagaggcaccggggctcagggagaaacactgggcgagaagtggaaacggcagctcaatcagctgagcaagtccgagttcaacatctacaaacgctctggcattatggaggtggacagaagcgaagccaaggaggggcttaaacggggagagaccacgagacacgcggtgtcccgcggcacagccaagctgcggtggttcgtcgaaagaaatctcgttaagcccgaggggaaagtgatcgatctgggatgtggccgcgggggatggtcttattactgcgctggcctgaagaaagtgaccgaagtcaagggctataccaaagggggacctggccatgaggaacccattcctatggccacatacgggtggaacctcgtgaaacttcacagcggaaaagacgtgtttttcacaccccctgagaagtgtgataccctgctgtgcgacatcggcgagtcctctccgaatcccacgattgaagaggggcggaccctcagagttctgaagatggtcgaaccttggcttcgcggaaaccaattttgtatcaaaattctgaatccctacatgcctagcgtggttgagacactcgagcagatgcagcggaagcatggcggcatgctggtgagaaaccccctgtcccgcaatagcacccacgaaatgtattgggtctcttgcgggacaggaaacatcgtgtccgctgtgaatatgaccagccggatgctcctgaacagattcacgatggcccaccgcaaaccgacctacgagcgggatgtcgaccttggcgcggggacaagacatgttgccgtggaacctgaggtggctaacctggatatcattggacagcgcatcgaaaatattaagcacgagcataaatctacctggcactatgacgaggataacccctacaagacatgggcctatcatggctcctacgaagtcaagcccagcgggtctgcttccagcatggtgaatggagttgtgaaactcctgaccaagccttgggacgtcatccccatggtgacacaaattgccatgaccgatacgacaccttttggccagcagagagttttcaaagagaaggtggacacccggaccccgaaagctaagcgcggcacagcccaaatcatggaagtcacggcgagatggctttgggggtttctgtcccggaacaagaaacccagaatctgtacccgggaggagttcacacgcaaggtgagaagcaatgccgctattggagccgtttttgtggacgagaaccagtggaactctgctaaagaggccgtcgaagatgagcggttctgggacctcgtgcagaaggaacgcgagctgcacaaacagggcaagtgcgcgacctgcgtctataacatgatggggaagagagagaagaagctgggagagtttggcaaagcgaaggggagccgggctatctggtacatgtggctcggcgcccgcttcctggagtttgaagcccttggattcatgaatgaggatcactggttctccagagaaaactctctgagcggcgtggagggggagggactccataaactgggctacattcttcgggacatctccaagattcctgggggaaatatgtatgctgatgacacagccggctgggatacccgcatcacagaagacgatctgcaaaacgaggctaaaatcaccgacattatggaacccgagcacgccctcctggcgacgtctatctttaagctgacctaccagaataaggttgtgagagtccagcggcctgccaaaaacgggacagtgatggatgtgattagccgcagagaccagcggggctccggacaagttggcacctatgggctcaatacattcaccaacatggaagctcagctgatccgccagatggagtctgagggaatttttcttcccagcgaactggagacgccgaacctcgccgaaagagtgctggattggcttgagaagtacggcgtcgaacggctgaaaagaatggctatctccggggacgactgtgtggttaagcctatcgatgaccgcttcgccacagcgctcaccgccctgaatgatatgggaaaagtgcggaaggacattccccagtgggagcctagcaagggctggaacgattggcaacaggtccccttttgctctcatcacttccaccagctgatcatgaaagacgggagagagattgtggtcccttgtcgcaatcaggatgaactcgtgggccgggctagagtttcccaaggagccggctggagcctgcgcgagacagcttgccttgggaagtcttatgcccagatgtggcagctgatgtactttcatcggagagacctccgcctggctgccaacgcgatctgttccgccgtgcccgtcgattgggtgccgaccagccggacgacctggtccattcacgctcatcaccaatggatgacaaccgaagacatgctttctgtttggaatagagtgtggatcgaggaaaacccttggatggaggataaaacacatgtcagctcctggggagacgtgccctatctgggcaagcgcgaggaccagtggtgcgggagcctcattggactgaccgcccgggccacatgggcttctaatatccaggtggccatcaaccaggttagacggctgattggcaatgaaaactacctcgattacatgacctccatgaaaagattcaagaatgagggggaccccgaaggcgcgttttggtga

SEQ ID NO: 18915 - RNA, 9879 nt, synthetic construct
  misc_feature 1..9879: note = derived and/or modified CDS sequence (opt5) from DENV-1__FJ410212__SS-prME
  source 1..9879: mol_type = other RNA
agcgtgaccatgctgctcatgctgatgcccacagctcttgctttccacctgacgaccagaggaggggagcctcatatgatcgtgtccaagcaggaacggggaaaatctctcctgtttaagaccagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgcccttctgacctggctcggactcaattctagatccacaagcctgtctatgacctgtattgctgtgggccttgttacactctacctgggggtgatggtccaggccgactccggatgcgtgatcaactggaaaggccgcgagctgaagtgtgggagcggaattttcgttaccaatgaagtgcacacatggaccgagcaatataagtttcaggcggattcccctaaacggctctctgccgctatcggcaaggcctgggaggaaggggtctgcggcattagaagcgctacgcgcctggagaacatcatgtggaaacagatctccaacgaacttaatcatattctgctcgagaacgacatgaagttcacagtggttgtgggagacgtcgccggcatcctggtgcaggggaaaaagatgattcggccgcaacccatggaatacaaatattcttggaaaagctggggaaaggccaaaatcattggcgctgatgtgcaaaattccacctttatcatcgacgggcctaacacccccgagtgtcctgatgaccagagagcgtggaatatttgggaggtcgaagattacggattcggcatctttacaaccaacatttggctgaaacttcgcgacagctatacgcaggtttgcgatcaccggctcatgtctgccgctatcaaagactccaaggccgtgcacgccgatatgggctactggattgagagcgagaagaatgagacatggaagctggctagagcctctttcatcgaagtgaagacctgtatctggcccaaatcccatacactgtggagcaacggggtcctcgagtctgagatgattatcccgaagattcacggaggccctatcagccaacataattatcgccccgggtacttcacccagacagcgggaccttggcacctgggcaaacttgaactggactttgatctctgcgaggggaccacggtggttgtggacgaacactgcggaaaccggggcccctccctgagaaccacaaccgtcacaggcaagattatccatgagtggtgttgccggagctgtaccctgcctccccttcgcttcagaggggaggatggatgctggtacggcatggaaatccggccggtgaaagagaaggaagagaatctcgttaagtctatggtgtccgctgggagcggagaagtcgactccttttctctgggcctgctctgtattagcatcatgattgaggaggtgatgagatcccgctggtctcggaaaatgctgatgacggggacacttgccgttttctttctgctcatcatgggacagctgacctggaacgacctgattagactttgcatcatggtgggcgccaatgctagcgatcgcatgggcatggggacaacctatctggccctcatggcgaccttcaagatgagacctatgtttgctgtcggactgctgttccggcgcctgacatccagagaagtgcttctgctcacgattggcctgtctctggtggccagcgtcgagcttcccaactccctggaagaactgggggacggactggccatgggcatcatgatcctcaaactgcttaccgattttcaaagctaccagctgtgggctacactcctgtctctgaccttcattaagacaaccttttcccttcactatgcctggaaaacgatggctatggttctgagcatcgtgtctctcttccccctgtgtctctccacaaccagccagaagaccacatggctgcctgtgcttctggggtctctgggatgcaagccgctcaccatgtttctgattgccgaaaataaaatctggggccggaagtcctggccccttaacgagggcattatggcggtcgggatcgtgagcatcctgctctccagcctgctcaaaaacgacgttcctctggccggaccccttattgctggcgggatgctgatcgcctgttacgtgatttctggaagctccgctgatctgtctctcgagaaggccgccgaagtcagctgggaggaagaggctgaacattccggcgcgtctcacaatatcctggtggaggttcaggacgatgggacaatgaaaattaaggacgaggaacgcgatgacacgcttaccatcctgctcaaagccacactgctcgctgtgagcggagtctatcctctgtccatccccgccacccttttcgtgtggcatttctggcaaaagaagaaacagagatctggcgtcctgtgggatacacctagccctcccgaggtggaacgggccgttctggacgatggcatttaccgcatcatgcagagagggctcctgggacggtcccaggtgggcgtcggggtgtttcaagagaacgttttccacaccatgtggcacgtgacgcgcggagctgtccttatgtatcagggcaagagactggagcccagctgggcctctgtgaaaaaggacctcatttcctacgggggaggctggcggtttcagggcagctggaataccggggaagaggtgcaggttatcgcggtcgaacccggcaaaaaccctaagaatgtgcaaacagctcccggcaccttcaagacaccggagggggaagtgggagccattgccctggactttaaacctggcacctctgggtcccccatcgtcaacagagagggaaagattgtgggcctctacggcaatggggttgtgacaacgagcggaacctatgtctccgctatcgcccaggcgaaggcttctcaggagggccctctgcccgaaatcgaggatgaagtgttccgcaagcggaaccttacaattatggacctgcatcccgggagcggaaaaaccagacgctacctgcctgccatcgttcgggaggccattaagagaaagctccgcaccctgatccttgctccgacacgggtggtcgcctccgaaatggctgaggccctgaaaggcatgcccattagatatcaaacgaccgcggtcaagagcgagcacacagggaaagaaatcgttgatctcatgtgccatgccacctttacaatgcgcctgctgtctcctgtgcgggtccccaattacaacatgatcattatggacgaggctcacttcaccgatccttccagcatcgccgctagaggctatatttctacgcgggtgggaatgggcgaagccgccgctatctttatgacagcgacaccccctgggagcatggaggccttcccgcagtccaatgctgtgattcaggacgaagaaagagatatccccgagagatcttggaacagcggatacgaatggatcaccgactttcctggcaagacagtctggttcgttccctccattaaagccgggaatgatatcgccaactgtctccggaagaatggaaagcgcgtgattcagctttctagaaaaaccttcgacacagagtatcaaaagaccaaaaacaacgattgggactacgtggtcacgacagacatcagcgaaatgggcgctaattttcgggccgatagagtgattgaccctcgccggtgcctgaagcccgttatcctgaaagatgggccggagagagtgattctcgcgggccctatgcccgtcaccgtggcttccgccgcccagcgccggggaagaatcggccgcaaccataataaggagggggaccagtacatctatatgggacagcccctgaacaatgatgaagaccacgctcactggacagaggccaagatgcttctggataacattaatacccctgaaggcatcattcccgccctcttcgagcctgaacgggagaaaagcgccgctatcgacggggagtacagactgcgcggagaagccagaaagacgtttgttgagctgatgcggcgcggcgatctcccggtgtggctttcttataaagtcgcttccgaagggttccaatacagcgacagacggtggtgctttgatggcgagcgcaacaatcaggtgctggaagagaacatggacgtcgagatttggaccaaggaaggagagcgcaaaaagctgcggcccagatggctcgatgcccgcacatattccgaccctctggcccttcgggagttcaaagagtttgccgcgggcagacgctctgtgagcggggacctgatcctcgaaatcggaaagctgccccagcatctgacccagcgggcccaaaatgctctcgataaccttgttatgctgcacaattccgagcagggcgggagagcctaccggcatgctatggaggaactgcctgacacaattgagaccctcatgctgcttgccctgatcgccgtgctcacaggaggcgtgaccctgttctttctgtctggcaaggggctcggaaaaacgagcattggccttctgtgtgtcatggcttccagcgttctgctctggatggcgtctgtggaaccccactggatcgccgcttccattatcctggagttctttcttatggtgctgctcatcccggagcctgatcgccagagaacaccccaggacaaccaactggcctatgtcgtgattgggctcctcttcatgatccttaccgttgccgctaatgaaatgggactgctggagaccacaaagaaagatctcggcattgggcacgtggccgtcgaaaaccatcaccatgcggccatgctggacgtggatcttcaccctgctagcgcctggaccctgtacgctgtcgccacaacgatcgtgacccccatgatgcggcatacaattgagaacaccacagcgaatatctctctcaccgccattgctaaccaggccgctatcctgatgggactggacaagggctggcctatctccaaaatggatattggcgttcccctccttgccctggggtgctacagccaggtgaatccgctgacgctcaccgctgccgtcctgatgcttgtggcgcactatgccatcattggacctggcctgcaagctaaggccacacgcgaagctcagaagagaaccgccgccgggatcatgaaaaaccccacaattgacggaatcgttgcgatcgatctcgaccccgtggtctacgatgctaagtttgagaaacagctgggccagattatgctgctcatcctttgtacctctcaaattctgctgatgcggacgacatgggccctctgcgagagcatcaccctggctacagggcctcttaccaccctgtgggaaggatccccgggcaagttctggaatacaacgattgccgtgtctatggccaacatcttccgcggcagctatctcgctggggccggactggcgttttccctgatgaaaagcctcggcgggggaagacggggcaccggggcccagggagagacacttggcgaaaagtggaagcgccagctgaatcagctgtccaaatctgagttcaacacctacaagagaagcggcatcatggaagtggaccggtccgaggctaaagaggggctcaagagaggagaaacaaccaaacacgccgtttctcgcggcacggctaagctgcggtggtttgtcgagagaaatcttgtgaagcccgaagggaaagtgattgacctgggatgtggccgcgggggatggagctattactgcgccggcctcaagaaagtcacagaggttaagggctataccaaagggggacctggccatgaggaacccatccctatggcgacctacgggtggaacctggtgaagctgcactccggaaaagatgtgttctttattccccctgagaagtgtgacacactcctttgcgatatcggcgaatctagcccgaatcccaccattgaggaagggcggacactgagagtcctgaagatggtggagccttggctccgcggaaaccaattctgtatcaaaattctgaatccctacatgccttccgttgtggagacgcttgaacagatgcagcggaagcatggcggcatgctggtcagaaaccccctcagccgcaattctacccacgagatgtattgggtgtcctgcgggacaggaaacatcgttagcgccgtgaatatgacctctcggatgctgctgaacagatttacaatggctcaccgcaaaccgacctacgaacgggacgtcgatctcggcgccgggacgagacatgtggctgtggagcctgaagtcgccaacctggacatcattggacagcgcatcgagaatattaagcacgagcataaatccacctggcactatgatgaagacaacccctacaagacatgggcttatcatggcagctacgaggttaagccctctgggtccgccagctccatggtgaatggagtggtcaaacttctgaccaagccttgggatgtgatccccatggttacacaaattgcgatgaccgacacaacccctttcggccagcagagagtgtttaaagaaaaggtcgatacgcggacaccgaaagccaagcgcggcaccgctcaaatcatggaggtgaccgccagatggctctgggggttcctgagccggaacaagaaacccagaatctgtacacgggaagagtttacgcgcaaggttagatctaatgctgccattggagccgtgttcgtcgacgagaaccagtggaatagcgcgaaagaagctgtggaggacgatcggttttgggaccttgttcaccgcgaaagagagctgcacaagcagggcaaatgcgcgacctgcgtgtataacatgatggggaagcgggaaaagaaactcggagagttcggcaaggccaaagggtcccgcgctatctggtacatgtggctgggcgccagattcctggagtttgaagctctcggattcatgaatgaggatcattggttttctcgggaaaacagcctgtccggcgtcgagggggagggacttcacaagctgggctacattctccgcgacatctctaaaattcctgggggaaatatgtatgccgatgacacagcgggctgggataccagaatcacagaagacgatctgcagaacgaggccaagatcaccgacattatggaacccgagcatgcccttctggccaaaagcatcttcaagctcacataccaaaataaggtggtccgggtgcagcgccctgctaaaaacgggaccgttatggatgtgatttccagacgggaccagcgcggctctggacaggtcggcacgtatgggctgaatacctttacaaacatggaagcccaactgatcagacagatggagagcgagggaattttcctccccaacgaactggagaccccgaatcttgcgggccgggtgctggattggctcgaaaagtacggggtggagagactgaaacgcatggccatctccggagacgactgtgttgtgaagcctatcgatgaccggtttgctacagcccttaccgctctgaacgatatgggcaaagtcagaaaggacattccccagtgggaacctagcaaggggtggaatgattggcagcaagtgcccttctgctctcaccactttcatcagctcatcatgaaagacggccgcgagattgttgtgccttgtcggaaccaggatgagctggtcggcagagctcgcgtgtcccagggagctgggtggagcctgcgggaaacggcctgcctcggaaagtcttatgcgcaaatgtggcagctgatgtacttccacagacgcgaccttcggctggccgctaatgccatctgttccgccgtccccgtggattgggttccgacaagcagaaccacatggtccattcatgctcaccatcagtggatgaccacggaggacatgctctctgtgtggaaccgcgtctggatcgaagagaatccttggatggaagataaaacccggattagctcctgggaggacgtgccctatctgggcaagagagaggaccaatggtgcgggagccttatcggactgacagcccgggcgacctgggctacaaacatccaggttgccattaatcaggtgagacgcctcatcggcaacgaaaattactctgattacatgacctccatgaaacggtttaagaacgagagcgaacccgagggggccctgtggtga

SEQ ID NO: 18916 - RNA, 9879 nt, synthetic construct
  misc_feature 1..9879: note = derived and/or modified CDS sequence (opt5) from DENV-1__FJ461307__SS-prME
  source 1..9879: mol_type = other RNA
agcgtgaccatgctgctcatgctgatgcccacggcccttgctttccacctgacgaccagaggaggggagcctcatatgatcgtctccaagcaggaacggggaaaatctctcctgtttaagaccagcgccggagttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgactccggatgcgttatcaactggaaaggccgcgagctgaagtgtgggagcggaattttcgtgaccaatgaagtccacacatggaccgagcaatataagtttcaggccgattcccctaaacggctctctgcggccatcggcaaggcttgggaggaaggggtgtgcggcattagaagcgccacgcgcctggagaacatcatgtggaaacagatctccaacgaacttaatcatattctgctcgagaacgacatgaagttcacagttgtggtcggagacgtggctggcatcctggtgcaggggaaaaagatgattcggccgcaacccatggaatacaaatattcttggaaaagctggggaaaggccaaaatcattggcgccgatgtccaaaattccacctttatcatcgacgggcctaacacccccgagtgtcctgatgaccagagagcttggaatatttgggaggttgaagattacggattcggcatctttacaaccaacatttggctgaaacttcgcgacagctatacacaggtgtgcgatcaccggctcatgtctgcggccatcaaagactccaaggctgtgcacgccgatatgggctactggattgagagcgagaagaatgagacatggaagctggccagagcttctttcatcgaagtcaagacctgtatctggcccaaatcccatacactgtggagcaacggggtgctcgagtctgagatgattatcccgaagattcacggaggccctatcagccaacataattatcgccccgggtacttcacccagacagccggaccttggcacctgggcaaacttgaactggactttgatctctgcgaggggaccacggttgtggtcgacgaacactgcggaaaccggggcccctccctgagaaccacaaccgtgacaggcaagattatccatgagtggtgttgccggagctgtaccctgcctccccttcgcttcagaggggaggatggatgctggtacggcatggaaatccggccggttaaagagaaggaagagaatctcgtgaagtctatggtctccgcggggagcggagaagtggactccttttctctgggcctgctctgtattagcatcatgattgaggaggttatgagatcccgctggtctcggaaaatgctgatgacggggacacttgctgtgttctttctgctcatcatgggacagctgacctggaacgacctgattagactttgcatcatggtcggcgccaatgccagcgatcgcatgggcatggggacaacctatctggctctcatggccaccttcaagatgagacctatgtttgcggtgggactgctgttccggcgcctgacatccagagaagtgcttctgctcacgattggcctgtctctggtcgctagcgttgagcttcccaactccctggaagaactgggggacggactggccatgggcatcatgatcctcaaactgcttaccgattttcaaagctaccagctgtgggccacactcctgtctctgaccttcattaagacaaccttttcccttcactatgcttggaaaacgatggccatggtgctgagcatcgtgtctctcttccccctgtgtctctccacaaccagccagaagaccacatggctgcctgtccttctggggtctctgggatgcaagccgctcaccatgtttctgattgctgaaaataaaatctggggccggaagtcctggccccttaacgagggcattatggccgtggggatcgttagcatcctgctctccagcctgctcaaaaacgacgtgcctctggcgggaccccttattgccggcgggatgctgatcgcttgttacgtcatttctggaagctccgccgatctgtctctcgagaaggctgccgaagtgagctgggaggaagaggccgaacattccggcgcttctcacaatatcctggttgaggtgcaggacgatgggacaatgaaaattaaggacgaggaacgcgatgacacgcttaccatcctgctcaaagcgacactgctcgccgtcagcggagtgtatcctctgtccatccccgctacccttttcgtctggcatttctggcaaaagaagaaacagagatctggcgtgctgtgggatacacctagccctcccgaggttgaacgggccgtgctggacgatggcatttaccgcatcatgcagagagggctcctgggacggtcccaggtcggcgtgggggtttttcaagagaacgtgttccacaccatgtggcacgtcacgcgcggagccgtgcttatgtatcagggcaagagactggagcccagctgggcttctgtgaaaaaggacctcatttcctacgggggaggctggcggtttcagggcagctggaataccggggaagaggttcaggtcatcgccgtggaacccggcaagaaccctaagaatgtgcaaacagcgcccggcaccttcaagacaccggagggggaagtcggagctattgccctggactttaaacctggcacctctgggtcccccatcgtgaacagagagggaaagattgttggcctctacggcaatggggtggtcacaacgagcggaacctatgtgtccgccatcgctcaggccaaagcgtctcaggagggccctctgcccgaaatcgaggatgaagttttccgcaagcggaaccttacaattatggacctgcatcccgggagcggaaaaaccagacgctacctgcctgctatcgtgcgggaggccattaagagaaagctccgcaccctgatccttgccccgacacgggtcgtggcttccgaaatggccgaggctctgaaaggcatgcccattagatatcaaacgaccgccgttaagagcgagcacacagggaaagaaatcgtggatctcatgtgccatgcgacctttacaatgcgcctgctgtctcctgtccgggtgcccaattacaacatgatcattatggacgaggcccacttcaccgatccttccagcatcgctgccagaggctatatttctacgcgggtgggaatgggcgaagctgccgccatctttatgacagctacaccccctgggagcatggaggcgttcccgcagtccaatgccgtcattcaggacgaagaaagagatatccccgagagatcttggaacagcggatacgaatggatcaccgactttcctggcaagacagtttggttcgtgccctccattaaagctgggaatgatatcgccaactgtctccggaagaatggaaagcgcgtgattcagctttctagaaaaaccttcgacacagagtatcaaaagaccaaaaacaacgattgggactacgtcgtgacgacagacatcagcgaaatgggcgccaattttcgggctgatagagttattgaccctcgccggtgcctgaagcccgtgatcctgaaagatgggccggagagagtcattctcgccggccctatgcccgtgaccgttgcgtccgctgcccagcgccggggaagaatcggccgcaaccataataaggagggggaccagtacatctatatgggacagcccctgaacaatgatgaagaccacgcccactggacagaggctaagatgcttctggataacattaatacccctgaaggcatcattcccgccctcttcgagcctgaacgggagaaaagcgcggccatcgacggggagtacagactgcgcggagaagctagaaagacgtttgtggagctgatgcggcgcggcgatctcccggtctggctttcttataaagtggcctccgaagggttccaatacagcgacagacggtggtgctttgatggcgagcgcaacaatcaggtcctggaagagaacatggacgtggagatttggaccaaggaaggagagcgcaaaaagctgcggcccagatggctcgatgctcgcacatattccgaccctctggcccttcgggagttcaaagagtttgctgccggcagacgctctgttagcggggacctgatcctcgaaatcggaaagctgccccagcatctgacccagcgggcgcaaaatgccctcgataaccttgtgatgctgcacaattccgagcagggcgggagagcttaccggcatgccatggaggaactgcctgacacaattgagaccctcatgctgcttgctctgatcgccgtgctcacaggaggcgtcaccctgttctttctgtctggcaaggggctcggaaaaacgagcattggccttctgtgtgttatggcctccagcgtgctgctctggatggcttctgtggaaccccactggatcgcggcctccattatcctggagttctttcttatggtcctgctcatcccggagcctgatcgccagagaacaccccaggacaaccaactggcttatgtggttattgggctcctcttcatgatccttaccgtggccgccaatgaaatgggactgctggagaccacaaagaaagatctcggcattgggcacgtcgctgtggaaaaccatcaccatgccgcgatgctggacgtcgatcttcaccctgccagcgcttggaccctgtacgccgtggctacaacgatcattacccccatgatgcggcatacaatcgagaacaccacagccaatatttctctcaccgcgatcgccaaccaggctgccatcctgatgggactggacaagggctggcctatttccaaaatggatatcggcgttcccctccttgctctggggtgctacagccaggtgaatccgctgacgctcaccgccgctgtcctgatgcttgtggcccactatgcgattatcggacctggcctgcaagccaaggctacacgcgaagcccagaagagaaccgctgccgggattatgaaaaaccccacaatcgacggaatcgttgccattgatctcgaccccgtggtctacgatgcgaagtttgagaaacagctgggccagatcatgctgctcattctttgtacctctcaaatcctgctgatgcggacgacatgggctctctgcgagagcattaccctggccacagggcctcttaccaccctgtgggaaggatccccgggcaagttctggaatacaacgatcgctgtgtctatggccaacatcttccgcggcagctatctcgccggggctggactggccttttccctgatgaaaagcctcggcgggggaagacggggcaccggggcgcagggagagacacttggcgaaaagtggaagcgccagctgaatcagctgtccaaatctgagttcaacacctacaagagaagcggcattatggaagtggaccggtccgaggccaaagaggggctcaagagaggagaaacaaccaaacacgctgtttctcgcggcacggccaagctgcggtggtttgtcgagagaaatcttgtgaagcccgaagggaaagtgatcgacctgggatgtggccgcgggggatggagctattactgcgctggcctcaagaaagtcacagaggttaagggctataccaaagggggacctggccatgaggaacccattcctatggccacctacgggtggaacctggtgaagctgcactccggaaaagatgtgttctttattccccctgagaagtgtgacacactcctttgcgatatcggcgaatctagcccgaatcccaccatcgaggaagggcggacactgagagtcctgaagatggtggagccttggctccgcggaaaccaattctgtattaaaatcctgaatccctacatgccttccgttgtggagacgcttgaacagatgcagcggaagcatggcggcatgctggtcagaaaccccctcagccgcaattctacccacgagatgtattgggtgtcctgcgggacaggaaacatcgttagcgcggtgaatatgacctctcggatgctgctgaacagatttacaatggcccaccgcaaaccgacctacgaacgggacgtcgatctcggcgctgggacgagacatgtggccgtggagcctgaagtcgctaacctggacattatcggacagcgcattgagaatatcaagcacgagcataaatccacctggcactatgatgaagacaacccctacaagacatgggcctatcatggcagctacgaggttaagccctctgggtccgctagctccatggtgaatggagtggtcaaacttctgaccaagccttgggatgtgattcccatggttacacaaatcgccatgaccgacacaacccctttcggccagcagagagtgtttaaagaaaaggtcgatacgcggacaccgaaagcgaagcgcggcaccgcccaaatcatggaggtgaccgctagatggctctgggggttcctgagccggaacaagaaacccagaatttgtacacgggaagagtttacgcgcaaggttagatctaatgccgctatcggagccgtgttcgtcgacgagaaccagtggaatagcgccaaagaagcggtggaggacgatcggttttgggaccttgttcaccgcgaaagagagctgcacaagcagggcaaatgcgctacctgcgtgtataacatgatggggaagcgggaaaagaaactcggagagttcggcaaggccaaagggtcccgcgccatttggtacatgtggctgggcgctagattcctggagtttgaagccctcggattcatgaatgaggatcattggttttctcgggaaaacagcctgtccggcgtcgagggggagggacttcacaagctgggctacatcctccgcgacatttctaaaatccctgggggaaatatgtatgctgatgacacagccggctgggataccagaatcacagaagacgatctgcagaacgaggcgaagattaccgacatcatggaacccgagcatgcccttctggctaaaagcattttcaagctcacataccaaaataaggtggtccgggtgcagcgccctgccaaaaacgggaccgttatggatgtgatctccagacgggaccagcgcggctctggacaggtcggcacgtatgggctgaatacctttacaaacatggaagctcaactgattagacagatggagagcgagggaatcttcctccccaacgaactggagaccccgaatcttgccggccgggtgctggattggctcgaaaagtacggggtggagagactgaaacgcatggcgatctccggagacgactgtgttgtgaagcctattgatgaccggtttgccacagctcttaccgccctgaacgatatgggcaaagtcagaaaggacatcccccagtgggaacctagcaaggggtggaatgattggcagcaagtgcccttctgctctcaccactttcatcagctcattatgaaagacggccgcgagatcgttgtgccttgtcggaaccaggatgagctggtcggcagagctcgcgtgtcccagggcgccgggtggagcctgcgggaaacggcttgcctcggaaagtcttatgcccaaatgtggcagctgatgtacttccacagacgcgaccttcggctggcggccaatgctatttgttccgccgtccccgtggattgggttccgacaagcagaaccacatggtccatccatgcccaccatcagtggatgaccacggaggacatgctctctgtgtggaaccgcgtctggattgaagagaatccttggatggaagataaaacccggatcagctcctgggaggacgtgccctatctgggcaagagagaggaccaatggtgcgggagccttatcggactgacagctcgggccacctgggcgacaaacattcaggttgctatcaatcaggtgagacgcctcattggcaacgaaaattactctgattacatgatctccatgaaacggtttaagaacgagagcgaacccgagggggccctgtggtga

SEQ ID NO: 18917 - RNA, 9879 nt, synthetic construct
  misc_feature 1..9879: note = derived and/or modified CDS sequence (opt5) from DENV-1__FJ410213__SS-prME
  source 1..9879: mol_type = other RNA
agcgtgaccatgctgctcatgctgatgcccaccgcccttgctttccacctgacgaccagaggcggggaacctcatatgatcgtgacaaagcaggaacggggaaaatccctcctgtttaagacctctgccggcgttaatatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctggggagcctcggatgcaaaccgctgacaatgtttcttattacggagaataagatctggggcagaaaatcttggcccctgaacgaaggcattatggctgtgggggttgtgtccatcctcctgagctccctcctgaaggatgacgtccctcttgccggacccctgatcgcgggcgggatgctgattgcctgttatgtgatcagcggatctagcgctgatctctccctggagaaagccgctgaggtttcttgggaagaggaagccgagcacagcggcgcctcccataacattcttgtggaagtccaggacgatgggaccatgaagatcaaagacgaggagcgggatgacacactgaccattctcctgaaggctacactcctggcggtgtctggagtctaccctcttagcatccccgccaccctgttcgtgtggtatttttggcaaaagaaaaagcagcgctccggcgttctgtgggatacgccttctcccccggaagtggagagagctgtcctcgacgacggcatctaccggattatgcagcgcgggctgcttggaagaagccaggtgggcgttggggtgttccaagaaaatgtcttccacaccatgtggcacgtgacacggggagccgtgctgatgtatcagggcaaacgcctcgagccttcctgggccagcgttaagaaagatctgatctcttacgggggaggctggagactccagggctcctggaacaccggggaggaagtccaggtgattgctgtggagcccggaaagaatcctaagaacgtccaaacagcccccggcacctttaaaacaccggaaggggaggtgggagcgatcgctctggacttcaagcctggcacgagcgggtctcccattgttaatcgggaaggaaaaatcgtgggcctttacggcaacggggtcgtgaccacatccggaacctatgttagcgccattgcccaggctaaggcctcccaggagggccctctgcccgagatcgaagatgaggtgtttagaaaacgcaatctgaccatcatggacctccatcccgggtctggaaagacacggagatacctgcctgcgattgtccgcgaagctatcaagcggaaacttagaacgctgattctcgccccgacccgcgtggttgccagcgagatggctgaagccctgaagggcatgcccatccggtatcaaacaaccgctgtgaaatccgagcacacagggaaggagattgtcgatctgatgtgccatgccaccttcacgatgagactccttagccctgtgcgcgtgcccaactacaatatgatcatcatggacgaagcgcactttacagatccttcttccattgccgctcggggctatatcagcaccagagtcggaatgggcgaggccgctgccattttcatgaccgccacaccccctgggtctgttgaggcttttccgcagagcaacgcggtgatccaggacgaggaacgggatattcccgagcgctcctggaactctggatacgagtggatcaccgacttccctggcaaaacagtgtggtttgtccccagcatcaagtccgggaacgatattgccaattgtctgagaaagaacggaaaacgggtgatccagctgtctcgcaagaccttcgacacggaatatcagaagaccaagaataacgactgggattacgttgtgaccacagacattagcgagatgggcgctaactttagagccgatcgggtcatcgaccctagacgctgcctcaaacccgtgattctgaaggatgggccggaacgggttatccttgccggccctatgcccgtgaccgtcgcttccgccgcgcagagacgcggacggattggcagaaatcataacaaggagggggaccagtacatctatatgggacagcccctgaataacgatgaggaccacgctcactggacggaagccaaaatgctcctggataatatcaacacccctgagggcattatccccgccctgttcgaacctgagcgcgaaaagagcgctgccattgacggggagtaccggctcagaggagaggcgcgcaaaacattcgtggaacttatgagacggggcgatctgccggtctggctgtcttataaggtggcctccgaggggtttcaatacagcgaccgcagatggtgcttcgatggcgaacggaataaccaggttctcgaggaaaatatggacgtggagatctggaccaaagagggagaacgcaagaaactgagaccccggtggcttgacgctagaacatattccgatcctctggccctccgcgagtttaaggagttcgctgccggccggagatctgtgagcggggacctgattctggagatcggaaagctcccccagcatcttacccagcgcgctcaaaacgccctggataatctggtcatgctccacaactccgaacagggcgggcgggcgtacagacatgccatggaggagctgcctgacacaatcgaaacccttatgctgctcgctctgattgccgttctgacgggaggcgtgacactctttttcctttctggccgggggctgggaaaaaccagcatcggcctgctctgtgtgatggcttccagcgtcctgctttggatggcctctgtggagccccactggattgccgcttccatcattctggaatttttcctcatggttctgctgatcccggagcctgatcgccagagaacaccccaggacaatcaactcgcgtatgtggtcatcgggcttctgtttatgattctgacagtggccgctaacgagatgggactcctggaaaccacaaagaaagatcttggcatcgggcacgtcgccgtggagaatcatcaccatgccacgatgctggacgttgatctccaccctgctagcgcctggaccctgtacgcggtggccacaaccattatcacacccatgatgcggcataccattgaaaacacgaccgctaacatctctctgacagccattgctaatcaggccgcgatcctcatgggacttgacaagggctggcctatctccaaaatggatattggcgtccccctgctggccctcgggtgctacagccaggtgaacccgctgacccttacagctgccgttctgatgctcgtggctcactatgccatcattggacctggcctgcaagctaaggccacccgcgaggcgcagaagagaacggccgctgggatcatgaaaaatcccacagtcgacggaattgtggccatcgatctggaccccgtggtttacgacgctaagttcgaaaaacagctcggccagatcatgcttctgattctgtgtacctctcaaatcctcctgatgcggacaacctgggccctttgcgagagcattaccctggccacagggcctctcacgaccctgtgggagggatccccgggcaagttttggaacacaaccatcgcggtctctatggctaatattttccgcggcagctatctggccggggctggactcgccttttcccttatgaaaagcctgggcgggggaagacggggcacaggggcccagggagaaaccctgggcgagaagtggaagcgccagctcaaccagctgtccaaatctgagttcaatatctacaagagaagcggcatcatggaggtggatcggtccgaagctaaagaggggcttaagagaggagagacgacacgccacgccgtgtctcggggcaccgcgaaactgagatggttcgtcgaacgcaacctcgttaagcccgaggggaaggtgattgacctgggatgtggcagagggggatggagctattactgcgccggcctgaaaaaggtgaccgaagtcaaaggctatacaaaagggggacctggccatgaggaacccatccctatggctacctacgggtggaatctcgtgaaacttcactccggaaaggatgtctttttcacaccccctgagaaatgtgacacgctgctgtgcgatattggcgagtctagcccgaaccccaccatcgaagaggggagaacactccgcgtgctgaagatggtcgaaccttggcttcggggaaatcaattttgtattaagatcctgaacccctacatgccttccgtggttgagaccctcgagcagatgcagagaaaacatggcggcatgctggtgcgcaatcccctgagccggaactctacacacgaaatgtattgggtctcctgcgggaccggaaatattgtgagcgccgtgaacatgacgtctagaatgctcctgaatcgcttcaccatggctcaccggaagccgacatacgagagagacgtcgatcttggcgccgggacccgccatgttgcggtggaacctgaggtggccaacctggacatcatcggacagagaattgaaaacatcaaacacgagcataagtccacatggcactatgatgaggacaatccctacaaaacctgggcttatcatggcagctacgaagtcaagccctctgggtccgccagctccatggtgaacggagttgtgaagctcctgacaaaaccttgggatgtcattcccatggtgacccaaatcgctatgacggacacaaccccttttggccagcagcgggttttcaaggagaaagtggacacccgcacaccgaaggccaaaagaggcacggctcaaattatggaagtcaccgcccggtggctttgggggtttctgagcagaaataagaagccccggatctgtacacgcgaggagttcaccagaaaagtgcggtctaacgcggccatcggagctgtttttgtggatgagaatcagtggaacagcgccaaggaggctgtcgaagacgagcgcttctgggatctcgtgcagaaagaaagagagctgcacaagcagggcaaatgcgccacatgcgtctataatatgatggggaagcgggaaaagaaactgggagagtttggcaaggccaaagggtcccgcgcgatttggtacatgtggctcggcgctagattcctggagtttgaagcccttggattcatgaacgaggaccactggttctctcgggaaaatagcctgtccggcgtggagggggagggactccataagctgggctacatccttcgcgatatttctaaaatccctgggggaaacatgtatgccgacgataccgctggctgggacacaagaattaccgaagatgacctgcaaaatgaggccaagatcacggatatcatggaacccgagcacgctctcctggccaccagcatttttaaactgacataccagaacaaggttgtgcgggtccagcgccctgcgaagaatgggaccgtgatggacgtgatctccagacgggatcagcgcggctctggacaagttggcacatatgggctcaacaccttcacgaatatggaagcccagctgattagacagatggagagcgagggaatctttcttccctccgaactggagacaccgaacctcgctgaacgggtgctggactggcttgagaaatacggcgtcgaaagactgaagcgcatggccattagcggggacgattgtgtggttaaacctatcgacgatcggttcgctaccgccctcacagcgctgaacgacatgggaaaggtgagaaaagatatcccccagtgggagccttctaagggctggaatgactggcaacaggtccccttttgctcccatcacttccaccagctgattatgaaggatgggcgcgagatcgtggtcccttgtcggaaccaggacgaactcgtgggcagagcccgcgttagccaaggagctggctggtctctgcgggagaccgcctgccttgggaaatcctatgctcagatgtggcagctgatgtactttcatagacgcgatctccggctggccgctaatgccatttgtagcgcggtgcccgtcgactgggtgccgacgtccagaaccacatggtctatccacgcccatcaccaatggatgaccacagaagatatgcttagcgtttggaaccgcgtgtggattgaggaaaatccttggatggaggacaagacccatgtctccagctggggagacgtgccctatctgggcaaacgggaggatcagtggtgcgggtctctcatcggactgacagctagagccacctgggcctccaacattcaggtggctatcaatcaggttcggagactgatcggcaacgaaaattacctcgactacatgacgagcatgaagcgcttcaaaaacgagggggatcccgaaggcgccctgtggtga

SEQ ID NO: 18918 - RNA, 9879 nt, synthetic construct
  misc_feature 1..9879: note = derived and/or modified CDS sequence (opt5) from DENV-1__FJ461308__SS-prME
  source 1..9879: mol_type = other RNA
agcgtgacaatgctgctgatgctgatgcccacagcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagagccgaaacctggatgagctccgagggcgcttggaaacagattcagcgggttgaaacgtgggccctccgccaccccggctttacagtgatcgcgctgttccttgcccatgctattgggacctctatcacacagaagggaatcatttttatcctgctcatgctggtcacccctagcatggccatgagatgcgtgggcattgggtcccgggatttcgttgagggacttagcggcgctacctgggtggacgtcgtgctggagcacgggtcttgtgtgacaacgatggccaaggataaacccaccctcgacatcgaactgctgaagacagaggtcaccaaccctgcggttctccgcaaactgtgcattgaagccaagatctccaatacaaccacggatagcagatgtccgacacaaggagaggctacccttgtggaagaacaagacgccaactttgtgtgccggcgcaccttcgtcgatagaggctggggcaatgggtgtggactgtttggcaaagggtctctcattacatgcgctaagttcaagtgcgtgaccaaactggagggaaagacagttcagtacgaaaaccttaaatattccgtgatcgtcacggtgcacaccggcgaccagcatcaagttgggaatgagagcacagaacacggaaccacagccaccatcacgccccaggccccttctaccgagattcagctgacagactacggcgctctcaccctggattgtagcccccggacaggcctggactttaacgaaatggtgctcctgaccatgaaggagaaaagctggcttgtccataagcagtggttcctggatctccctctgccctggacgtccggggcgtctacaagccaagagacctggaatcgcaaagaccttctggtgacatttaagaccgcccacgctaagaaacaggaagtcgtggttctcggatcccaggagggcgccatgcacaccgccctgacaggggctacggaaatccaaaccagcggaacaaccacaattttcgccggccatctgaagtgcagactcaaaatggataagctgacccttaaagggatgtcttatgtgatgtgtacgggctccttcaagctggagaaggaagtcgcggagacacagcacggaaccgtgctcgttcagatcaaatacgagggcaccgacgctccgtgcaagattccttttagcacacaggatgaaaaaggggtgacccaaaacggacggctgatcacagccaatcccatcgtcacggacaaggagaaacctgtgaacattgaagccgagccgcccttcggcgagtcttgtatcgtgattggggctggagaaaaggccctgaaacttagctggtttaaaaagggctcctctatcgggaaaatgttcgaggctaccgccagaggcgcgcgccggatggccattctcggagatacagcttgggactttggcagcatcgggggagttttcacctccgtcggcaagctggtgcatcagatctttgggacagcctatggagtgctgttcagcggcgtctcttggaccatgaaaattgggatcggcgtgctcctgacgtggcttggactcaattccagaagcacctctctctccatgacatgcattgctgttggcctggtgaccctgtaccttggggtcatggtgcaggccgatagcggatgtgttatcaactggaagggccgcgaactcaagtgcgggtccggaatttttgtgacaaatgaggtccacacctggacagaacagtacaaattccaagcggactctcctaagcggctgagcgccgctatcggcaaagcctgggaggagggggtgtgtggcattagatccgctacccgcctggaaaacatcatgtggaagcagatctctaacgagctcaatcatattctgcttgaaaacgacatgaaatttacggttgtggtcggagatgtggccggcatcctggcccaggggaagaaaatgattcggccgcagcccatggagcacaagtatagctggaagtcctggggaaaagctaagatcattggcgcggacgtgcaaaatacaaccttcatcatcgatgggcctaacacccccgaatgccctgacgatcagagagcctggaatatttgggaggtcgaggactacggatttggcatcttcacaaccaacatttggctcaaactgcgcgatagctatacgcaggtttgtgaccaccggctgatgtctgctgccatcaaggattccaaagccgtgcatgctgacatgggctactggattgaaagcgagaagaatgaaacatggaaacttgccagagcgtctttcatcgaggtgaaaacctgcatctggcccaagtcccacacactctggagcaacggggtcctggaatctgagatgattatcccgaaaatttatggaggccctatcagccagcataattaccgccccgggtattttacccaaacagctggaccttggcacctgggcaagctcgagctggatttcgacctttgcgaagggaccacggtggttgtggatgagcactgtggaaaccggggcccctccctgagaaccacaaccgtcacaggcaaaattatccatgaatggtgctgtcggagctgcaccctccctcccctgcgctttaagggggaggacggatgttggtacggcatggagatcagaccggtgaaggaaaaagaggaaaatctggttaagtctatggtgtccgccgggagcggagaggtcgactccttctctcttggcctcctgtgcattagcatcatgattgaagaggtgatgcggtccagatggtctcgcaaaatgctgatgacggggacactcgccgtctttttcctgcttatcatgggacagctgacctggaacgatctcattcggctgtgtatcatggtgggcgctaatgccagcgacagaatgggcatggggacaacctacctggcgcttatggctacctttaagatgcgccctatgttcgccgtcggactgctctttagacggctgacatcccgcgaggtgctcctgcttacgattggcctgtctctcgtggccagcgtcgaactgcccaactccctggaggaacttggggatggactggctatgggcatcatgatcctcaaactgctcaccgacttccagagccaccaactgtgggccacacttctgtctctcacctttattaagacaaccttctccctgcattatgcttggaagacgatggccatggttctgagcatcgtgtctctttttcccctgtgcctctccacaaccagccagaaaaccacatggctgcctgtgctcctggggtctcttggatgtaagccgctgaccatgttcctgattgcggagaataaaatctggggcagaaagtcctggcccctcaacgaaggcattatggccgtcgggatcgtgagcatcctgctttccagcctgctcaaaaacgatgttcctctggctggacccctcattgccggcgggatgctgatcgcttgctacgtgatttctggaagctccgccgacctttctctggagaaggccgctgaggtcagctgggaagaggaagcggagcactccggcgcctctcataatatcctggtggaagttcaggatgacgggacaatgaaaattaaggatgaggagcgggacgatacgctcaccatcctgcttaaggctacactgctcgccgtgagcggagtctatcctctgtccatccccgccaccctcttcgtgtggtacttttggcagaaaaagaaacaacgctctggcgtcctgtgggacacaccttcccctcccgaagtggagagagctgttcttgatgacggcatttatcggatcatgcagcgcgggctgctgggaagatcccaggtgggcgtcggggtgttccaggaaaacgtttttcacaccatgtggcacgtgacgcggggagccgtcctcatgtaccaaggcaagcgcctggagcccagctgggcgtctgtgaaaaaggaccttatttcctatgggggaggctggagactgcagggcagctggaataccggggaggaagtgcaggttatcgctgtcgagcccggaaagaaccctaaaaatgtgcagacagcccccggcaccttcaagacatctgaaggggaggtgggagccattgctctcgattttaaaccgggcacctccgggagccctatcgtcaaccgggaaggaaagattgtgggcctgtacggcaatggggttgtgacaacgtccggaacctacgtctctgccatcgcgcaagctaaagccagccaggagggccccctccctgagatcgaagacgaggtgttcagaaagcgcaacctgacaattatggatcttcatcccgggtccggaaagacccggagatatctgcccgccatcgttcgcgaagctattaaacggaagctgagaaccctcatcctggcccctacacgcgtggtcgctagcgagatggccgaagcgcttaaaggcatgccgattcggtaccagacgaccgccgtgaagtctgagcacacagggaaagagatcgttgacctgatgtgtcatgctacctttacaatgagactcctgtcccccgtgcgcgtccctaattataacatgatcattatggatgaagcccacttcaccgaccccagctctatcgctgcccggggctacattagcacgagagtgggaatgggcgaggccgctgcgatctttatgacagccacccctcccgggtccgtggaggctttccctcaatctaatgccgtcattcaggatgaagaacgggacatcccggagcgcagctggaactccggatatgagtggatcaccgattttcccggcaagacagtttggttcgtgccttctattaagagcgggaatgacatcgccaactgcctgcgcaagaatggaaagcgggtgattcagctctcccgcaaaaccttcgatacagaataccagaagaccaaaaacaacgactgggactatgtcgtgacgacagatatcagcgagatgggcgctaattttagagccgaccgggttattgatcccagacgctgccttaagcctgtgatcctgaaggacgggcccgaacgggtcattctggcgggcccgatgcctgtgaccgttgcttctgccgcccaaagacgcggacggatcggcagaaaccataataaagagggggatcagtacatctacatgggacagcccctcaacaatgacgaggatcacgctcactggacagaagccaagatgctgcttgacaacattaatacccccgagggcatcattcctgcgctgttcgaacccgagcgcgaaaaatccgccgctatcgatggggagtatcggctcagaggagaggcccgcaagacgtttgtggaactgatgagacggggcgacctgcctgtctggctcagctacaaagtggcttccgaggggttccagtattctgatcgcagatggtgttttgacggcgaacggaacaatcaagtccttgaggaaaacatggatgtggagatttggaccaaggagggagaacgcaaaaagctgagaccgcggtggctggacgccagaacatacagcgaccccctcgctctgcgcgagttcaaggaatttgccgcgggccggagatccgtttctggggatcttatcctggagatcggaaaactccctcagcatctgacccagcgcgcccagaatgctctggacaacctcgtgatgcttcacaatagcgaacaaggcgggcgggcctatagacatgctatggaggagctgcccgatacaattgaaaccctgatgctcctggcccttatcgccgtgctgacaggaggcgtcaccctcttctttctgtccggccgggggctgggaaagacgagcattggcctcctttgcgttatggcttcttccgtgctgctgtggatggcgagcgtggagcctcactggatcgccgcttctattatcctcgagttctttctgatggtccttctgatccccgagccggaccgccagagaacacctcaggataaccagctcgcctacgtggttattgggctgctgttcatgatcctcaccgtggccgctaatgagatgggacttctggaaaccaccaagaaggacctgggcattgggcacgtcgccgtggagaaccatcaccatgcggccatgctcgatgtcgacctgcaccccgcttccgcctggaccctttatgctgtggccacaacgatcattacccctatgatgcggcatacaatcgaaaacaccacagcgaatattagcctgaccgccatcgctaaccaagccgctatcctcatgggactggataaaggctggcccatttctaagatggacatcggcgttcctctgctcgcccttgggtgttacagccaggtgaatcccctgacgctgaccgctgccgtcctcatgctggtggcgcactacgccattatcggaccgggccttcaggctaaggccacacgcgaggctcagaagagaaccgccgccgggattatgaagaaccctacagttgatggaatcgtggcgatcgacctggatcccgtcgtgtatgacgctaaatttgaaaagcagctcggccagattatgctgctgatcctctgcacctcccagattcttctgatgcggacgacatgggccctgtgtgagtctatcaccctcgctacagggcccctgaccaccctttgggagggaagccctggcaaattctggaatacaacgattgccgtgtccatggccaacatcttccgcggcagctacctggctggggccggactcgcgttttccctgatgaagtctctgggcgggggaagacggggcaccggggcccaaggagaaacactcggcgagaagtggaaacgccagcttaatcagctgagcaagtccgagttcaacacctataaaagatctggcatcatggaggttgaccggagcgaagctaaggaggggctgaaaagaggagagacaaccaagcacgccgtctcccgcggcacggctaagctccggtggtttgtggaaagaaatctggtgaaaccggaggggaaggtcattgatcttggatgcggccgcgggggatggtcttactattgtgccggcctgaaaaaggttacagaagtgaaaggctacaccaaagggggacccggccatgaggaacctatccccatggcgacctatgggtggaacctcgtgaaactgcacagcggaaaggacgtcttctttattcctcccgagaagtgcgatacactgctctgtgacatcggcgagtccagccctaatccgaccattgaagaggggcggacacttagagtgctgaaaatggttgaaccctggctgcgcggaaaccagttctgcatcaagattctcaatccttacatgccctctgtggtcgagacgctggagcaaatgcagcggaaacatggcggcatgcttgtgagaaaccctctgtcccgcaatagcacccacgaaatgtactgggtttcttgtgggacaggaaacatcgtgtccgccgtcaatatgaccagccggatgctcctgaacagatttacaatggctcaccgcaagcccacctatgagcgggatgtggacctgggcgccgggacgagacatgtggctgtcgaaccggaggttgccaacctcgatatcattggacagcgcatcgaaaatattaaacacgagcataagtctacctggcactacgacgaggataacccttataagacatgggcttaccatggctcctatgaagtgaaacccagcgggtccgccagctctatggtgaatggagtcgtgaagctgcttaccaaaccctgggacgttatccctatggtgacacagattgcgatgaccgatacaacccccttcggccaacagagagtctttaaggagaaagtggacacgcggacacctaaggccaagcgcggcaccgctcagatcatggaagttaccgccaaatggctgtgggggttcctcagcagaaacaagaaaccgcggatctgcacaagagaggaatttacgcggaaggtgcgctccaatgctgccattggagccgtcttcgtggacgagaaccaatggaactctgcgaaagaggctgttgaagatgagagattttgggacctggtgcaccgggaacgcgagcttcacaagcagggcaagtgcgccacctgtgtctacaacatgatggggaaaagagaaaagaaactgggagagttcggcaaggccaaagggagccgggctatctggtatatgtggctcggcgcccgcttcctggagtttgaagctctgggattcatgaatgaggatcattggttttccagagaaaactctctcagcggcgtggagggggagggactgcacaaacttggctacattctgcgggacatctccaaaattcccgggggaaatatgtacgccgatgacacagcgggctgggatacccgcatcacagaagacgatctccagaacgaggccaagatcaccgacattatggaacctgagcatgctctgcttgccaagtctatcttcaaactgacatatcagaataaggtcgtgagagttcaacggcccgctaaaaacgggaccgtgatggatgtcattagccgcagagaccagcggggctccggacaggtgggcacgtacgggctcaatacctttacaaacatggaagcccagctgatccgccaaatggagagcgagggaattttctctccttccgaactggagacccccaacctcgcgggcagagtgctggattggcttgaaaagcacggggttgagcggctgaaaagaatggccatcagcggagacgactgcgtggtcaagccgatcgatgaccgctttgctacagccctcaccgctctgaatgatatgggcaaggtgcggaaagacattcctcagtgggaaccctctaaggggtggaacgattggcagcaggttcctttctgttcccaccattttcaccaacttatcatgaaagacggcagagagattgtggtcccctgccgcaatcaggatgagctggtgggacgggccagagtcagccagggcgctgggtggtccctccgcgaaacggcctgtctgggaaagtcttatgcgcagatgtggcaactgatgtacttccatcggagagacctccgcctggccgctaacgccatctgcagcgccgtgcctgttgattgggtgcccacatcccggaccacatggagcattcacgctcatcaccagtggatgaccacggaggacatgctttctgtctggaatagagtgtggatcgaagagaacccgtggatggaagataaaacccacatttccagctggggcgacgttccttatctggggaagcgcgaggaccagtggtgtggatctctcatcggcctgacagcccgggcgacctgggctacaaatatccaagtggccattaaccaggtcagacggcttatcgggaatgagaactacctggattatatgaccagcatgaagagatttaaaaatgaatccgaccccgagggcgccctctggtga

SEQ ID NO: 18919 - RNA, 9879 nt, synthetic construct
  misc_feature 1..9879: note = derived and/or modified CDS sequence (opt5) from DENV-1__FJ461310__SS-prME
  source 1..9879: mol_type = other RNA
agcgtgaccatgctgctcatgctgatgcccaccgctcttgctttccacctgacgacccggggcggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgagcaccggcgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctgattacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagttcacagtggttgtgggagatgtcgctggcatcctcgcccaggggaaaaagatgattcggccgcaacccatggagtacaaatattcttggaaaagctggggaaaggccaagatcatcggcgctgacgtgcagaataccacctttattatcgatgggcctaacacacccgaatgtcctgacgatcagagagcgtggaatatttgggaggtggaggactacggattcggcatctttaccacgaacatttggctgaagctgcgcgattcctatacacaggtctgcgaccaccggcttatgagcgccgctatcaaagattctaaggccgttcacgccgacatgggctactggatcgaatccgagaaaaatgaaacctggaagctcgctagagccagcttcattgaggtgaagacatgtatctggcccaaatctcataccctgtggtccaacggggtgctggaaagcgagatgattatcccgaagatttatggaggccctatctctcaacacaattaccgccccgggtacttcacacaggcggctggaccttggcatctcggcaaactggagcttgattttgacctgtgcgaagggaccacggtcgtggttgatgagcactgcggaaaccggggccccagcctcagaaccacaaccgtgacaggcaagatcattcacgaatggtgttgccggtcctgtaccctgcctcccctgcgcttcagaggggaggacggatgctggtatggcatggagatccggccggtcaaagaaaaggaggaaaatcttgtcaagagcatggtttctgccgggtccggagaggtggacagcttttccctcggcctgctgtgtatttctatcatgattgaagaggtcatgagaagccgctggtcccggagaatgctcatgacggggacactggccgtgttctttcttctgatcatgggacagctcacctggaacgatctgattcgcctgtgcatcatggttggcgctaatgcctctgacagaatgggcatggggacaacctaccttgcgctgatggctaccttcaaaatgcggcctatgtttgccgtgggactcctgttccgcagactcacaagccgggaggtcctgcttctgacgatcggcctctccctggtggcctctgtggaactgcccaacagccttgaggaactgggggatggactcgctatgggcattatgatcctgaagctcctgaccgactttcaatcccatcagctttgggccacactgctcagcctgaccttcattaaaacaaccttttctctgcactatgcttggaagacgatggccatggtcctttccatcgttagcctgttccccctctgtctgtctacaacctcccagaaaaccacatggctccctgtgctgcttgggagcctgggatgcaagccgctgaccatgtttctcattgcggagaataagatctggggccgcagatcttggcccctgaacgaaggcatcatggccgtggggattgtctccatccttctgagctccctcctgaaaaacgatgtgcctctcgctggacccctgattgccggcgggatgcttatcgcttgttacgttattagcggatctagcgccgacctgtccctggagaaggccgctgaggtgtcttgggaagaggaagcggagcatagcggcgcctcccacaatatcctcgtcgaagtgcaggatgacgggacaatgaaaatcaaggatgaggagcgggacgatacgctgaccattcttctgaaagctacactcctggccgtttctggagtgtatcctctcagcatccccgccaccctgttcgtctggtacttctggcaacgcaagaaacagagatccggcgtgctttgggacacaccttctcccccggaagtcgagcgggctgtgctggatgacggcatttatcgcatcatgcagagagggctgctcggacggagccaggttggcgtgggggtctttcaagaaaacgtgttccataccatgtggcacgttacgagaggagccgtgctgatgtaccagggcaagcgccttgagccttcctgggcgagcgtcaagaaagacctgatttcttacgggggaggctggcggctccagggctcctggaataccggggaggaagtccaggtgatcgctgttgagcccggaaagaaccctaaaaatgtccaaacagcccccggcacctttaagacaccggaaggggaggtgggagccattgctctggatttcaaacctggcaccagcgggtctcccatcgtgaacagagaaggaaagatcgtcggcctctatggcaatggggtggttacaacgtccggaacctacgtgagcgccattgcgcaggctaaggcctcccaggagggccctctgcccgagatcgaagacgaggtctttcgcaaacggaaccttacaattatggatctgcaccccgggtctggaaagaccagacgctatctgcctgccatcgtgcgggaagctattaaaagaaagctccgcaccctgatccttgccccgacacgggttgtggctagcgagatggccgaagcgctgaaaggcatgcccatcagataccaaacgaccgccgtcaagtccgagcatacagggaaggagattgtggacctcatgtgccacgctaccttcacaatgcggctgctgagccctgttcgcgtgcccaattataacatgatcattatggatgaagcccattttaccgacccttcttccatcgctgccagaggctacattagcacgcgggtcggaatgggcgaggccgctgcgatcttcatgacagccacaccccctgggtctgtggaggcttttccgcagagcaatgccgtgatccaggatgaggaacgcgacattcccgagagatcctggaactctggatatgagtggatcaccgatttccctggcaaaacagtctggtttgttcccagcattaagtccgggaatgacatcgccaactgtctccggaaaaatggaaagagagtgattcagctttctcgcaaaaccttcgatacagaataccaaaagaccaagaacaacgactgggactacgtggtcacgacagatatcagcgagatgggcgctaatttccgggccgacagagtgattgatcctcgccggtgcctgaaacccgttatcctgaaggacgggccggaaagagtgatcctcgcgggccctatgcccgtcaccgtggcttccgccgcccagcgccggggaagaattggccgcaaccacaataaagagggggatcagtatatctacatgggacagcccctgaacaatgacgaggatcatgctcactggacagaagccaagatgcttctggacaacattaatacccctgagggcatcattcccgcgctctttgaacctgagagagaaaagagcgccgctatcgatggggagtatcggctgcgcggagaggccagaaagacgttcgttgagctgatgcggcgcggcgacctcccggtgtggctttcttacaaggtcgcttccgaggggtttcaatatagcgatagacggtggtgcttcgacggcgaaagaaacaatcaggtgctggaggaaaacatggatgtcgagatctggaccaaagagggagaacgcaagaaactgcggcccagatggctcgacgcccgcacatactccgaccctctggcccttcgggagtttaaggagttcgccgcgggcagacggtctgtgagcggggatctgattctcgagatcggaaaactgccccagcacctgacccagcgcgcccaaaatgctctcgacaaccttgttatgctgcataattccgaacagggcgggagagcctatcggcacgctattgaggagctgcctgatacaatcgaaaccctcatgctgcttgccctgattgccgtgctcacaggaggcgtgaccctgtttttcctgtctggccgcgggctcggaaagacgagcatcggccttctgtgtgtcatggcttccagcgttctgctctggatggcgtctgtggagccccattggatcgccgcttccattatcctggaatttttccttatggtgctgctcattccggagcctgacagacagcggacaccccaggataaccaactggcctacgtcgtgatcgggctgctctttatgattcttaccgttgccgctaatgagatgggactgctggaaaccaccaaaaaggacctcggcatcgggcacgtggccgtcgagaaccaccatcacgcggccatgctggatgtggaccttcatcctgctagcgcctggaccctgtacgctgtcgccacaacgattatcacccccatgatgcgccacacaatcgaaaacaccacagcgaatatttctctcaccgccatcgctaaccaggccgctattctgatgggactggataagggctggcctatctccaaaatggacattggcgtgcccctccttgccctggggtgctatagccaggttaatccgctgacgctcaccgctgccgtgctgatgcttgtcgcgcattacgccatcatcggacctggcctgcaagctaaggccacaagagaggctcagaaacggaccgccgccgggattatgaagaaccccacagtggatggaatcgttgcgattgacctcgatcccgtggtctatgacgctaaattcgaaaagcagctgggccagatcatgctgctcattctttgtacctctcaaatcctgctgatgcgcacgacatgggccctctgcgagagcatcaccctggctacagggcctcttaccaccctgtgggagggatccccgggcaagttttggaatacaacgattgccgtgtctatggccaacatcttcagaggcagctacctcgctggggccggactggcgttctccctgatgaaaagcctcggcgggggacggagaggcaccggggcccagggagaaacacttggcgagaagtggaaacgccagctgaatcagctgtccaagtctgaatttaacacctataaacggagcggcattatggaggtggacagatccgaagctaaggaggggctcaagcgcggagagacaaccaaacacgccgtttctcggggcacggctaagctgagatggttcgtcgaacgcaatcttgtgaaacccgaggggaaggtgatcgatctgggatgtggcagagggggatggagctactattgcgccggcctcaaaaaggtcacagaagttaagggctacaccaaagggggacctggccacgaggaacccattcctatggcgacctacgggtggaacctggtgaagctgcattccggaaaagacgtgtttttcattccccctgagaagtgtgatacactcctttgcgacattggcgagtctagcccgaatcccaccatcgaagaggggagaacactgcgcgtcctgaaaatggtggaaccttggctccggggaaaccaattttgtatcaagattctgaatccctatatgccttccgttgtggagacgcttgagcagatgcagagaaaacacggcggcatgctggtccgcaaccccctcagcagaaattctacccatgaaatgtactgggtgtcctgcgggacaggaaacatcgttagcgccgtgaatatgacctctagaatgctgctgaaccgcttcacaatggctcacagaaagccgacctatgagcgggatgtcgacctcggcgccgggacgcgccacgtggctgtggaacctgaggtcgccaacctggatattatcggacagagaattgaaaatatcaagcatgagcacaaatccacctggcattacgacgaggataacccctataagacatgggcttaccacggcagctatgaagttaaaccctctgggtccgccagctccatggtgaatggagtggtcaaacttctgaccaaaccttgggacgtgatccccatggttacacaaattgcgatgaccgatacaaccccttttggccagcagcgggtgttcaaggagaaggtcgacacgagaacaccgaaagccaagcggggcaccgctcaaatcatggaagtgaccgccaaatggctctgggggtttctgagccgcaacaagaaacccagaatttgtacacgggaggagttcacgcgcaaggttagatctaatgctgccatcggagccgtgtttgtcgacgagaaccagtggaatagcgcgaaggaggctgtggaagatgagcggttctgggaccttgttcatcgcgaaagagagctgcacaaacagggcaagtgcgctacctgcgtgtacaacatgatggggaaacgggaaaagaaactcggagagtttggcaaggccaaggggtcccgcgctatttggtacatgtggctgggcgccagattcctggagttcgaagctctcggatttatgaatgaggatcactggttctctcgggaaaacagcctgtccggcgtcgagggggagggacttcataaactgggctatatcctccgcgacatctctaagattcctgggggaaatatgtacgccgatgacacagcgggctgggataccagaatcacagaagacgatctgcagaacgaggcccggattaccgacatcatggaacccgagcacgcccttctggccaaaagcatttttaagctcacatatcaaaataaagtggtccgcgtgcagagacctgctaagaacgggaccgttatggatgtgatctcccggagagaccagcgcggctctggacaggtcggcacgtacgggctgaataccttcacaaacatggaagcccaactgatccggcagatggagagcgagggaatcttttcccccagcgaactcgagaccccgaacctggcggaaagagtgcttgattggctggagaaatatggcgtggaacgcctcaagcggatggccatctctggggacgactgtgttgtgaagcctattgatgacagattcgctacagccctgaccgctcttaatgatatgggaaaagtccgcaaggacatcccccagtgggagccttccaaaggctggaacgattggcagcaagtgcccttttgcagccatcacttccaccagctgattatgaaggacgggcgggagatcgttgtgccttgtagaaatcaggatgaactcgtcggccgcgcccgggtgtctcagggagctggctggtccctgagagagacggcctgcctggggaaaagctacgcgcaaatgtggcagctcatgtattttcatcgccgggacctgagacttgccgctaacgccatttgttccgccgtccccgtggattggatcccgacatctcggaccacatggagcatccacgctcatcaccagtggatgaccacggaagacatgctgtccgtttggaatagagtgtggattgaggaaaacccttggatggaggataagacccatatcagctcttggggagacgtcccctacctcggcaagcgcgaggaccaatggtgcgggtccctgattggacttacagcccgggcgacctgggctacaaatatccaggtggccattaaccaggttagacgcctgatcggcaatgaaaactacctcgattatatgaccagcatgaaaagattcaagaatgagtctgaccccgaaggggccctgtggtga

SEQ ID NO: 18920 - RNA, 9879 nt, synthetic construct
  misc_feature 1..9879: note = derived and/or modified CDS sequence (opt5) from DENV-1__FJ906728__SS-prME
  source 1..9879: mol_type = other RNA
agcgtgacaatgctgctgatgctgatgcccacagcccttgctttccacctgacgacccggggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccgcgcatcacagaagctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgattctggattgttctccccggacaggcctcgacttcaacgaaatggtgctgcttaccatgaaggagaaatcctggctggtccataagcagtggtttctcgatctgcctcttccctggacgagcggggcttccacatctcaagagacctggaatcgccaggacctgctcgtgacattcaaaaccgcgcacgccaagaagcaggaagtcgtggttctgggaagccaagagggcgctatgcacaccgccctgacaggggccacggaaatccagacctccggaacaaccacaatttttgctggccatctcaaatgcagactgaagatggataaacttaccctgaaggggatgagctatgtgatgtgtacgggcccgttcaaactcgagaaggaagtcgccgagacacagcacggaaccgtgctggttcagatcaagtacgagggcaccgacgcgccttgcaaaatccccttctctacacaagatgaaaagggggtgacccagaacggacggctgattacagctaatcctatcgtcacggacaaagagaagcccgtgaacattgaagccgagcccccttttggcgagtcctatatcgtgattggggccggagaaaaagctcttaagctcagctggttcaagaaaggctctagcatcgggaagatgtttgaggccaccgctagaggcgcccgccggatggcgatcctgggagatacagcctgggacttcggctccattgggggagtttttacctctgtcggcaaactggtgcatcagatcttcgggacagcttacggagtgctctttagcggcgtctcctggaccatgaagattgggatcggcgtgctgcttacgtggctgggactcaatagcagatctacctccctgagcatgacatgtattgccgttggcctggtgaccctttacctcggggtcatggtgcaggctgattctggatgcgttatcaactggaaaggccgcgaactgaagtgtgggtccggaattttcgtgacaaatgaggtccacacctggacagaacaatataagtttcaggccgacagcccgaaacggctgtccgcggccatcggcaaggcttgggaggagggggtgtgcggcatcagatctgccacccgcctcgaaaacattatgtggaaacagatcagcaacgagctgaatcatattcttctggaaaacgacatgaagctcacggttgtggtcggagatgtggctggcatcctggggcagggcaagaagatgattcggccccaacctatggagtacaaatattcctggaagtcttggggcaaggccaaaatcatcggggccgacgctcagaatacaaccttcattatcgatggacccaacacccctgaatgtcccgacgatcagagagcgtggaatatttgggaggtggaggactacggctttggcatcttcacaaccaacatttggctgaaacttcgcgatagctatacgcaggtctgcgaccaccggctcatgtccgccgctatcaaagatagcaaggccgttcacgccgacatggggtactggatcgaatctgagaaaaatgaaacatggaagctggctagagcctcctttattgaggtgaagacctgtatctggccgaaaagccatacactgtggtctaacggagtgctcgaatccgagatgattatccctaagatttatggcgggcccatcagccaacacaattaccgccctggatacttcacccagacagcgggcccctggcatctggggaaacttgagctggatttcgacctctgcgaaggaaccacggtcgtggttgatgagcactgcggcaaccggggcccttctctgagaaccacaaccgtgacagggaagatcattcacgaatggtgttgccggagctgtaccctgcccccgcttcgctttagaggagaggacggctgctggtatgggatggagatccggcctgtcaaagaaaaggaggaaaatctcgtgaagtccatggttagcgctggatctggcgaggtggactccttcagcctggggctgctctgtatttccatcatgattgaagaggtcatgagatctcgctggagccggaaaatgctgatgacgggaacacttgccgtgtttttcctgctcatcatgggccagctgacctggaacgatctgattagactttgcatcatggttggcgccaatgcttccgaccgcatggggatgggaacaacctacctggccctcatggcgacctttaagatgagacccatgttcgctgtgggcctgctcctgcggcgccttacatctagagaggtcctgctcctgacgatcgggctgagccttgtggcctccgtggaactgcccaactctctcgaggaactgggagatggcctcgccatggggattatgatcctgaaacttctgaccgactttcaaagccatcagctctgggctacactgctgtcccttaccttcattaagacaacctttagcctgcactatgcctggaaaacgatggctatggtcctctctatcgtttccctgttccctctctgtctgagcacaacctctcagaagaccacatggcttccggtgctgctgggatccctcggctgcaagcccctgaccatgtttcttattgccgagaataaaatctggggcagaaagagctggcctctgaacgaagggatcatggcggtgggaattgtctctatcctcctgtccagcctcctgaaaaacgatgtgccccttgccggccctctgattgctgggggaatgctgatcgcctgttacgttatttccggcagctctgctgacctcagcctggagaaggccgccgaggtgtcctgggaagaggaagctgagcattctggggcgagccacaatatccttgtcgaagtgcaggatgacggaacaatgaaaatcaaggatgaggagcgcgacgatacgctgaccattctcctgaaagccacactcctggctgtttccggcgtgtatcccctttctatccctgccaccctgttcgtctggtacttttggcaaaagaagaaacagagaagcggcgtgctgtgggacacaccctccccgcctgaagtcgagcgggccgtgctcgatgacgggatttatcgcatcatgcagagaggactgcttggccggtctcaggttggggtgggagtcttccaagaaaacgtgttccataccatgtggcacgttacgcgcggcgctgtgctgatgtaccaggggaagagactcgagcccagctgggcctccgtcaaaaaggacctgattagctacggaggcggctggcggctcagagggtcttggaataccggagaggaagtccaggtgatcgcggttgagcctggcaaaaaccccaagaatgtccagacagctccggggacctttaagacacctgaaggagaggtgggcgccattgccctggatttcaaacccgggacctccggaagccctatcgtgaaccgcgaaggcaagatcgtcggcctttatgggaatggagtggttacaacgtctggcacctacgtgtccgctattgcccaagcgaaagctagccaggaggggcccctgcccgagatcgaagacgaggtctttcggaagagaaacctgacaattatggatctccaccctggatccggcaaaacccgccggtatctgccggccatcgtgagagaagccattaagcgcaaacttcggaccctgatcctcgctcccacaagagttgtggcctctgagatggctgaagccctgaaagggatgcctatccgctaccagacgaccgcggtcaagagcgagcatacaggcaaagagattgtggacctgatgtgccacgccaccttcacaatgcggctcctttcccccgttagagtgcctaattataacatgatcattatggatgaagctcattttaccgaccccagctctatcgccgctcggggatacatttccacgcgcgtcggcatgggggaggccgccgctatcttcatgacagcgacccctccgggaagcgtggaagcctttccccaatctaatgctgtgatccaggatgaggaaagagacattcctgagcggagctggaacaccggctatgagtggatcacagatttccccgggaagaccgtctggtttgttccttccattaaatctggaaatgacatcgccaactgtctgcgcaagaatggcaagagagtgattcagctgagccggaaaacattcgataccgaataccagaagacgaaaaacaacgactgggactacgtggtcacaaccgatatctccgagatgggggccaattttagagctgaccgcgtgattgatccccggagatgcctcaagccggttatcctgaaagacggccctgaacgcgtgatccttgccggacccatgcccgtcacagtggcgtctgctgcccaacggagaggccgcattgggcggaaccacaataaggagggagatcagtatatctacatgggccagcctctgaacaatgacgaggatcatgcccactggaccgaagctaagatgctcctggacaacattaatacgcccgaggggatcattcctgccctgttcgaaccggagagagaaaagagcgcggccgttgatggagagtatcgcctcagaggcgaggctcggaagaccttcgtggagcttatgcgcagaggggacctgcccgtctggctgtcctacaaagtggccagcgagggctttcagtattctgatcggcgctggtgcttcgacggagaaagaaacaatcaagtcctcgaggaaaacatggatgtggagatctggacaaaggagggcgaacggaaaaagctgagacctcgctggcttgacgctcggacctactccgaccccctggccctcagagagtttaaagagttcgctgccgggcgccggagcgtttccggagatctgatcctggagattggcaagctccctcagcaccttacacagagagcgcagaatgccctggacaacctggtgatgctccataattctgaacaagggggacgggcttatcgccacgccatggaggagctgcccgataccatcgaaacacttatgctgctcgctctgattgccgtgctgaccggcggcgtcacgctctttttccttagcgggagaggactgggcaagacatccatcgggctgctctgtgttatggcctctagcgtgctgctttggatggcttccgtggagccgcattggattgcggccagcatcatcctggaatttttcctcatggtcctgctgattcctgagcccgaccggcagcgcacccctcaggataaccagctcgcttacgtggttatcggacttctgtttatgattctggccgtggccgctaatgagatgggcctcctggaaaccaccaagaaggaccttgggatcggacacgtcgccgtggagaaccaccatcacgcggccatgctggatgtcgacctccatcccgcttctgcctggaccctgtacgctgtggccacaacgattatcacccctatgatgagacacacaattgaaaacaccacagcgaatatctccctgaccgccatcgctaaccaagccgctattctcatgggccttgataaaggctggcccatcagcaagatggacattggggttccgctgctggccctcggatgctattctcaggtgaatcctctgacgcttaccgctgccgtcctgatgctcgtggcgcattacgccatcattggccccgggctgcaggctaaagccacacgggaggctcaaaagcgcaccgccgccggaatcatgaagaaccccacagttgatggcatcgtggcgattgacctggatcctgtcgtgtatgacgctaaattcgaaaagcagctcgggcagatcatgcttctgattctgtgtacctcccagatcctcctgatgagaacgacatgggccctttgcgagagcattaccctggctacaggaccgctcaccaccctgtgggagggctctcccggcaaattttggaatacaacgatcgccgtgagcatggccaacatcttccgggggtcctacctggctggagccggcctcgcgttttctcttatgaaaagcctcgggggaggccgcagagggaccggagcccaaggcgaaacactgggcgagaaatggaagcggcagctcaatcagctgtccaagagcgagttcaacacctataaaagatccgggattatggaggttgaccgctctgaagctaaggagggacttaaacggggcgagacaaccaagcacgccgtcagcagagggacggctaaactgcgctggttcgtggaacggaatctcgtgaagcctgagggaaaggtcatcgatctgggctgtgggagaggaggctggtcctactattgcgccggcctgaaaaaggttacagaagtgaaagggtacaccaagggaggccccgggcacgaggaacctattcccatggcgacctacggatggaacctcgtgaaacttcattctggcaaggacgtctttttcatccctccggagaaatgtgatacactgctgtgcgacattggggagagctcccccaatcctaccatcgaagagggacgcacactccgggtgctgaagatggttgaaccctggcttagaggcaaccagttttgtattaagatcctgaatccttatatgccctctgtggtcgagacgctcgagcaaatgcagcgcaaacacggcgggatgctggtgcggaacccgctgagcagaaattccacccatgaaatgtactgggttagctgcggaacaggcaacatcgtgtctgccgtcaatatgacctcccgcatgctcctgaaccggttcacaatggctcacagaaagcctacctatgagcgcgatgtggaccttgggacgggaaccagacacgtggccgtcgaacccgaggttgctaacctggatattatcggccagcggattgaaaatatcaaacatgagcacaagagcacatggcattacgacgaggataacccctataaaacctgggcctaccacgggtcttatgaagtgaagccttccggaagcgcttcttccatggtgaatggcgtcgtgaagctcctgacaaaaccctgggacgttattcctatggtgacccagatcgccatgacagataccacgccgtttggccaacagcgcgtcttcaaggagaaagtggacacaagaacccccaaggcgaaacgggggaccgcccagatcatggaagttacagctagatggctttggggatttctgagccggaacaagaagcctcgcatttgtacgagagaggagttcacccggaaagtgcgctccaatgccgctatcggcgccgtctttgtggacgagaaccaatggaatagcgccaaggaggcggttgaagatgagagattctgggacctcgtgcatcgggaacgcgagctgcacaaacaggggaagtgcgctacatgcgtctacaacatgatgggaaaaagagaaaagaagctgggcgagtttgggaaagccaagggctctcgggccatttggtacatgtggctcggagctcgcttcctggagtttgaagcccttggcttcatgaatgaggatcactggttcagcagagaaaactccctgtctggggtggagggagagggcctccataaactggggtatatccttcgggacattagcaagatccccggaggcaatatgtacgctgatgacaccgccgggtgggatacacgcatcaccgaagacgatctgcagaacgaggcgaaaattacagacatcatggaacctgagcacgccctcctggctaaggccatttttaaactgacctatcagaataaggtcgtgagagttcaacggcccgctaagaacggcacggtgatggatgtcatctcccgcagagaccagcggggatctggccaggtggggacctacggactcaatacattcaccaacatggaagcccagctgattagacaaatggagagcgagggcatcttttccccgtctgaacttgagacacctaacctggcggaacgcgccctcgattggctggagaaatatggggtggaacggcttaagagaatggctatcagcggagacgactgtgttgtgaaacccattgatgaccgcttcgccaccgctctgacggccctcaatgatatgggcaaggtccggaaagacatccctcagtgggagccctccaaggggtggaacgattggcaacaggtgcctttttgcagccatcacttccaccaactgattatgaaggacggcagagagatcgttgtgccctgtcgcaatcaggatgaactggtcggacgggctagagtgtctcagggcgccgggtggtccctccgcgagacagcgtgcctgggaaaaagctacgcccagatgtggcaacttatgtattttcatcggagagacctgcgcctcgctgccaacgccatttgttctgctgtcccggtggattgggttcctacctcccggacaacctggagcatccacgcccatcaccagtggatgacgaccgaagacatgctgtccgtgtggaatagagtctggattgaggaaaacccctggatggaggataagacacatatctctagctgggaggacgtgccctaccttggcaaacgggaagaccagtggtgcgggtccctgatcggactcaccgcgagagctacatgggccaccaatattcaagttgccatcaaccaggtgcgccggctgattggcaatgagaactacctggattatatgacaagcatgaagagattcaaaaatgaatctgaccctgagggggctctctggtga

SEQ ID NO: 18921 - RNA, 9879 nt, synthetic construct
  misc_feature 1..9879: note = derived and/or modified CDS sequence (opt5) from DENV-1__FJ461313__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaagtctctcctgtttaagaccagcgccggcgttaatatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggctatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagctcacagtggttgtgggagatgtcgccggcattctggggcagggcaagaagatgatccggccgcaacccatggagtacaaatattcttggaaaagctggggcaaggccaagattatcggggctgacgcgcagaataccaccttcatcattgatggacctaacacacccgaatgtcctgacgatcagagagcctggaatatctgggaggtggaggactacggctttggcattttcaccacgaacatctggctgaaacttcgcgattcctatacacaggtgtgcgaccaccggctcatgagcgctgccattaaagattctaaggccgtccacgctgacatggggtactggatcgaatccgagaaaaatgaaacctggaagctggccagagcgagctttatcgaggttaagacatgtatttggcccaaatctcataccctgtggtccaacggagtgctcgaaagcgagatgatcattccgaagatctatggcgggcctatttctcaacacaattaccgccccggatacttcacacagaccgctggcccttggcatctggggaaacttgagctggatttcgacctctgcgaaggaacgaccgtggtcgtggatgagcactgcggcaaccggggccccagcctgagaacaaccacagttaccgggaagatcatccacgaatggtgttgccggtcctgtacgctgcctccccttcgctttagaggagaggacggctgctggtatgggatggagattcggccggtgaaagaaaaggaggaaaatctcgtcaagagcatggtgtctgccggatccggcgaggttgacagcttctccctggggctgctctgtatctctattatgatcgaagaggtgatgagaagccgctggtcccggaaaatgctgatgacaggaacccttgccgtctttttcctgctcattatgggccagctgacatggaacgatctgatcagactttgcattatggtgggcgctaatgcctctgaccgcatggggatgggaaccacctacctggcgctcatggctacatttaagatgagacctatgttcgccgttggcctgctctttcggcgcctgacgagcagagaggtgcttctgctcaccatcgggctgtccctggtcgcctctgtggaacttcccaacagcctggaggaactcggagatggcctggctatggggatcatgattctcaaactgcttacagacttccaatcccatcagctgtgggccaccctcctgagcctgacatttatcaagaccacgttctctcttcactatgcttggaaaacaatggccatggtgctgtccattgtcagcctctttcccctgtgtctctctaccacctcccagaagacaacctggctgcctgttcttctgggaagcctgggctgcaagccgctcacaatgttcctgatcgcggagaataaaatttggggccggaagtcttggccccttaacgaagggatcatggccgtgggaatcgtgtccattctgctcagctccctgctcaaaaacgatgtccctctggctggcccccttatcgccgggggaatgctgattgcttgttacgtgatcagcggctctagcgccgacctgtccctcgagaaggccgctgaggtttcttgggaagaggaagcggagcatagcggggcctcccacaatattctggtggaagtccaggatgacggaacgatgaaaatcaaggatgaggagcgcgacgatacccttacaatcctgctcaaagctaccctgctcgccgtgtctggcgtttatcctctgagcattcccgccacactttttgtgtggtacttctggcaaaagaagaaacagagatccggcgtcctgtgggacaccccttctcccccggaagtggagcgggctgtcctggatgacgggatctatcgcattatgcagagaggactcctgggccggagccaggtgggggttggagtgttccaagaaaacgtctttcatacgatgtggcacgtgacccgcggcgccgttcttatgtaccaggggaagagactggagccttcctgggcgagcgtgaaaaaggacctcatctcttacggaggcggctggcggctgagagggtcctggaatacaggagaggaagtccaggtgattgctgtggagcccggcaaaaaccctaagaatgttcagaccgcccccgggacattcaagaccccggaaggagaggtcggcgccatcgctctcgattttaaacctgggacaagcggatctcccattgtgaaccgcgaaggcaagatcgtgggcctgtatgggaatggagtcgtgacgacctccggcacatacgttagcgccatcgcgcaagctaaagcctcccaggaggggcctcttcccgagattgaagacgaggtgttccggaagagaaacctgaccatcatggatctgcaccccggatctggcaaaacccgccggtatctccctgccattgtcagagaagctatcaagcgcaagctgcggacacttattctggccccgacgagagtggttgctagcgagatggccgaagcgctcaaagggatgcccatccgctaccagaccacagccgtgaagtccgagcataccggcaaagagatcgtcgacctgatgtgccacgctacatttaccatgcggctgctcagccctgtgagagttcccaattataacatgattatcatggatgaagcccatttcacggacccttcttccattgctgcccggggatacatcagcacacgcgtgggcatgggggaggccgctgcgatttttatgaccgccacaccccctggatctgtcgaggctttcccgcaaagcaatgccgtgatccaggatgaggaaagagacatccccgagcggtcctggaactctggctatgagtggattacagattttcctgggaagaccgtgtggttcgtccccagcatcaaatccggaaatgacattgccaactgtcttcgcaagaatggcaagagagttatccagctgtctcggaaaacatttgataccgaataccagaagacgaaaaacaacgactgggactacgtggtgacaaccgatattagcgagatgggggctaatttcagagccgaccgcgtcatcgatcctcggagatgcctgaagcccgtgattctcaaagacggcccggaacgcgttatcctggcgggacctatgcccgtgacagtcgcttccgccgcccaacggagaggccgcatcgggcggaaccacaataaggagggagatcagtatatttacatgggccagccccttaacaatgacgaggatcatgctcactggaccgaagccaagatgctgctcgacaacatcaatacgcctgaggggattatccccgcgctgttcgaacctgagagagaaaagagcgccgctgtggatggagagtatcgcctgagaggcgaggcccggaagacctttgttgagctcatgcgcagaggggaccttccggtgtggctgtcttacaaagtcgcttccgagggcttccagtatagcgatcggcgctggtgctttgacggagaaagaaacaatcaagtgctggaggaaaacatggatgtcgagatttggacaaaggagggcgaacggaaaaagctcagaccccgctggctggacgcccggacctactccgaccctcttgctctgagagagttcaaagaatttgccgcggggcgccggtctgtgagcggagatctcatcctggagatcggcaagctgccccagcacctcacacagagagcccagaatgctcttgacaacctggttatgctgcataattccgaacaagggggacgggcctatcgccacgctatggaggagctccctgataccattgaaacactgatgcttctggccctcatcgccgtgctgaccggcggcgtgacgctgttctttctctctgggagaggacttggcaagacaagcattgggctgctgtgtgtcatggcttccagcgttctcctgtggatggcgtctgtggagccccattggatcgccgcttccattatccttgagttctttctgatggtgctcctgatcccggagcctgaccggcagcgcacaccccaggataaccagctggcctacgtcgtgattggactccttttcatgatcctgaccgttgccgctaatgagatgggcctgctcgaaacaaccaaaaaggacctggggattggacacgtggccgtcgagaaccaccatcacgcggccatgcttgatgtggacctgcatcctgctagcgcctggacactctacgctgtcgccacgaccatcattacacccatgatgagacacaccatcgaaaacacaaccgcgaatatttctctgacggccatcgctaaccaagccgctatcctgatgggcctcgataaaggctggcctatttccaagatggacatcggggtgccccttctggccctgggatgctatagccaggttaatccgctcaccctgacagctgccgtgcttatgctggtcgcgcattacgccattatcggccctgggctccaggctaaagccacccgggaggctcaaaagcgcacagccgccggaattatgaagaaccccaccgtggatggcatcgttgcgatcgacctggatcccgtggtctatgacgctaaatttgaaaagcagctggggcagattatgctccttatcctgtgtacgtctcagattctgctcatgagaacaacctgggccctgtgcgagagcatcacacttgctaccggacctctgaccacactctgggagggctccccgggcaaattctggaatacgaccattgccgtgtctatggccaacatctttcgggggagctacctggctggagccggcctggcgttctccctcatgaaaagccttgggggaggccgcagatccacaggggcccaaggagaaaccctgggcgagaaatggaagcggcagctgaatcagctctctaagagcgagttcaacacatataaaagatccggcatcatggaggtggaccgctctgaagctaaggaggggctgaaacggggagagaccacgaagcacgccgttagcagaggcacagctaaacttcgctggtttgtcgaacggaatctggtgaagcccgaggggaaggtgattgatctcggatgtggcagagggggatggtcctactattgcgccggcctgaaaaaggtcaccgaagttaaaggctacaccaaagggggacctggccacgaggaacccatccctatggcgacatacgggtggaacctggtgaaactccattctggaaaggacgtgttctttattccccctgagaaatgtgatacccttctgtgcgacatcggcgagagctccccgaatcccacaattgaagaggggcgcacgctgcgggtcctcaagatggtggaaccttggctgagaggaaaccagttctgtatcaagattcttaatccctatatgcctagcgttgtggagaccctggagcaaatgcagcgcaaacacggcggcatgctcgtccggaaccccctgtctagaaattccacacatgaaatgtactgggtgagctgcgggaccggaaacatcgtttctgccgtgaatatgacatcccgcatgctgctcaaccggtttaccatggctcacagaaagccgacgtatgagcgcgatgtcgacctgggcaccgggacaagacacgtggccgtggaacctgaggtcgctaaccttgatatcattggacagcggatcgaaaatattaaacatgagcacaagagcacctggcattacgacgaggataacccctataaaacatgggcctaccacggctcttatgaagttaagccctccgggagcgcttccagcatggtgaatggagtggtcaagctgctcaccaaaccttgggacgtgatccccatggttacacagattgccatgaccgatacgacacctttcggccaacagcgcgtgtttaaggagaaagtcgacaccagaaccccgaaggcgaaacggggcacagcccagatcatggaagtgacggctagatggctgtgggggttcctttctcggaacaagaagccccgcatctgtaccagagaggaatttacacggaaagttcgcagcaatgccgctattggagccgtgttcgtcgacgagaaccaatggaactccgccaaggaggcggtggaagatgagagattttgggacctggttcatcgggaacgcgagctccacaaacagggcaagtgcgctacctgcgtgtacaacatgatggggaaaagagaaaagaagctgggagagttcggcaaagccaaggggtctcgggccatctggtacatgtggctgggcgctcgctttctcgagttcgaagccctgggattcatgaatgaggatcactggtttagcagagaaaactccctttctggcgtcgagggggagggactgcataaactcggctatattctgcgggacatcagcaagattcctgggggaaatatgtacgctgatgacacagccggctgggatacccgcatcacagaagacgatcttcagaacgaggcgaaaatcaccgacattatggaacccgagcacgccctgctcgctaaggccatcttcaaactgacgtatcagaataaggtggtcagagtgcaacggcctgctaagaacgggaccgttatggatgtgatttcccgcagagaccagcggggctctggacaggtcggcacatacgggctgaatacctttacaaacatggaagcccagctcatcagacaaatggagagcgagggaattttctcccccagcgaactggagaccccgaaccttgcggaacgcgccctgaattggctcgagaaatatggcgtggaacggctgaagagaatggctatctctggggatgactgtgtggttaaacctatcgacgatcgctttgccacggctcttacagccctgaacgacatgggaaaggtgcggaaagatattccccagtgggagccttccaagggctggaatgactggcagcaggtccccttctgcagccatcactttcaccaactcatcatgaaggatgggagagagattgtggttccttgtcgcaaccaggacgaactggtgggccgggctagagtctctcagggagccggctggtccctgcgcgagaccgcgtgcctcgggaaaagctacgcccagatgtggcaactgatgtatttccatcggagagatcttcgcctggctgccaatgccatctgttccgctgtgcccgtcgactgggtgccgacatctcggaccacgtggagcattcacgcccatcaccagtggatgaccacagaagatatgctctccgtttggaacagagtgtggatcgaggaaaatccttggatggaggacaagacccatattagctcttgggaggatgtcccctacctgggaaaacgggaagaccagtggtgcggctcccttatcgggctgacagcgagagctacctgggccacaaacatccaagtggccattaatcaggttcgccggctcatcggaaacgagaattacctggactatatgaccagcatgaagagatttaaaaacgaatctgatcccgagggcgctctgtggtga

SEQ ID NO: 18922 - RNA, 9879 nt, synthetic construct
  misc_feature 1..9879: note = derived and/or modified CDS sequence (opt5) from DENV-1__FJ547063__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctggggagcctgggatgcaagccgctcacgatgtttctgattgctgagaataaaatctggggccggcgctcttggccccttaacgaaggcatcatggccgtggggattgtgtccatcctgctcagctccctgctcaagaacgatgtccctctggcgggaccccttattgccggcgggatgctgatcgcttgttacgtgattagcggatctagcgccgacctgtccctcgagaaagctgccgaggtttcttgggaagaggaagccgagcatagcggcgcttcccacaatatcctggtggaagtccaggatgacgggaccatgaagatcaaagatgaggagagagacgatacacttaccattctgctcaaggcgacactgctcgccgtgtctggagtttatcctctgagcatccccgctacccttttcgtgtggtacttctggcagaagaagaagcagcggtccggcgtcctgtgggacacgccttctcccccggaagtggagcgcgccgtcctggatgacggcatttatagaatcatgcagcgggggctcctgggacgcagccaggtgggcgttggggtgtttcaagaaaacgtcttccataccatgtggcacgtgacaagaggagccgttcttatgtaccagggcaaacggctggagccttcctgggctagcgtgaagaaagacctcatttcttacgggggaggctggagactgcagggctcctggaataccggggaggaagtccaggtgatcgccgtggagcccggaaagaaccctaaaaatgttcaaacagcgcccggcacctttaagacaccggaaggggaggtcggagctattgccctcgatttcaagcctggcacgagcgggtctcccatcgtgaaccgcgaaggaaaaatcgtgggcctgtatggcaatggggtcgtgaccacatccggaacctacgttagcgccattgctcaggccaaggcgtcccaggagggccctcttcccgagatcgaagacgaggtgtttcggaaaagaaacctgaccattatggatctgcaccccgggtctggaaagacacgccggtatctccctgctatcgtcagagaagccattaaacgcaagctgcggacgcttatcctggccccgaccagagtggttgctagcgagatggccgaagctctcaagggcatgcccatccgctaccaaacaaccgccgtgaaatccgagcatacagggaaggagattgtcgacctgatgtgccacgcgaccttcacgatgcggctgctcagccctgtgagagttcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgtgatccaggatgaggaaagagacattcccgagcggtcctggaactctggatatgagtggatcaccgatttccctggcaaaacagtgtggtttgtccccagcattaagtccgggaatgacatcgctaactgtcttcgcaaaaatggaaagagagttattcagctgtctcggaagaccttcgatacggaataccagaagaccaagaacaacgactgggactacgtggtgaccacagatatcagcgagatgggcgccaatttcagagccgaccgcgtcattgatcctcggagatgcctgaaacccgtgatcctcaaggacgggccggaacgcgttatcctggctggccctatgcccgtgaccgtcgcctccgcggctcagcggagaggacgcattggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgcccggacatactccgaccctcttgctctgagagagtttaaggagttcgccgctggccgccggtctgtcagcggggatctcattctggagatcggaaaactgccccagcacctcacccagagagcccaaaatgcgcttgacaacctggtgatgctgcataattccgaacagggcgggcgggcctatcgccacgctatggaggagctccctgatacaattgaaaccctgatgcttctggccctcatcgctgttctgacgggaggcgtgacactgtttttcctctctggcagagggcttggaaagaccagcattggcctgctgtgtgtgatggcctccagcgtcctcctgtggatggcctctgttgagccccattggatcgctgcgtccatcattcttgaatttttcctgatggtgctcctgatcccggagcctgaccggcagcgcacaccccaggataaccaactggcctacgtggtcattgggctcctttttatgatcctgacagtggctgccaatgagatgggactgctcgaaaccacaaagaaagacctgggcattgggcacgttgccgtggagaaccaccatcacgctgccatgcttgatgtcgacctgcatcctgcgagcgcctggacgctctacgctgtggccaccacaatcattacccccatgatgagacacacaatcgaaaacaccacggctaatatctctctgaccgccattgcgaaccaggccgctatcctgatgggactcgataagggctggcctatttccaaaatggacatcggcgtcccccttctggccctggggtgctatagccaggtgaatccgctcacactgaccgctgccgttcttatgctggtggctcattacgccattatcggacctggcctccaagcgaaggccacacgggaggctcagaaacgcaccgccgctgggatcatgaagaaccccacggtcgatggaattgtggccatcgacctggatcccgttgtgtatgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaatcgccgtctctatggctaacattttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcatcatggaggtggaccgctccgaagcgaaagaggggctgaagcggggagagacgacaaaacacgccgtgtctagaggcaccgctaaacttcgctggttcgttgaacggaatctggtcaaacccgaggggaaggtgattgatctcggatgtggcagagggggatggagctactattgcgccggcctgaagaaagtgaccgaagtcaagggctacacaaaagggggacctggccacgaggaacccatccctatggctacctacgggtggaacctggttaagctccattccggaaaagacgtgtttttcattccccctgagaagtgtgatacacttctgtgcgacatcggcgagtctagcccgaatcccacgattgaagaggggcgcaccctgcgggtgctcaaaatggtcgaaccttggctgagaggaaaccaattttgtatcaagatccttaatccctatatgccttccgtggttgagacactggagcagatgcagcgcaagcacggcggcatgctcgtgcggaaccccctgcagagaaatagcacccatgaaatgtactgggtctcttgcgggacaggaaacattgtgtccgccgttaatatgaccagccgcatgctgctcaaccggttcacgatggcgcacagaaaaccgacctatgagcgcgatgtggacctgggcgccgggacaagacacgtcgctgtggaacctgaggtggccaaccttgatatcattggacaacggatcgaaaatattaagcatgagcacaaatctacctggcattacgacgaggataacccctataagacatgggcttaccacggctcctatgaagtcaaacccagcgggtctgcctccagcatggttaatggagtggtgaagctgctcaccaagccttgggacgtcatccccatggtgacacagatcgctatgaccgatacgacaccttttggccagcaacgcgttttcaaagagaaggtggacaccagaaccccgaaagccaagcggggcacagcgcagattatggaagtcacggccaaatggctgtgggggtttctttccagaaacaagaagccccggatctgtacccgcgaggagttcacaagaaaagtgcggagcaatgctgccattggagctgtttttgtggacgagaaccagtggaactctgccaaggaggccgtcgaagatgagcgcttctgggacctggtgcatagagaacgggagctccacaaacagggcaagtgcgcgacctgcgtttacaacatgatggggaaacgcgaaaagaagctgggagagtttggcaaagctaaggggagcagagccatctggtacatgtggctgggcgcccggttcctcgagttcgaagctctgggatttatgaatgaggatcactggttctcccgcgaaaactctcttagcggcgtggagggggagggactgcataaactcggctatattctgagagacatctccaagatccctgggggaaatatgtacgccgatgacacagctggctgggatacccggattacagaagacgatcttcaaaacgaggcccgcatcaccgacattatggaacccgagcacgcgctgctcgccaaatctatctttaagctgacgtatcagaataaagtcgtgagagtccagcggcctgctaagaacgggaccgtgatggatgttattagccgcagagaccagcggggctccggacaagtgggcacatacgggctgaataccttcacaaacatggaagcccagctcatcagacagatggagtctgagggaatctttagcccctccgaactggagaccccgaaccttgctgaacgcgtcctggattggctcgagaagtatggcgtggaacggctgaaaagaatggccattagcggggacgactgtgtggttaagcctatcgatgaccgcttcgcgacggcccttacagctctgaatgatatgggaaaagtgcggaaggacattccccagtgggagccttctaaaggctggaacgattggcaacaggtccccttttgctcccatcacttccaccagctcatcatgaaggacgggagagagattgtggttccttgtcgcaatcaggatgaactggtgggccgggccagagtcagccaaggagctggctggtctctgcgcgagaccgcctgcctcgggaagtcctacgctcagatgtggcagctgatgtattttcatcggagagaccttcgcctggccgcgaacgccatctgtagcgctgtgcccgtcgattggattccgacatcccggaccacgtggtctatccacgcccatcaccaatggatgaccacagaagacatgctcagcgtgtggaatagagtttggatcgaggaaaacccttggatggaggataaaacccatatttccagctggggagacgtgccctacctgggcaagcgggaggaccagtggtgcgggtctcttatcggactgacagccagagctacctgggccacaaatattcaggtcgcgatcaaccaggtgcgccggctcattggcaatgaaaactacctggattatatgacctccatgaaaagattcaagaatgagagcgaccccgaaggggctctgtggtga

SEQ ID NO: 18923 - RNA, 9879 nt, synthetic construct
  misc_feature 1..9879: note = derived and/or modified CDS sequence (opt5) from DENV-1__FJ410218__SS-prME
  source 1..9879: mol_type = other RNA
agcgtgaccatgctgctcatgctgatgcccaccgcccttgctttccacctgacgacccggggcggggaacctcatatgattgtcaccaagcaggaacggggaaaatccctcctgtttaagacctctgccggcgttaacatgtgcacccttattgccatggacctgggggaactctgtgaagataccatgacatacaaatgcccccgcatcaccgaagctgaacccgacgatgtggactgttggtgcaatgccacggatacctgggtgacctatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgtcgagaataagatttggggcagaaaatcttggcccctgaacgaaggcatcatggctgtgggggttgtgtccatcctcctgagctccctcctgaagaacgatgtccctcttgccggacccctgattgcgggcgggatgctgatcgcctgttatgtgattagcggatctagcgctgacctctccctggagaaagccgctgaggtttcttgggaagaggaagccgagcacagcggcgcctcccataatatccttgtggaagtccaggatgacgggacgatgaagattaaagatgaggagcgggacgataccctgacaatcctcctgaaggctaccctcctggcggtgtctggagtctaccctcttagcatccccgccacactgttcgtgtggtatttttggcaaaagaaaaagcagcgctccggcgttctgtgggacaccccttctcccccggaagtggagagagctgtcctcgatgacggcatttaccggatcatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggccagcgttaagaaagacctgatttcttacgggggaggctggagactccagggctcctggaatacaggggaggaagtccaggtgatcgctgtggagcccggaaagaaccctaagaatgtccaaaccgcccccggcacatttaaaaccccggaaggggaggtgggagcgattgctctggatttcaagcctggcacaagcgggtctcccatcgttaaccgggaaggaaaaattgtgggcctttacggcaatggggtcgtgacgacctccggaacatatgttagcgccatcgcccaggctaaggcctcccaggagggccctctgcccgagatcgaagacgaggtgtttagaaaacgcaacctgaccattatggatctccatcccgggtctggaaagacccggagatacctgcctgcgatcgtccgcgaagctattaagcggaaacttagaacactgatcctcgccccgacgcgcgtggttgccagcgagatggctgaagccctgaagggcatgcccattcggtatcaaaccacagctgtgaaatccgagcacaccgggaaggagatcgtcgacctgatgtgccatgccacattcaccatgagactccttagccctgtgcgcgtgcccaattacaacatgatcattatggatgaagcgcactttacggacccttcttccatcgccgctcggggctatattagcacaagagtcggaatgggcgaggccgctgccatcttcatgaccgccacaccccctgggtctgttgaggcttttccgcagagcaatgcggtgattcaggatgaggaacgggacatccccgagcgctcctggaactctggatacgagtggatcacagatttccctggcaaaaccgtgtggtttgtccccagcattaagtccgggaatgacatcgccaactgtctgagaaagaatggaaaacgggtgattcagctgtctcgcaagacattcgataccgaatatcagaagacgaagaacaacgactgggactacgttgtgacaaccgatatcagcgagatgggcgctaattttagagccgaccgggtcattgatcctagacgctgcctcaaacccgtgatcctgaaggacgggccggaacgggttattcttgccggccctatgcccgtgacagtcgcttccgccgcgcagagacgcggacggatcggcagaaaccataataaggagggggatcagtacatctatatgggacagcccctgaacaatgacgaggatcacgctcactggaccgaagccaaaatgctcctggacaacattaatacgcctgagggcatcattcccgccctgttcgaacctgagcgcgaaaagagcgctgccatcgatggggagtaccggctcagaggagaggcgcgcaaaaccttcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatttggacaaaagagggagaacgcaagaaactgagaccccggtggcttgacgctagaacctattccgaccctctggccctccgcgagtttaaggagttcgctgccggccggagatctgtgagcggggatctgatcctggagatcggaaagctcccccagcatcttacacagcgcgctcaaaatgccctggacaacctggtcatgctccacaattccgaacagggcgggcgggcgtacagacatgccatggaggagctgcctgataccattgaaacacttatgctgctcgctctgatcgccgttctgaccggaggcgtgacgctctttttcctttctggccgggggctgggaaaaacaagcattggcctgctctgtgtgatggcttccagcgtcctgctttggatggcctctgtggagccccactggatcgccgcttccattatcctggaatttttcctcatggttctgctgatcccggagcctgaccgccagagaacaccccaggataaccaactcgcgtatgtggtcattgggcttctgtttatgatcctgaccgtggccgctaatgagatgggactcctggaaacaaccaagaaagaccttggcattgggcacgtcgccgtggagaaccatcaccatgccacaatgctggatgttgacctccaccctgctagcgcctggacgctgtacgcggtggccaccacaatcattacccccatgatgcggcatacaatcgaaaacaccacggctaatatttctctgaccgccatcgctaaccaggccgcgatcctcatgggacttgataagggctggcctatttccaaaatggacatcggcgtccccctgctggccctcgggtgctacagccaggtgaatccgctgacacttaccgctgccgttctgatgctcgtggctcactatgccattatcggacctggcctgcaagctaaggccacacgcgaggcgcagaagagaaccgccgctgggattatgaaaaaccccacggtcgatggaatcgtggccatcgacctggatcccgtggtttacgacgctaagttcgaaaaacagctcggccagattatgcttctgatcctgtgtacatctcaaattctcctgatgcggaccacatgggccctttgcgagagcatcaccctggccaccgggcctctcacaacgctgtgggagggatccccgggcaagttttggaataccacaattgcggtctctatggctaacatcttccgcggcagctatctggccggggctggactcgccttttcccttatgaaaagcctgggcgggggaagacggggcaccggggcccagggagaaacactgggcgagaagtggaagcgccagctcaatcagctgtccaaatctgagttcaacatctacaagagaagcggcattatggaggtggaccggtccgaagctaaagaggggcttaagagaggagagaccacgcgccacgccgtgtctcggggcacagcgaaactgagatggttcgtcgaacgcaatctcgttaagcccgaggggaaggtgatcgatctgggatgtggcagagggggatggagctattactgcgccggcctgaaaaaggtgaccgaagtcaaaggctataccaaagggggacctggccatgaggaacccattcctatggctacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggtcgaaccttggcttcggggaaaccaattttgtatcaagattctgaatccctacatgccttccgtggttgagacactcgagcagatgcagagaaaacatggcggcatgctggtgcgcaaccccctgagcagaaattctacccacgaaatgtattgggtctcctgcgggacaggaaacatcgtgagcgccgtgaatatgacctctagaatgctcctgaaccgcttcacgatggctcaccggaagccgacctacgagagagatgtcgaccttggcgccgggacacgccatgttgcggtggaacctgaggtggccaacctggatatcattggacagagaatcgaaaatattaaacacgagcataagtccacctggcactatgacgaggataacccctacaaaacatgggcttatcatggcagctacgaagtcaagccctctgggtccgccagctccatggtgaatggagttgtgaagctcctgaccaaaccttgggacgtcatccccatggtgacacaaattgctatgaccgatacgacaccttttggccagcagcgggttttcaaggagaaagtggacacccgcaccccgaaggccaaaagaggcacagctcaaatcatggaagtcacggcccggtggctttgggggtttctgagcagaaacaagaagccccggatctgtacccgcgaggagttcacaagaaaagtgcggtctaatgcggccattggagctgtttttgtggacgagaaccagtggaatagcgccaaggaggctgtcgaagatgagcgcttctgggacctcgtgcagaaagaaagagagctgcacaagcagggcaaatgcgcgacctgcgtctataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgccgatgacacagctggctgggataccagaatcacagaagacgatctgcaaaacgaggccaagatcaccgacattatggaacccgagcacgctctcctggccacgagcatctttaaactgacctaccagaataaggttgtgcgggtccagcgccctgcgaagaacgggacagtgatggatgtgatttccagacgggaccagcgcggctctggacaagttggcacctatgggctcaatacattcaccaacatggaagcccagctgatcagacagatggagagcgagggaatcttttcccccagcgaacttgagatcccgaacctggctgaacgggtgctcgattggctggagaaatacggcgtcgaaagacttaagcgcatggccatctctggggacgactgtgtggttaaacctattgatgaccggttcgctacggccctgacagcgctcaatgatatgggaaaggtgagaaaagacgtcccccagtgggagccttccaagggctggaacgattggcaacaggtgcccttttgcagccatcacttccaccagctgatcatgaaggacgggcgcgagattgtcgtgccttgtcggaatcaggatgaactggttggcagagcccgcgtgtctcaaggagctggctggtccctccgggagaccgcctgcctggggaaaagctatgctcagatgtggcagcttatgtactttcatagacgcgacctgcggctcgccgctaacgccatctgttccgcggtccccgtggattgggttccgacatctagaaccacgtggagcattcacgcccatcaccaatggatgaccacagaagacatgctgtccgtgtggaatcgcgtctggatcgaggaaaacccttggatggaggataagacccatgtgagctcttggggagacgtgccctatcttggcaaacgggaggaccagtggtgcgggtccctgattggactcacagctagagccacctgggccagcaatatccaggttgctatcaaccaggtccggagactgattggcaatgaaaactacctggattacatgacatctatgaagcgcttcaaaaatgagggggaccccgaaggcgccctctggtga

SEQ ID NO: 18924 - RNA, 9879 nt, synthetic construct
  misc_feature 1..9879: note = derived and/or modified CDS sequence (opt5) from DENV-1__FJ461316__SS-prME
  source 1..9879: mol_type = other RNA
agcgtgaccatgctgctgatgctgatgcccacagcccttgctttccacctgacgaccagaggcggggagcctcatatggtggtttccaagcaggaacggggaaagtctctcctgtttaagaccagcgccggcgtgaacatgtgcacccttatcgcgatggacctgggggagctctgtgaagatacaatgacctacaaatgcccccgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggctgggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacgttatgtggaaacagatctccaacgagcttaatcatatcctgctcgaaaacgacatgaagttcacagtggtcgtgggagatgtggctggcattctggcccaggggaaaaagatgatccggccgcaacccatggagtacaaatattcttggaaaagctggggaaaggccaagattatgggcgctgacgtccagaataccacctttatcattgatgggcctaacacacccgaatgtcctgacgatcagagagcgtggaatatctgggaggttgaggactacggattcggcatctttaccacgaacatttggctgaaacttcgcgattcctatacacaggtgtgcgaccaccggctcatgagcgccgctatcaaagattctaaggccgtgcacgccgacatgggctactggattgaatccgagaaaaatgaaacctggaagctggctagagccagcttcatcgaggtcaagacatgtatttggcccaaatctcataccctgtggtccaacggggtgctcgaaagcgagatgatcatcccgaagatttatggaggccctatctctcaacacaattaccgccccgggtacttcacacagaccgcgggaccttggcatctgggcaaacttgagctggattttgacctctgcgaagggacgaccgttgtggtcgatgagcactgcggaaaccggggccccagcctgagaacaaccacagtgaccggcaagattatccacgaatggtgttgccggtcctgtacgctgcctccccttcgcttcagaggggaggacggatgctggtatggcatggagattcggccggttaaagaaaaggaggaaaatctcgtcaagagcatggtctctgctgggtccggagaggtggacagcttttccctgggcctgctctgtatctctatcatgattgaagaggttatgagaagccgctggtcccggaaaatgctgatgacagggacccttgccgtgttcctgctcctgatcatgggacagctgacatggaacgatcttattagactgtgcatcatggtcggcgccaatgcttctgaccgcatgggcatggggaccacctacctcgccctgatggcgacatttaagatgagacctatgttcgctgtgggactcctgtttcggcgccttacgagcagagaggtgctgctcctgaccattggcctgtcccttgtcgcctctgttgaactgcccaacagcctcgaggaactgggggatggactcgccatgggcatcatgattctgaaacttctgacagacttccaatcccatcagctctgggctaccctgctgagccttacatttatcaagaccacgttctctctgcactatgcctggaaaacaatggctatggtgctctccatcgtgagcctgtttcccctctgtctgtctaccacctcccagaagacaacctggcttcctgtcctgctggggagcctcggatgcaagccgctgacaatgttccttattgccgagaataaaatctggggccggcgctcttggcccctgaacgaaggcattatggcggtggggatcgtttccattctcctgagctccctcctgaagaacgatgtgcctcttgccggacccctgatcgctggcgggatgctgatcgcctgttacgtcattagcggatctagcgctgacctctccctggagaaagccgccgaggtgtcttgggaagaggaagctgagcatagcggcgcgtcccacaatatccttgttgaagtgcaggatgacgggacgatgaagattaaagatgaggagagagacgataccctgacaatcctcctgaaggccaccctcctggctgtctctggagtgtatcctcttagcattcccgccacactgtttgtctggtacttctggcagaagaagaagcagcggtccggcgtgctgtgggacaccccttctcccccggaagttgagcgcgccgtgctcgatgacggcatctatagaatcatgcagcgggggctgcttggacgcagccaggtcggcgtgggggttttccaagaaaacgtgtttcatacgatgtggcacgtcaccagaggagctgtgctgatgtaccagggcaaacggctcgagccttcctgggccagcgtgaagaaagacctgatttcttacgggggaggctggagactccagggctcctggaatacaggggaggaagttcaggtcatcgcggtggagcccggaaagaaccctaaaaatgtgcaaaccgctcccggcacattcaagaccccggaaggggaggtcggagccattgccctggattttaagcctggcacaagcgggtctcccatcgtgaaccgcgaaggaaaaattgttggcctttatggcaatggggtggtcacgacctccggaacatacgtgagcgctatcgcccaggcgaaggcttcccaggagggccctctgcccgagattgaagacgaggttttccggaaaagaaacctgaccatcatggatctccaccccgggtctggaaagacccgccggtatctgcctgccatcgtgagagaagccattaaacgcaaacttcggacactgatcctcgctccgacgagagtcgtggccagcgagatggctgaagccctgaagggcatgcccattcgctaccaaaccacagcggttaaatccgagcataccgggaaggagatcgtggacctgatgtgccacgccacatttaccatgcggctccttagccctgtcagagtgcccaattataacatgattatcatggatgaagctcatttcacggacccttcttccatcgccgctcggggctacattagcacacgcgtgggaatgggcgaggccgccgctatctttatgaccgcgacaccccctgggtctgtcgaagccttcccgcagagcaatgctgttattcaggatgaggaaagagacatccccgagcggtcctggaactctggatatgagtggattacagattttcctggcaaaaccgtgtggttcgtgcccagcatcaagtccgggaatgacatcgccaactgtctgcgcaaaaatggaaagagagtcattcagctgtctcggaagacatttgataccgaataccagaagacgaagaacaacgactgggactacgtggttacaaccgatatcagcgagatgggcgccaatttcagagctgaccgcgtgattgatcctcggagatgcctcaaacccgtcatcctgaaggacgggccggaacgcgtgattcttgccggccctatgcccgttacagtggcgtccgctgcccagcggagaggacgcatcggccggaaccacaataaagagggggatcagtatatttacatgggacagcccctgaacaatgacgaggatcatgcccactggaccgaagctaagatgctcctggacaacatcaatacgcctgagggcatcattcccgccctgttcgaacctgagagagaaaagagcgcggccatcgatggggagtatcgcctcagaggagaggctcggaaaacctttgtcgaacttatgcgcagaggcgacctgccggtgtggctgtcttacaaggtcgcctccgaggggttccaatatagcgatcggcgctggtgctttgacggcgaaagaaacaatcaggtgctcgaggaaaacatggatgttgagatttggacaaaagagggagaacggaagaaactgagaccccgctggcttgacgctcggacctactccgaccctctggccctcagagagttcaaggaatttgctgccggccgccggtctgtgagcggggatctgatcctggagattggaaaactcccccagcaccttacacagagagcgcaaaatgccctggacaacctggtgatgctccataattccgaacagggcgggcgggcttatcgccacgccatggaggagctgcctgataccatcgaaacacttatgctgctcgctctgatcgccgtcctgaccggaggcgttacgctgttctttctttctggcagagggctgggaaagacaagcattggcctgctctgtgtgatggcctccagcgtgctgctttggatggcttctgtcgagccccattggatcgcggcctccattatcctggagttctttctcatggtgctgctgattccggagcctgaccggcagcgcacaccccaagataaccaactcgcttacgttgtgatcgggcttctgttcatgatcctgaccgtcgccgccaatgagatgggactcctggaaaccaccaagaaagaccttggcattgggcacgctgccgtgggaaaccaccatcacgcggccatgctggatgtcgacctccatcctgctagcgcctggacactgtacgctgtggccacgaccatcattacacccatgatgagacacaccatcgagaacacaaccgcgaatatttctctgacggccatcgctaaccaggccgctattctcatgggccttgataagggctggcctatctccaaaatggacatcggggttcccctgctggccctcggatgctatagccaggtgaatccgctgacccttacagctgccgtcctgatgctcgtggcgcattacgccattatcggccctgggctgcaagctaaggccacccgggaagctcagaaacgcacagccgccggaattatgaagaaccccaccgttgatggcatcgtggcgattgacctggatcccgtcgtgtatgacgctaagtttgagaaacagctcgggcagatcatgcttctgatcctgtgtacgtctcaaattctcctgatgagaacaacctgggccctttgcgaaagcatcacactggctaccggacctctcaccacactgtgggagggctccccgggcaagttctggaatacgaccattgccgtgtctatggccaacatctttcgggggagctacctggctggagccggcctcgcgttctcccttatgaaaagcctcgggggaggccgcagagggacaggagcccagggcgagaccctgggcgaaaagtggaaacggcagctcaatcagctgtccaagtctgagttcaacacatataagagaagcgggattatggaagttgaccgctccgaggctaaagaaggacttaagcggggcgagaccacgaaacacgccgtctctagagggacagctaagctgcgctggtttgtggagcggaatctcgtgaaacccgaaggaaaggtcatcgatctgggctgtgggagaggaggctggagctactattgcgccggcctgaagaaagttaccgaggtgaaggggtacaccaaaggaggccctgggcacgaagaacccatccctatggcgacatacggatggaacctcgtgaaacttcattccggcaaagacgtcttctttattccccctgaaaagtgtgataccctgctgtgcgacatcggggagtctagcccgaatcccacaattgaggaaggacgcacgctccgggtgctgaaaatggttgagccttggcttagaggcaaccaattctgtatcaagattctgaatccctatatgccttccgtggtcgaaaccctcgagcagatgcagcgcaagcacggcgggatgctggtgcggaaccccctgagcagaaattctacacatgagatgtactgggtttcctgcggaaccggcaacatcgtgagcgccgtcaatatgacatctcgcatgctcctgaaccggtttaccatggctcacagaaaaccgacgtatgaacgcgatgtggaccttggggccggaaccagacacgtggctgtcgagcctgaagttgccaacctggatattatcggccagcggatcgagaatattaagcatgaacacaaatccacatggcattacgacgaggataacccctataagacctgggcttaccacgggagctatgaggtgaaaccctctggatccgccagctccatggtgaatggcgtcgtgaagctcctgacaaagccttgggacgttatccccatggtgacccaaattgcgatgacagataccacgcctttcggccagcagcgcgtctttaaagaaaaggtggacacaagaaccccgaaagccaagcgggggaccgctcaaatcatggaggttacagccaaatggctttggggattcctgagcagaaacaagaagccccggatttgtacgcgcgaagagtttaccagaaaagtgcggtctaatgctgccatcggcgccgtcttcgtggacgaaaaccagtggaatagcgcgaaggaggctgttgaggatgaacgcttttgggacctcgtgcatagagagcgggaactgcacaaacaggggaagtgcgccacatgcgtctacaacatgatgggaaaacgcgagaagaagctgggcgagttcgggaaagccaagggctccagagctatctggtacatgtggctcggagcccggtttctggagttcgaggctcttggcttcatgaatgaagatcactggttttctcgcgagaacagcctgtccggggtggaaggagagggcctccataaactggggtatattcttagagacatctctaagattcctggaggcaatatgtacgccgatgacaccgcggggtgggatacacggatcaccgaggacgatctgcagaacgaagcccgcattacagacatcatggagcccgaacacgctctcctggccaaaagcatcttcaagctgacctatcaaaataaagtcgtgagagttcagcggcctgctaagaacggcacggtgatggatgtcatttcccgcagagaccagcggggatctggccaggtggggacctacggactcaatacatttaccaacatggaggcccaactgatcagacagatggaaagcgagggcattttctcccccagcgagcttgaaacaccgaacctggcggagcgcgtgctcgattggctggaaaagtatggggttgagcggcttaaaagaatggccatctctggagacgactgtgtggtcaagcctattgatgaccgctttgctaccgccctgacggctctcaatgatatgggcaaagtgcggaaggacatcccccagtgggaaccttccaaagggtggaacgattggcagcaagttcccttctgcagccatcactttcaccagctgatcatgaaggacggcagagagattgtggtcccttgtcgcaatcaggatgagctggtgggacgggccagagtctctcagggcgctgggtggtccctccgcgaaacagcctgcctgggaaagagctacgcgcaaatgtggcagcttatgtatttccatcggagagacctgcgcctcgccgctaacgccatctgttccgccgtgcccgttgattggattccgacctctcggacaacctggagcatccacgctcatcaccagtggatgacgaccgaggacatgctgtccgtgtggaatagagtctggattgaagagaacccttggatggaagataaaacacatatcagctcttggggcgacgtgccctaccttgggaagcgggaggaccaatggtgcggatccctgattggcctcaccgccagagcgacatgggctaccaatatccaggttgccatcaaccaggtgcgccggctgattgggaatgagaactacctggattatatgacaagcatgaaaagatttaagaatgaatctgaccccgagggcgccctctggtga

SEQ ID NO: 18925 - RNA, 9879 nt, synthetic construct
  misc_feature 1..9879: note = derived and/or modified CDS sequence (opt5) from DENV-1__FJ410220__SS-prME
  source 1..9879: mol_type = other RNA
agcgtgaccatgctgctcatgctgatgcccacggcccttgctttccacctgacgaccagaggaggggagcctcatatgatcgtgtccaagcaggaacggggaaaatctctcctgtttaagaccagcgccggagttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcgtcttcattctcctgatgcttgtgacccctagcatggctatgagatgcgttggcatcgggtcccgggactttgtggagggactgagcggcgccacatgggtcgatgtggtgctcgaacacgggtcttgtgtcacgaccatggctaaggacaaacccacactggatattgagctgctcaagaccgaagttacaaaccctgccgtgctgcgcaaactttgcatcgaggcgaagatttccaataccacgacagacagcagatgtccgacccaaggagaagccaccctggtggaggagcaggatgctaacttcgtctgccggcgcacatttgtggacagaggctggggcaatgggtgtggactcttcggcaaagggtctctgcttacctgcgccaagtttaagtgcgttacaaaactggaaggaaagatcgtgcagtacgagaacctcaaatattccgtcattgtgacggttcacaccggcgatcagcatcaagtggggaatgaaagcacagagcacggaaccacagctaccatcacgccccaggcccctaccacagaaatccagctgaccgactacggcgccctgacactcgactgttctccccggaccggcctggatttcaacgagatggtccttctgacgatgaaggagaaatcctggctcgtgcataagcagtggtttctggaccttcctctgccctggacaagcggggcttccacctctcaagaaacatggaatcgccaggatctcctggtcaccttcaaaaccgcgcacgccaagaagcaggaggtggttgtgctgggaagccaagaaggcgctatgcacacagccctcacgggggccaccgagattcagacatccggaaccacaaccatctttgctggccatctgaaatgcagacttaagatggacaaactgacgctcaaggggatgagctatgtcatgtgtacaggctctttcaaactggaaaaggaggtggccgagacccagcacggaaccgttctggtgcagattaagtacgaaggcacagatgcgccgtgcaaaatccctttctccacccaagacgagaagggggtcacacagaacggacggcttattacggctaatcccatcgtgaccgataaagaaaagcctgtgaacatcgaggccgagccgccctttggcgaaagctatattgttatcggggccggagagaaagctctcaagctgtcttggttcaagaaaggcagctccattgggaagatgtttgaagccacagctagaggcgcccgccggatggcgatcctgggagacaccgcctgggatttcggctctattgggggagtctttacaagcgtgggcaaactcgtgcatcagatcttcgggaccgcttacggagtcctgttttccggcgtgagctggacgatgaagatcgggattggcgttcttctgacctggctcggactcaattctagatccacaagcctgtctatgacctgtatcgccgtgggccttgtcacactctacctgggggtgatggttcaggctgactccggatgcgtgattaactggaaaggccgcgagctgaagtgtgggagcggaatcttcgtcaccaatgaagtgcacacatggaccgagcaatataagtttcaggccgattcccctaaacggctctctgcggccattggcaaggcttgggaggaaggggtttgcggcatcagaagcgccacgcgcctggagaacattatgtggaaacagatctccaacgaacttaatcatatcctgctcgagaacgacatgaagttcacagtggtcgtgggagacgtggctggcattctggtccaggggaaaaagatgatccggccgcaacccatggaatacaaatattcttggaaaagctggggaaaggccaaaattatcggcgccgatgttcaaaattccacctttattatcgacgggcctaacacccccgagtgtcctgatgaccagagagcttggaatatctgggaggtggaagattacggattcggcatttttacaaccaacatctggctgaaacttcgcgacagctatacacaggtgtgcgatcaccggctcatgtctgcggccattaaagactccaaggctgtccacgccgatatgggctactggatcgagagcgagaagaatgagacatggaagctggccagagcttctttcattgaagtgaagacctgtatctggcccaaatcccatacactgtggagcaacggggttctcgagtctgagatgatcattccgaagatccacggaggccctattagccaacataattatcgccccgggtacttcacccagacagccggaccttggcacctgggcaaacttgaactggactttgatctctgcgaggggaccacggtggtcgtggacgaacactgcggaaaccggggcccctccctgagaaccacaaccgttacaggcaagatcattcatgagtggtgttgccggagctgtaccctgcctccccttcgcttcagaggggaggatggatgctggtacggcatggaaatccggccggtgaaagagaaggaagagaatctcgtcaagtctatggtgtccgcggggagcggagaagttgactccttttctctgggcctgctctgtatcagcattatgatcgaggaggtgatgagatcccgctggtctcggaaaatgctgatgacggggacacttgctgtcttctttctgctcattatgggacagctgacctggaacgacctgatcagactttgcattatggtgggcgccaatgccagcgatcgcatgggcatggggacaacctatctggctctcatggccaccttcaagatgagacctatgtttgcggtgggactgctgttccggcgcctgacatccagagaagtccttctgctcacgatcggcctgtctctggttgctagcgtggagcttcccaactccctggaagaactgggggacggactggccatgggcattatgatcctcaaactgcttaccgattttcaaagctaccagctgtgggccacactcctgtctctgaccttcatcaagacaaccttttcccttcactatgcttggaaaacgatggccatggtgctgagcattgtctctctcttccccctgtgtctctccacaaccagccagaagaccacatggctgcctgtgcttctggggtctctgggatgcaagccgctcaccatgtttctgatcgctgaaaataaaatttggggccggaagtcctggccccttaacgagggcatcatggccgttgggattgtgagcatcctgctctccagcctgctcaaaaacgacgtccctctggcgggaccccttatcgccggcgggatgctgattgcttgttacgtgatctctggaagctccgccgatctgtctctcgagaaggctgccgaagttagctgggaggaagaggccgaacattccggcgcttctcacaatattctggtggaggtccaggacgatgggacaatgaaaatcaaggacgaggaacgcgatgacacgcttaccattctgctcaaagcgacactgctcgccgtgagcggagtctatcctctgtccatccccgctacccttttcgtgtggcatttctggcaaaagaagaaacagagatctggcgttctgtgggatacacctagccctcccgaggtggaacgggccgtcctggacgatggcatctaccgcattatgcagagagggctcctgggacggtcccaggtgggcgttggggtgtttcaagagaacgtcttccacaccatgtggcacgtgacgcgcggagccgtgcttatgtatcagggcaagagactggagcccagctgggcttctgttaaaaaggacctcatctcctacgggggaggctggcggtttcagggcagctggaataccggggaagaggtccaggtgattgccgtggaacccggcaagaaccctaagaatgtccaaacagcgcccggcaccttcaagacaccggagggggaagtgggagctatcgccctggactttaaacctggcacctctgggtcccccattgttaacagagagggaaagatcgtgggcctctacggcaatggggtcgtgacaacgagcggaacctatgtttccgccattgctcaggccaaagcgtctcaggagggccctctgcccgaaatcgaggatgaagtgttccgcaagcggaaccttacaatcatggacctgcatcccgggagcggaaaaaccagacgctacctgcctgctattgtccgggaggccatcaagagaaagctccgcaccctgattcttgccccgacacgggtggttgcttccgaaatggccgaggctctgaaaggcatgcccatcagatatcaaacgaccgccgtcaagagcgagcacacagggaaagaaattgtcgatctcatgtgccatgcgacctttacaatgcgcctgctgtctcctgtgcgggtgcccaattacaacatgatcatcatggacgaggcccacttcaccgatccttccagcattgctgccagaggctatatctctacgcgggtcggaatgggcgaagctgccgccatttttatgacagctacaccccctgggagcatggaggcgttcccgcagtccaatgccgttatccaggacgaagaaagagatattcccgagagatcttggaacagcggatacgaatggatcaccgactttcctggcaagacagtgtggttcgtgccctccatcaaagctgggaatgatattgccaactgtctccggaagaatggaaagcgcgtcatccagctttctagaaaaaccttcgacacagagtatcaaaagaccaaaaacaacgattgggactacgtggttacgacagacattagcgaaatgggcgccaattttcgggctgatagagtgatcgaccctcgccggtgcctgaagcccgtcattctgaaagatgggccggagagagtgatcctcgccggccctatgcccgttaccgtggcgtccgctgcccagcgccggggaagaattggccgcaaccataataaggagggggaccagtacatctatatgggacagcccctgaacaatgatgaagaccacgcccactggacagaggctaagatgcttctggataacatcaatacccctgaaggcattatccccgccctcttcgagcctgaacgggagaaaagcgcggccattgacggggagtacagactgcgcggagaagctagaaagacgtttgtcgagctgatgcggcgcggcgatctcccggtgtggctttcttataaagtcgcctccgaagggttccaatacagcgacagacggtggtgctttgatggcgagcgcaacaatcaggtgctggaagagaacatggacgttgagatctggaccaaggaaggagagcgcaaaaagctgcggcccagatggctcgatgctcgcacatattccgaccctctggcccttcgggagttcaaagagtttgctgccggcagacgctctgtgagcggggacctgattctcgaaatcggaaagctgccccagcatctgacccagcgggcgcaaaatgccctcgataaccttgtgatgctgcacaattccgagcagggcgggagagcttaccggcatgccatggaggaactgcctgacacaatcgagaccctcatgctgcttgctctgattgccgtcctcacaggaggcgttaccctgttctttctgtctggcaaggggctcggaaaaacgagcatcggccttctgtgtgtgatggcctccagcgtgctgctctggatggcttctgtcgaaccccactggattgcggcctccatcattctggagttctttcttatggtgctgctcatcccggagcctgatcgccagagaacaccccaggacaaccaactggcttatgttgtgatcgggctcctcttcatgattcttaccgtcgccgccaatgaaatgggactgctggagaccacaaagaaagatctcggcatcgggcacgtggctgtcgaaaaccatcaccatgccgcgatgctggacgtggatcttcaccctgccagcgcttggaccctgtacgccgttgctacaacgattatcacccccatgatgcggcatacaattgagaacaccacagccaatatctctctcaccgcgattgccaaccaggctgccatcctgatgggactggacaagggctggcctatctccaaaatggatattggcgtgcccctccttgctctggggtgctacagccaggtcaatccgctgacgctcaccgccgctgtgctgatgcttgttgcccactatgcgatcattggacctggcctgcaagccaaggctacacgcgaagcccagaagagaaccgctgccgggatcatgaaaaaccccacaattgacggaatcgtggccatcgatctcgaccccgtcgtgtacgatgcgaagtttgagaaacagctgggccagattatgctgctcatcctttgtacctctcaaattctgctgatgcggacgacatgggctctctgcgagagcatcaccctggccacagggcctcttaccaccctgtgggaaggatccccgggcaagttctggaatacaacgattgctgtgtctatggccaacatcttccgcggcagctatctcgccggggctggactggccttttccctgatgaaaagcctcggcgggggaagacggggcaccggggcgcagggagagacacttggcgaaaagtggaagcgccagctgaatcagctgtccaaatctgagttcaacacctacaagagaagcggcatcatggaagttgaccggtccgaggccaaagaggggctcaagagaggagaaacaaccaaacacgctgtctctcgcggcacggccaagctgcggtggtttgtggagagaaatcttgtgaagcccgaagggaaagtcattgacctgggatgtggccgcgggggatggagctattactgcgctggcctcaagaaagttacagaggtgaagggctataccaaagggggacctggccatgaggaacccatccctatggccacctacgggtggaacctggtgaagctgcactccggaaaagatgtcttctttattccccctgagaagtgtgacacactcctttgcgatatcggcgaatctagcccgaatcccaccattgaggaagggcggacactgagagtgctgaagatggttgagccttggctccgcggaaaccaattctgtatcaaaattctgaatccctacatgccttccgtggtcgagacgcttgaacagatgcagcggaagcatggcggcatgctggtgagaaaccccctcagccgcaattctacccacgagatgtattgggtttcctgcgggacaggaaacatcgtgagcgcggtcaatatgacctctcggatgctgctgaacagatttacaatggcccaccgcaaaccgacctacgaacgggacgtggatctcggcgctgggacgagacatgtggccgtcgagcctgaagttgctaacctggacatcattggacagcgcatcgagaatattaagcacgagcataaatccacctggcactatgatgaagacaacccctacaagacatgggcctatcatggcagctacgaggtgaagccctctgggtccgctagctccatggtgaatggagtcgtgaaacttctgaccaagccttgggatgttatccccatggtgacacaaattgccatgaccgacacaacccctttcggccagcagagagtctttaaagaaaaggtggatacgcggacaccgaaagcgaagcgcggcaccgcccaaatcatggaggttaccgctagatggctctgggggttcctgagccggaacaagaaacccagaatctgtacacgggaagagtttacgcgcaaggtgagatctaatgccgctattggagccgtcttcgtggacgagaaccagtggaatagcgccaaagaagcggttgaggacgatcggttttgggaccttgtgcaccgcgaaagagagctgcacaagcagggcaaatgcgctacctgcgtctataacatgatggggaagcgggaaaagaaactcggagagttcggcaaggccaaagggtcccgcgccatctggtacatgtggctgggcgctagattcctggagtttgaagccctcggattcatgaatgaggatcattggttttctcgggaaaacagcctgtccggcgtggagggggagggacttcacaagctgggctacattctccgcgacatctctaaaattcctgggggaaatatgtatgctgatgacacagccggctgggataccagaatcacagaagacgatctgcagaacgaggcgaagatcaccgacattatggaacccgagcatgcccttctggctaaaagcatcttcaagctcacataccaaaataaggtcgtgcgggttcagcgccctgccaaaaacgggaccgtgatggatgtcatttccagacgggaccagcgcggctctggacaggtgggcacgtatgggctgaatacctttacaaacatggaagctcaactgatcagacagatggagagcgagggaattttcctccccaacgaactggagaccccgaatcttgccggccgggtgctggattggctcgaaaagtacggggttgagagactgaaacgcatggcgatctccggagacgactgtgtggtcaagcctatcgatgaccggtttgccacagctcttaccgccctgaacgatatgggcaaagtgagaaaggacattccccagtgggaacctagcaaggggtggaatgattggcagcaagttcccttctgctctcaccactttcatcagctcatcatgaaagacggccgcgagattgtggtcccttgtcggaaccaggatgagctggtgggcagagctcgcgtctcccagggcgccgggtggagcctgcgggaaacggcttgcctcggaaagtcttatgcccaaatgtggcagctgatgtacttccacagacgcgaccttcggctggcggccaatgctatctgttccgccgtgcccgttgattgggtgccgacaagcagaaccacatggtccattcatgcccaccatcagtggatgaccacggaggacatgctctctgtctggaaccgcgtgtggatcgaagagaatccttggatggaagataaaacccggattagctcctgggaggacgttccctatctgggcaagagagaggaccaatggtgcgggagccttatcggactgacagctcgggccacctgggcgacaaacatccaggtggctattaatcaggtcagacgcctcatcggcaacgaaaattactctgattacatgacctccatgaaacggtttaagaacgagagcgaacccgagggggccctgtggtga

SEQ ID NO: 18926 - RNA, 9879 nt, synthetic construct
  misc_feature 1..9879: note = derived and/or modified CDS sequence (opt5) from DENV-1__JF937649__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttatcgcgatggacctgggggagctctgtgaagatacaatgacctacaagtgcccgagaatcacagaggtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaagcagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaggataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggcaaggggctcggaaaaacgagcatcggccttctgtgtgtgatggcttcttccgccctgctctggatggccagcgtcgagccccattggattgctgcgtctatcatcctggagttctttcttatggtgctgctcattccggagcctgaccgccagagaacaccccaggataaccaactggcctacgttgtgatcgggctcctgttcatgattcttaccgtcgctgccaatgagatgggactgctggaaaccacaaagaaagacctcggcatcgggcacgtggccgtcgagaaccaccatcacgctaccatgctggatgtggaccttcatcctgcctccgcgtggacactgtacgccgttgctacgaccattatcacacccatgatgcggcacaccattgaaaacacaaccgccaatatcagcctcacggctatcgccaaccaggcggccattctgatgggactggataagggctggcctatctctaaaatggacattggcgtgcccctccttgctctggggtgctatagccaggtcaatccgctgaccctcacagccgctgtgctgatgcttgttgcccattacgctatcattggacctggcctgcaagccaaggcgacccgcgaggcccagaagagaacagctgccgggatcatgaaaaaccccaccgtggatggaatcgtcgctattgacctcgatcccgtggtgtatgacgccaagtttgaaaaacagctgggccagatcatgctgctcattctttgtacgtcccaaatcctgctgatgcggacaacctgggccctctgcgagtctattacactggcgaccgggcctcttaccacactgtgggagggaagcccgggcaagttctggaatacgaccatcgctgtttccatggccaacatctttcgcggcagctacctcgctggggccggactggccttctccctgatgaaatctctcggcgggggaagacggggcacaggggctcagggagaaacccttggcgagaagtggaagcgccagctgaatcagctgagcaaatccgagttcaacacatataagagatctggcattatggaggtcgaccggagcgaagccaaagaggggctcagacgcggagagaccacgaagcacgcggtgtcccggggcacagccaaactgagatggtttgtggaacgcaatcttgtcaagcccgaggggaaggttatcgatctgggatgtggcagaggcgggtggtcttactattgcgctgggctcaaaaaggtgaccgaagtgaaaggctacaccaaagggggacctggccacgaggaacccattcctatggccacatacgggtggaacctggtcaaactgcatagcggaaaggacgtgttctttattccccctgagaaatgtgataccctcctttgcgacattggcgagtccagcccgaatcccacaatcgaagaggggagaacgctgcgcgttctgaagatggtggaaccttggctccggggaaaccaattctgtattaagatcctgaatccctatatgccttctgtcgtggagacccttgagcagatgcagagaaaacacggcggcatgctggttcgcaaccccctctcccggaatagcacacatgaaatgtactgggtgtcttgcgggaccggaaacatcgtctccgctgtgaatatgacaagcagaatgctgctgaaccgctttaccatggcccaccggaagccgacgtatgagagagatgtggacctcggcgcggggacccgccacgtcgccgttgaacctgaggtggctaacctggatattatcggacagagaattgaaaatatcaaacatgagcacaagtctacatggcattacgacgaggataacccctataaaacctgggcctaccacggctcctatgaagtgaagcccagcgggtccgctagctctatggtcaatggagtggttaaacttctgacaaaaccttgggacgtgattcccatggtcacccaaatcgccatgacagataccacgcctttcggccagcagcgggtgtttaaggagaaagttgacacacgcaccccgaaggctaaaagaggcaccgcccaaatcatggaagtgacagcgcggtggctctgggggttcctgagcagaaacaagaagccccggatttgtacgcgcgaggaatttaccagaaaagtccggtccaatgccgctatcggagccgtgttcgttgacgagaaccagtggaactctgctaaggaggccgtggaagatgagcgcttttgggaccttgtccatagagaacgggagctgcacaaacagggcaagtgcgccacatgcgtgtacaacatgatggggaaacgcgaaaagaagctcggagagttcggcaaagcgaaggggagcagagctatttggtacatgtggctgggcgcccggtttctggagttcgaagccctcggattcatgaatgaggatcactggttttcccgcgaaaactctctgagcggcgtcgagggggagggacttcataaactgggctatatcctcagagacatttccaagatccctgggggaaatatgtacgctgatgacaccgccggctgggatacacggatcaccgaagacgatctgcagaacgaggctaaaattacagacatcatggaacccgagcacgcccttctggcgacctctattttcaagctcacgtatcaaaataaagtggttcgcgtgcagagacctgcccggaacgggaccgtcatggatgtgatcagccgcagagaccagcggggctccggacaggtgggcacatacgggctgaatacctttacaaacatggaagctcaactgattagacagatggagagcgagggaatcttctctccctccgaactcgagaccccgaacctggccgaacgcgttcttgattggctggagaagcatggcgtggaacggctcaagagaatggctatcagcggggacgactgtgtcgtgaaacctattgatgaccgctttgccacggcgctgtctgcccttaatgatatgggaaaggttcggaaagacatcccccagtgggagccttccaagggctggaacgattggcagcaagtgcccttctgcagccaccactttcatcagctgattatgaaagacgggagagagatcgtcgtgccttgtcgcaatcaggatgaactcgtcggccgggctagagtgtcccagggagccggctggtctctgcgcgagacagcttgcctgggaaagagctatgcccaaatgtggcagctcatgtacttccaccggagagacctgcgccttgctgccaacgcgatttgttccgccgttcccgtggattgggtcccgaccagccggacaacctggtctatccatgctcaccatcagtggatgacgaccgaagacatgctgtccgtgtggaatagagtttggattgaggaaaacccttggatggaggataagacacacatcagctcttggggagacgtgccctatctcggcaaacgggaggaccaatggtgcgggagcctgatcggacttaccgccagagccacatgggctaccaatattcaggtcgccatcaaccaggtgcgccggctgattggcaatgaaaactacctcgattacatgacatccatgaagagatttaaaaatgagtctgaccccgaaggggcgctgtggtga

SEQ ID NO: 18927 - RNA, 9879 nt, synthetic construct
  misc_feature 1..9879: note = derived and/or modified CDS sequence (opt5) from DENV-1__FJ410222__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaagtctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcctgcccctctgtctgtctaccacatcccagaagaccacatggcttcctgtgctgctggggagcctcggatgcaagccgctgacgatgttccttatcgctgagaataaaatttggggccggcgctcttggcccctgaacgaaggcatcatggccgtggggatcgtctccattctcctgagctccctcctgaagaacgatgtgcctcttgcgggacccctgatcgccggcgggatgctgattgcttgttacgttatcagcggatctagcgccgacctctccctggagaaagctgccgaggtgtcttgggaagaggaagccgagcatagcggcgcttcccacaatattcttgtcgaagtgcaggatgacgggaccatgaagatcaaagatgaggagagagacgatacactgaccatcctcctgaaggcgacactcctggccgtttctggagtgtatcctcttagcattcccgctaccctgtttgtctggtacttctggcagaagaagaagcagcggtccggcgtgctgtgggacacgccttctcccccggaagtcgagcgcgccgtgctcgatgacggcatctatagaattatgcagcgggggctgcttggacgcagccaggttggcgtgggggtcttccaagaaaacgtgtttcataccatgtggcacgttacaagaggagccgtgctgatgtaccagggcaaacggctcgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctttatggcaatggggtggttaccacatccggaacctacgtgagcgccatcgctcaggccaaggcgtcccaggagggccctctgcccgagattgaagacgaggtcttccggaaaagaaacctgaccatcatggatctccaccccgggtctggaaagacacgccggtatctgcctgctattgtgagagaagccatcaaacgcaaacttcggacgctgattctcgccccgaccagagttgtggctagcgagatggccgaagctctgaagggcatgcccatccgctaccaaacaaccgccgtcaaatccgagcatacagggaaggagatcgtggacctgatgtgccacgcgacctttacgatgcggctccttagccctgttagagtgcccaattataacatgattatcatggatgaagcccatttcacagacccttcttccattgctgcccggggctacatcagcacccgcgtcggaatgggcgaggctgccgccatttttatgaccgctacaccccctgggtctgtggaagcgttcccgcagagcaatgccgtgatccaggatgaggaaagagacatccccgagcggtcctggaactctggatatgagtggattaccgattttcctggcaaaacagtctggttcgttcccagcatcaagtccgggaatgacattgctaactgtctgcgcaaaaatggaaagagagtgatccagctgtctcggaagacctttgatacggaataccagaagaccaagaacaacgactgggactacgtggtcaccacagatattagcgagatgggcgccaatttcagagccgaccgcgtgatcgatcctcggagatgcctcaaacccgttattctgaaggacgggccggaacgcgtgatccttgctggccctatgcccgtcaccgtggcctccgcggctcagcggagaggacgcatcggccggaaccacaataaagagggggatcagtatatttacatgggacagcccctgaacaatgacgaggatcatgcccactggacggaagccaagatgctcctggacaacatcaatacccctgagggcattatccccgctctgttcgaacctgagagagaaaagagcgccgcgattgatggggagtatcgcctcagaggagaggcccggaaaacatttgttgaacttatgcgcagaggcgacctgccggtgtggctgtcttacaaggtcgcttccgaggggttccaatatagcgatcggcgctggtgctttgacggcgaaagaaacaatcaggtgctcgaggaaaacatggatgtcgagatctggaccaaagagggagaacggaagaaactgagaccccgctggcttgacgcccggacatactccgaccctctggctctcagagagttcaaggaatttgccgctggccgccggtctgtgagcggggatctgatcctggagattggaaaactcccccagcaccttacccagagagcccaaaatgcgctggacaacctggttatgctccataattccgaacagggcgggcgggcctatcgccacgctatggaggagctgcctgatacaatcgaaacccttatgctgctcgccctgattgctgtgctgacgggaggcgtgacactcttctttctttctggcagagggctgggaaagaccagcatcggcctgctctgtgtcatggcctccagcgttctgctttggatggcctctgtggagccccattggattgctgcgtccatcatcctggagttctttctcatggtgctgctgattccggagcctgaccggcagcgcacaccccaggataaccaactcgcctacgtcgtgatcgggcttctgttcatgattctgacagttgctgccaatgagatgggactcctggaaaccacaaagaaagaccttggcatcgggcacgtggccgtcgagaaccaccatcacgctgccatgctggatgtggacctccatcctgcgagcgcctggacgctgtacgctgtcgccaccacaattatcacccccatgatgagacacacaattgaaaacaccacggctaatatctctctgaccgccatcgcgaaccaggccgctattctcatgggacttgataagggctggcctatctccaaaatggacattggcgtgcccctgctggccctcgggtgctatagccaggttaatccgctgacacttaccgctgccgtgctgatgctcgtcgctcattacgccatcattggacctggcctgcaagcgaaggccacacgggaggctcagaaacgcaccgccgctgggatcatgaagaaccccacggtggatggaatcgttgccattgacctggatcccgtggtctatgacgccaagtttgaaaaacagctcggccagatcatgcttctgattctgtgtacatctcaaatcctcctgatgagaaccacatgggcgctttgcgagagcattaccctggctaccgggcctctcacaacgctgtgggagggatccccgggcaagttctggaataccacaatcgccgtgtctatggctaacatctttcggggcagctacctggccggggccggactcgctttctcccttatgaaaagcctgggcgggggacgcagaggcaccggggcccagggagaaacactgggcgagaagtggaaacggcagctcaatcagctgtccaagtctgagttcaacacctataagagaagcggcattatggaggtggaccgctccgaagcgaaagaggggcttaagcggggagagacgacaaaacacgccgtttctagaggcaccgctaagctgcgctggtttgtcgaacggaatctcgtgaaacccgaggggaaggtgatcgatctgggatgtggcagagggggatggagctactattgcgccggcctgaagaaagtcaccgaagttaagggctacacaaaagggggacctggccacgaggaacccattcctatggctacctacgggtggaacctcgtgaaacttcattccggaaaagacgtgttctttattccccctgagaagtgtgatacactgctgtgcgacatcggcgagtctagcccgaatcccacgatcgaagaggggcgcaccctccgggtcctgaaaatggtggaaccttggcttagaggaaaccaattctgtattaagatcctgaatccctatatgccttccgttgtggagacactcgagcagatgcagcgcaagcacggcggcatgctggtccggaaccccctgagcagaaattctacccatgaaatgtactgggtgtcctgcgggacaggaaacatcgttagcgccgtgaatatgacctctcgcatgctcctgaaccggtttacgatggcgcacagaaaaccgacctatgagcgcgatgtcgaccttggcgccgggacaagacacgtggctgtggaacctgaggtcgccaacctggatattatcggacagcggattgaaaatatcaagcatgagcacaaatccacctggcattacgacgaggataacccctataagacatgggcttaccacggcagctatgaagttaaaccctctgggtccgccagctccatggtgaatggagtggtcaagctcctgaccaagccttgggacgtgattcccatggttacacaaatcgctatgaccgatacgacacctttcggccagcagcgcgtgtttaaagagaaggtcgacaccagaaccccgaaagccaagcggggcacagcgcaaatcatggaagtgacggccaaatggctttgggggttcctgagcagaaacaagaagccccggatttgtacccgcgaggaatttacaagaaaagttcggtctaatgctgccatcggagctgtgttcgtcgacgagaaccagtggaatagcgccaaggaggccgtggaagatgagcgcttttgggacctcgttcatagagaacgggagctgcacaaacagggcaagtgcgcgacctgcgtgtacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtcgagggggagggactccataaactgggctatatccttagagacatttctaagatccctgggggaaatatgtacgccgatgacacagctggctgggatacccggatcacagaagacgatctgcagaacgaggcccgcattaccgacatcatggaacccgagcacgcgctcctggccaaaagcattttcaagctgacgtatcaaaataaagtggtcagagtgcagcggcctgctaagaacgggaccgttatggatgtgatctcccgcagagaccagcggggctctggacaggtcggcacatacgggctcaatacctttacaaacatggaagcccaactgattagacagatggagagcgagggaatcttctcccccagcgaacttgagaccccgaacctggctaagcgcgtgctcgattggctggaaaaatatggcgtggagcggcttaagagaatggccatctctggggacgactgtgttgtgaaacctattgatgaccgctttgcgacggccctgacagctctcaatgatatgggaaaggtccggaaagacatcccccagtgggaaccttccaagggctggaacgattggcagcaagtgcccttctgcagccatcactttcaccagctgattatgaaggacgggagagagatcgttgtgccttgtcgcaatcaggatgagctggtcggccgggccagagtgtctcagggagctggctggtccctccgcgaaaccgcctgcctggggaaaagctacgctcaaatgtggcagcttatgtatttccatcggagagacctgcgcctcgccgcgaacgccatttgttccgctgtccccgtggattggatcccgacatctcggaccacgtggagcattcacgcccatcaccagtggatgaccacagaggacatgctgtccgtttggaatagagtgtggatcgaagagaacccttggatggaagataagacccatatcagctcttggggagacgtcccctaccttggcaaacgggaggaccaatggtgcgggtccctgattggactcacagccagagctacctgggccacaaatatccaggtggcgattaaccaggttcgccggctgatcggcaatgagaactacctggattatatgaccagcatgaagagatttaaaaatgaatctgaccccgagggggctctctggtga

SEQ ID NO: 18928 - RNA, 9879 nt, synthetic construct
  misc_feature 1..9879: note = derived and/or modified CDS sequence (opt5) from DENV-1__FJ461319__SS-prME
  source 1..9879: mol_type = other RNA
agcgtgaccatgctgctgatgctgatgcccacagcccttgctttccacctgacgaccagaggcggggagcctcatatggtggtttccaagcaggaacggggaaagtctctcctgtttaagaccagcgccggcgtgaacatgtgcacccttatcgccatggacctgggggagctctgtgaagatacaatgacctacaaatgcccccgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggctgggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacgttatgtggaaacagatctccaacgagcttaatcatatcctgctcgaaaacgacatgaagttcacagtggtcgtgggagatgtggctggcattctggcccaggggaaaaagatgatccggccgcaacccatggagcacaaatactcttggaaaagctggggaaaggccaagattatcggcgctgacgtccagaataccacctttattatcgatgggcctaacacacccgaatgtcctgacgatcagagagcgtggaatatctgggaggttgaggactatggattcggcatttttaccacgaacatctggctgaaacttcgcgattcctacacacaggtgtgcgaccaccggctcatgagcgccgctattaaagattctaaggccgtgcatgccgacatgggctattggatcgaatccgagaaaaatgaaacctggaagctggctagagccagcttcattgaggtcaagacatgtatctggcccaaatctcacaccctgtggtccaacggggtgctcgaaagcgagatgatcattccgaagatctacggaggccctatttctcaacataattatcgccccgggtacttcacacagaccgcgggaccttggcacctgggcaaacttgagctggattttgacctctgcgaagggacgaccgttgtggtcgatgagcactgcggaaaccggggccccagcctgagaacaaccacagtgaccggcaagatcattcatgaatggtgttgccggtcctgtacgctgcctccccttcgcttcagaggggaggacggatgctggtacggcatggagatccggccggttaaagaaaaggaggaaaatctcgtcaagagcatggtctctgctgggtccggagaggtggacagcttttccctgggcctgctctgtatctctattatgatcgaagaggttatgagaagccgctggtcccggaaaatgctgatgacagggacccttgccgtgttcctgctcctgattatgggacagctgacatggaacgatcttatcagactgtgcattatggtcggcgccaatgcttctgaccgcatgggcatggggaccacctatctcgccctgatggcgacatttaagatgagacctatgttcgctgtgggactcctgtttcggcgccttacgagcagagaggtgctgctcctgaccatcggcctgtcccttgtcgcctctgttgaactgcccaacagcctcgaggaactgggggatggactcgccatgggcattatgatcctgaaacttctgacagacttccaatcccaccagctctgggctaccctgctgagccttacatttatcaagaccacgttctctctgcattacgcctggaaaacaatggctatggtgctctccattgtgagcctgtttcccctctgtctgtctaccacctcccagaagacaacctggcttcctgtcctgctggggagcctcggatgcaagccgctgacaatgttccttatcgccgagaataaaatttggggccggcgctcttggcccctgaacgaaggcatcatggcggtggggattgtttccatcctcctgagctccctcctgaagaacgatgtgcctcttgccggacccctgatcgctggcgggatgctgattgcctgttatgtcatcagcggatctagcgctgacctctccctggagaaagccgccgaggtgtcttgggaagaggaagctgagcacagcggcgcgtcccataatattcttgttgaagtgcaggatgacgggacgatgaagatcaaagatgaggagagagacgataccctgacaattctcctgaaggccaccctcctggctgtctctggagtgtaccctcttagcatccccgccacactgtttgtctggtatttctggcagaagaagaagcagcggtccggcgtgctgtgggacaccccttctcccccggaagttgagcgcgccgtgctcgatgacggcatctacagaattatgcagcgggggctgcttggacgcagccaggtcggcgtgggggttttccaagaaaacgtgtttcacacgatgtggcacgtcaccagaggagctgtgctgatgtatcagggcaaacggctcgagccttcctgggccagcgtgaagaaagacctgatctcttacgggggaggctggagactccagggctcctggaatacaggggaggaagttcaggtcattgcggtggagcccggaaagaaccctaaaaatgtgcaaaccgctcccggcacattcaagaccccggaaggggaggtcggagccatcgccctggattttaagcctggcacaagcgggtctcccattgtgaaccgcgaaggaaaaatcgttggcctttacggcaatggggtggtcacgacctccggaacatatgtgagcgctattgcccaggcgaaggcttcccaggagggccctctgcccgagatcgaagacgaggttttccggaaaagaaacctgaccatcatggatctccatcccgggtctggaaagacccgccggtacctgcctgccattgtgagagaagccatcaaacgcaaacttcggacactgattctcgctccgacgagagtcgtggccagcgagatggctgaagccctgaagggcatgcccatccgctatcaaaccacagcggttaaatccgagcacaccgggaaggagattgtggacctgatgtgccatgccacatttaccatgcggctccttagccctgtcagagtgcccaattacaacatgatcatcatggatgaagctcacttcacggacccttcttccattgccgctcggggctatatcagcacacgcgtgggaatgggcgaggccgccgctatttttatgaccgcgacaccccctgggtctgtcgaagccttcccgcagagcaatgctgttatccaggatgaggaaagagacattcccgagcggtcctggaactctggatacgagtggatcacagattttcctggcaaaaccgtgtggttcgtgcccagcatcaagtccgggaatgacattgccaactgtctgcgcaaaaatggaaagagagtcatccagctgtctcggaagacatttgataccgaatatcagaagacgaagaacaacgactgggactacgtggttacaaccgatattagcgagatgggcgccaatttcagagctgaccgcgtgatcgatcctcggagatgcctcaaacccgtcattctgaaggacgggccggaacgcgtgatccttgccggccctatgcccgttacagtggcgtccgctgcccagcggagaggacgcattggccggaaccataataaagagggggatcagtacatctatatgggacagcccctgaacaatgacgaggatcacgcccactggaccgaagctaagatgctcctggacaacatcaatacgcctgagggcattatccccgccctgttcgaacctgagagagaaaagagcgcggccattgatggggagtaccgcctcagaggagaggctcggaaaacctttgtcgaacttatgcgcagaggcgacctgccggtgtggctgtcttataaggtcgcctccgaggggttccaatacagcgatcggcgctggtgctttgacggcgaaagaaacaatcaggtgctcgaggaaaacatggatgttgagatctggacaaaagagggagaacggaagaaactgagaccccgctggcttgacgctcggacctattccgaccctctggccctcagagagttcaaggaatttgctgccggccgccggtctgtgagcggggatctgattctggagatcggaaaactcccccagcatcttacacagagagcgcaaaatgccctggacaacctggtgatgctccacaattccgaacagggcgggcgggcttaccgccatgccatggaggagctgcctgataccatcgaaacacttatgctgctcgctctgattgccgtcctgaccggaggcgttacgctgttctttctttctggcagagggctgggaaagacaagcatcggcctgctctgtgtgatggcctccagcgtgctgctttggatggcttctgtcgagccccactggattgcggcctccatcattctggagttctttctcatggtgctgctgatcccggagcctgaccggcagcgcacaccccaagataaccaactcgcttatgttgtgatcgggcttctgttcatgattctgaccgtcgccgccaatgagatgggactcctggaaaccaccaagaaagaccttggcatcgggcacgctgccgtgggaaaccatcaccatgcggccatgctggatgtcgacctccaccctgctagcgcctggacactgtacgctgtggccacgaccattatcacacccatgatgagacataccattgagaacacaaccgcgaatatctctctgacggccattgctaaccaggccgctatcctcatgggccttgataagggctggcctatctccaaaatggacattggggttcccctgctggccctcggatgctacagccaggtgaatccgctgacccttacagctgccgtcctgatgctcgtggcgcactatgccatcattggccctgggctgcaagctaaggccacccgggaagctcagaaacgcacagccgccggaatcatgaagaaccccaccgttgatggcattgtggcgatcgacctggatcccgtcgtgtacgacgctaagtttgagaaacagctcgggcagatcatgcttctgattctgtgtacgtctcaaatcctcctgatgagaacaacctgggccctttgcgaaagcattacactggctgccggacctctcaccaccctgtgggagggctccccgggcaagttctggaatacaacgatcgccgtgtctatggctaacatttttcgggggagctatctggccggagcgggcctcgccttctcccttatgaaaagcctcgggggaggccgcagagggaccggagctcagggcgagacactgggcgaaaagtggaaacggcagctcaatcagctgtccaagtctgagttcaacacctacaagagaagcgggatcatggaagttgaccgctccgaggccaaagaaggacttaagcggggcgagacaaccaaacacgctgtctctagagggacggccaagctgcgctggtttgtggagcggaatctcgtgaaacccgaaggaaaggtcatcgatctgggctgtgggagaggaggctggagctattactgcgcgggcctgaagaaagttacagaggtgaaggggtataccaaaggaggccctgggcatgaagaacccattcctatggccacctacggatggaacctcgtgaaacttcactccggcaaagacgtcttctttattccccctgaaaagtgtgatacactgctgtgcgacatcggggagtctagcccgaatcccaccatcgaggaaggacgcacactccgggtgctgaaaatggttgagccttggcttagaggcaaccaattctgtattaagatcctgaatccctacatgccttccgtggtcgaaacgctcgagcagatgcagcgcaagcatggcgggatgctggtgcggaaccccctgagcagaaattctacccacgagatgtattgggtttcctgcggaacaggcaacattgtgagcgctgtcaatatgacctctcgcatgctcctgaaccggtttacaatggcccacagaaaaccgacctacgaacgcgatgtggaccttggggctggaacgagacatgtggccgtcgagcctgaagttgctaacctggatatcatcggccagcggattgagaatatcaagcacgaacataaatccacctggcactatgacgaggataacccctacaagacatgggcctatcatgggagctacgaggtgaaaccctctggatccgcgagctccatggtgaatggcgtcgtgaagctcctgaccaagccttgggacgttattcccatggtgacacaaatcgccatgaccgatacaacccctttcggccagcagcgcgtctttaaagaaaaggtggacacgagaacaccgaaagctaagcgggggaccgcccaaattatggaggttaccgctaaatggctttggggattcctgagcagaaacaagaagccccggatctgtacacgcgaagagtttacgagaaaagtgcggtctaatgccgccatcggcgcggtcttcgtggacgaaaaccagtggaatagcgctaaggaggccgttgaggatgaacgcttttgggacctcgtgcacagagagcgggaactgcacaaacaggggaagtgcgcgacctgcgtctataacatgatgggaaaacgcgagaagaagctgggcgagttcgggaaagctaagggctccagagccatttggtacatgtggctcggagctcggtttctggagttcgaggcccttggcttcatgaatgaagatcattggttttctcgcgagaacagcctgtccggggtggaaggagagggcctccacaaactggggtacatccttagagacatttctaagatccctggaggcaatatgtatgcggatgacacagccgggtgggatacccggattacagaggacgatctgcagaacgaagctcgcatcaccgacatcatggagcccgaacatgccctcctggctaaaagcattttcaagctgacataccaaaataaagtcgtgagagttcagcggcctgccaagaacggcaccgtgatggatgtcatctcccgcagagaccagcggggatctggccaggtggggacgtatggactcaatacctttacaaacatggaggcgcaactgattagacagatggaaagcgagggcatcttctcccccagcgagcttgaaaccccgaacctggccgagcgcgtgctcgattggctggaaaagtacggggttgagcggcttaaaagaatggctatttctggagacgactgtgtggtcaagcctatcgatgaccgctttgccacagctctgaccgccctcaatgatatgggcaaagtgcggaaggacatcccccagtgggaaccttccaaagggtggaacgattggcagcaagttcccttctgcagccaccactttcatcagctgattatgaaggacggcagagagatcgtggtcccttgtcgcaatcaggatgagctggtgggacgggctagagtctctcagggcgccgggtggtccctccgcgaaacggcgtgcctgggaaagagctatgcccaaatgtggcagcttatgtacttccaccggagagacctgcgcctcgctgccaacgccatttgttccgctgtgcccgttgattggatcccgacatctcggaccacatggagcattcatgcccaccatcagtggatgaccacggaggacatgctgtccgtgtggaatagagtctggatcgaagagaacccttggatggaagataaaacccacattagctcttggggcgacgtgccctatcttgggaagcgggaggaccaatggtgcggatccctgatcggcctcacagcgagagctacctgggccacaaatgttcaggtggccatcaaccaggtccgccggctgattgggaatgagaactacctggattacatgaccagcatgaaaagatttaagaatgaatctgaccccgagggcgctctctggtga

SEQ ID NO: 18929 - RNA, 9879 nt, synthetic construct
  misc_feature 1..9879: note = derived and/or modified CDS sequence (opt5) from DENV-1__FJ461320__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtggccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatggttgaagaggtgatgcggagcagatggtcccgcaagatgctcatgacagggaccctggctgtcttccttctgctcattatgggacagctgacatggaacgatctgatccggctttgcattatggtgggcgccaatgcctctgacagaatgggcatggggaccacctatctggctctcatggccacatttaaaatccgccctatgttcgcggtgggactgctctttagacggctgacgagccgcgaggtccttctgctcaccattggcctgtccctggttgcttctgtggaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtcagcctgttccccctctgtctgtctaccacctcccagaagacaacctggcttcctgtgctgctggggagcctcggatgcaaaccgctgacaatgtttcttattacggagaataagatctggggcagaaaatcttggcccctgaacgaaggcattatggctgttggggtggtctccatcctcctgagctccctcctgaagaacgatgtgcctcttgccggacccctgatcgcgggcgggatgctgattgcctgttatgttatcagcggatctagcgctgacctctccctggagaaagccgctgaggtgtcttgggaagaggaagccgagcacagcggcgcctcccataatattcttgtcgaagtgcaggatgacgggaccatgaagatcaaagatgaggagcgggacgatacactgaccattctcctgaaggctacactcctggcggtctctggagtgtaccctcttagcatccccgccaccctgttcgtttggtatttttggcaaaagaaaaagcagcgctccggcgtgctgtgggacacgccttctcccccggaagtcgagagagctgtgctcgatgacggcatctaccggattatgcagcgcgggctgcttggaagaagccaggttggcgtgggggtcttccaagaaaacgtgttccacaccatgtggcacgtgacacggggagccgttctgatgtatcagggcaaacgcctcgagccttcctgggccagcgtcaagaaagacctgatctcttacgggggaggctggagactccagggctcctggaataccggggaggaagtccaggtgattgctgtcgagcccggaaagaaccctaagaatgtgcaaacagcccccggcacctttaaaacaccggaaggggaggttggagcgatcgctctggatttcaagcctggcacgagcgggtctcccattgtgaaccgggaaggaaaaatcgtcggcctttacggcaatggggtggttaccacatccggaacctatgtgagcgccattgcccaggctaaggcctcccaggagggccctctgcccgagatcgaagacgaggtctttagaaaacgcaacctgaccatcatggatctccatcccgggtctggaaagacacggagatacctgcctgcgattgtgcgcgaagctatcaagcggaaacttagaacgctgattctcgccccgacccgcgttgtggccagcgagatggctgaagccctgaagggcatgcccatccggtatcaaacaaccgctgtcaaatccgagcacacagggaaggagattgtggacctgatgtgccatgccaccttcacgatgagactccttagccctgtgcgcgtccccaattacaacatgatcatcatggatgaagcgcactttacagacccttcttccattgccgctcggggctatatcagcaccagagttggaatgggcgaggccgctgccattttcatgaccgccacaccccctgggtctgtggaggcttttccgcagagcaatgcggtgatccaggatgaggaacgggacattcccgagcgctcctggaactctggatacgagtggatcaccgatttccctggcaaaacagtctggtttgtgcccagcatcaagtccgggaatgacattgccaactgtctgagaaagaatggaaaacgggttatccagctgtctcgcaagaccttcgatacggaatatcagaagaccaagaacaacgactgggactacgtggtcaccacagatattagcgagatgggcgctaattttagagccgaccgggtgatcgatcctagacgctgcctcaaacccgttattctgaaggacgggccggaacgggtgatccttgccggccctatgcccgtcaccgtggcttccgccgcgcagagacgcggacggattggcagaaaccataataaggagggggatcagtacatctatatgggacagcccctgaacaatgacgaggatcacgctcactggacggaagccaaaatgctcctggacaacatcaatacccctgagggcattatccccgccctgttcgaacctgagcgcgaaaagagcgctgccattgatggggagtaccggctcagaggagaggcgcgcaaaacattcgtcgaacttatgagacggggcgacctgccggtgtggctgtcttataaggttgcctccgaggggtttcaatacagcgatcgcagatggtgcttcgacggcgaacggaacaatcaggtgctcgaggaaaacatggatgtggagatctggaccaaagagggagaacgcaagaaactgagaccccggtggcttgacgctagaacatattccgaccctctggccctccgcgagtttaaggagttcgctgccggccggagatctgtcagcggggatctgattctggagatcggaaagctcccccagcatcttacccagcgcgctcaaaatgccctggacaacctggttatgctccacaattccgaacagggcgggcgggcgtacagacatgccatggaggagctgcctgatacaatcgaaacccttatgctgctcgctctgattgccgtgctgacgggaggcgtgacactctttttcctttctggccgggggctgggaaaaaccagcatcggcctgctctgtgtcatggcttccagcgtgctgctttggatggcctctgttgagccccactggattgccgcttccatcattctggaatttttcctcatggtgctgctgatcccggagcctgaccgccagagaacaccccaggataaccaactcgcgtatgtcgtgatcgggcttctgtttatgattctgacagtcgccgctaatgagatgggactcctggaaaccacaaagaaagaccttggcatcgggcacgtggccgttgagaaccatcaccatgccacgatgctggatgtggacctccaccctgctagcgcctggaccctgtacgcggtcgccacaaccattatcacacccatgatgcggcataccattgaaaacacgaccgctaatatctctctgacagccattgctaaccaggccgcgatcctcatgggacttgataagggctggcctatctccaaaatggacattggcgtgcccctgctggccctcgggtgctacagccaggttaatccgctgacccttacagctgccgtgctgatgctcgtcgctcactatgccatcattggacctggcctgcaagctaaggccacccgcgaggcgcagaagagaacggccgctgggatcatgaaaaaccccacagtggatggaattgtggccatcgacctggatcccgttgtctacgacgctaagttcgaaaaacagctcggccagatcatgcttctgattctgtgtacctctcaaatcctcctgatgcggacaacctgggccctttgcgagagcattaccctggccacagggcctctcacgaccctgtgggagggatccccgggcaagttttggaatacaaccatcgcggtgtctatggctaacattttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcatcatggaggtggaccggtccgaagctaaagaggggcttaagagaggagagacgacacgccacgccgtctctcggggcaccgcgaaactgagatggttcgttgaacgcaatctcgtgaagcccgaggggaaggtgattgatctgggatgtggcagagggggatggagctattactgcgccggcctgaaaaaggtcaccgaagtgaaaggctatacaaaagggggacctggccatgaggaacccatccctatggctacctacgggtggaacctcgttaaacttcactccggaaaggacgtgtttttcacaccccctgagaaatgtgatacgctgctgtgcgacattggcgagtctagcccgaatcccaccatcgaagaggggagaacactccgcgtcctgaagatggtggaaccttggcttcggggaaaccaattttgtattaagatcctgaatccctacatgccttccgttgtggagaccctcgagcagatgcagagaaaacatggcggcatgctggtccgcaaccccctgagcagaaattctacacacgaaatgtattgggtgtcctgcgggaccggaaacattgtgagcgccgtcaatatgacgtctagaatgctcctgaaccgcttcaccatggctcaccggaagccgacatacgagagagatgttgaccttggcgccgggacccgccatgtggcggtggaacctgaggtcgccaacctggatatcatcggacagagaattgaaaatatcaaacacgagcataagtccacatggcactatgacgaggataacccctacaaaacctgggcttatcatggcagctacgaagtgaagccctctgggtccgccagctccatggttaatggagtggtcaagctcctgacaaaaccttgggacgtgattcccatggttacccaaatcgctatgacggatacaaccccttttggccagcagcgggtgttcaaggagaaagtcgacacccgcacaccgaaggccaaaagaggcacggctcaaattatggaagtgaccgcccggtggctttgggggtttctgagcagaaacaagaagccccggatctgtacacgcgaggagttcaccagaaaagttcggtctaatgcggccatcggagctgtgtttgtcgacgagaaccagtggaatagcgccaaggaggctgtggaagatgagcgcttctgggacctcgtccagaaagaaagagagctgcacaagcagggcaaatgcgccacatgcgtgtataacatgatggggaagcgggaaaagaaactgggagagtttggcaaggccaaagggtcccgcgcgatttggtacatgtggctcggcgctagattcctggagtttgaagcccttggattcatgaatgaggatcactggttctctcgggaaaacagcctgtccggcgttgagggggagggactccataagctgggctacatccttcgcgacatttctaaaatccctgggggaaatatgtatgccgatgacaccgctggctgggatacaagaattaccgaagacgatctgcaaaacgaggccaagatcacggacatcatggaacccgagcacgctctcctggccaccagcatttttaaactgacataccagaataaggtggtccgggtgcagcgccctgcgaagaacgggaccgtgatggatgttatctccagacgggaccagcgcggctctggacaagtgggcacatatgggctcaataccttcacgaacatggaagcccagctgattagacagatggagagcgagggaatctttcttccctccgaactggagacaccgaacctcgctgaacgggtcctggattggcttgagaaatacggcgtggaaagactgaagcgcatggccattagcggggacgactgtgttgtgaaacctatcgatgaccggttcgctaccgccctcacagcgctgaatgatatgggaaaggtcagaaaagacatcccccagtgggagccttctaagggctggaacgattggcaacaggtgcccttttgctcccatcacttccaccagctgattatgaaggacgggcgcgagatcgtcgtgccttgtcggaatcaggatgaactcgttggcagagcccgcgtgagccaaggagctggctggtctctgcgggagaccgcctgccttgggaaatcctatgctcagatgtggcagctgatgtactttcatagacgcgacctccggctggccgctaacgccatttgtagcgcggtccccgtggattgggttccgacgtccagaaccacatggtctatccacgcccatcaccaatggatgaccacagaagacatgcttagcgtgtggaatcgcgtctggattgaggaaaacccttggatggaggataagacccatgtgtccagctggggagacgtgccctatctgggcaaacgggaggaccagtggtgcgggtctctcatcggactgacagctagagccacctgggcctccaatattcaggttgctatcaaccaggtccggagactgatcggcaatgaaaactacctcgattacatgacgagcatgaagcgcttcaaaaatgagggggaccccgaaggcgccctgtggtga

SEQ ID NO: 18930 - RNA, 9879 nt, synthetic construct
  misc_feature 1..9879: note = derived and/or modified CDS sequence (opt5) from DENV-1__FJ410225__SS-prME
  source 1..9879: mol_type = other RNA
agcgtgaccatgctgctcatgctgatgcccaccgctcttgctttccacctgacgaccagaggaggggaacctcatatgatcgtctccaagcaggaacggggaaaatctctcctgtttaagaccagcgccggcgttaacatgtgcacccttattgcgatggacctgggggaactctgtgaagataccatgacctacaaatgcccccgcatcacagaaaccgaacccgacgatgtggactgttggtgcaatgctacggatacctgggtgacatatggaacctgttcccaaacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcattggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccaggccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtgaaaagcatggtttctgctgggtccggagaggtggacagcttttccctcggcctgctgtgtatttctatcatgattgaagaggtcatgagaagccgctggtcccggagaatgctcatgacagggaccctggccgtgttctttcttctgatcatgggacagctcacatggaacgatctgattcgcctgtgcatcatggttggcgccaatgcttctgacagaatgggcatggggaccacctaccttgccctgatggcgacattcaaaatgcggcctatgtttgctgtgggactcctgttccgcagactcacgagccgggaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgagatctcttgggaagaggaagctgagcatagcggcgcgtcccacaatatcctcgtggaagtccaggatgacgggacgatgaaaattaaggatgaggagcgggacgataccctgacaatccttctgaaagccaccctcctggctgtgtctggagtttatcctctcagcattcccgccacactgttcgtgtggtacttctggcaaaagaaaaagcagcgctccggcgtcctttgggacaccccttctcccccggaagtggagagagccgtcctggatgacggcatctatcggattatgcagcgcgggctgctcggaagaagccaggtgggcgttggggtgtttcaagaaaacgtcttccatacgatgtggcacgtgacccggggagctgttctgatgtaccagggcaagagacttgagccttcctgggccagcgtgaaaaaggacctgatctcttacgggggaggctggcgcctccagggctcctggaatacaggggaggaagtccaggtgattgcggtggagcccggcaagaaccctaagaatgttcaaaccgctcccggcacatttaaaaccccggaaggggaggtcggagccatcgccctggatttcaagcctggcacaagcgggtctcccatcgtgaaccgggaaggaaagattgtgggcctctatggcaatggggtcgtgacgacctccggaacatacgttagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgtccgcgaagccatcaagcggaaactcagaacactgatccttgctccgacgcgcgtggttgccagcgagatggctgaagccctgaagggcatgcccattcggtaccaaaccacagcggtgaagtccgagcataccgggaaagagatcgtcgacctcatgtgccacgccacattcaccatgagactgctgagccctgctcgggtgcccaattataacatgattatcatggatgaagcccattttacggacccttcttccattgctgcccgcggctacatcagcacaagagttggaatgggcgaggccgctgcgatcttcatgaccgccacaccccctgggtctgtggaggcttttccgcagagcaatgccgtcattcaggatgaggaacgggacatccccgagcgctcctggaactctggatatgagtggattacagatttccctggcaagaccgtgtggtttgtgcccagcatcaaatccgggaatgacattgccaactgtctcagaaagaatggaaaacgggtcatccagctttctagaaagacattcgataccgaataccaaaagacgaaaaacaacgactgggactacgttgtgacaaccgatattagcgagatgggcgctaatttccgcgccgaccgggtgatcgatcctagacgctgcctgaagcccgtcatcctgaaagacgggccggaacgggtgattctcgcgggccctatgcccgttacagtggcttccgccgcccagagacgcggacggatcggcagaaaccacaataaggagggggatcagtatatttacatgggacagcccctgaacaatgacgaggatcatgctcactggaccgaagccaaaatgcttctggacaacatcaatacgcctgagggcattatccccgcgctctttgaacctgagcgcgaaaagagcgccgctatcgatggggagtatagactgcggggagaggcccgcaagaccttcgtcgaactgatgagacggggcgacctcccggtgtggctttcttacaaagttgcttccgaggggtttcaatatagcgatcgcagatggtgcttcgacggcgaacggaacaatcaggtgctggaggaaaacatggatgtcgagatttggacaaaggagggagaacgcaagaagctgcgcccccggtggctcgacgccagaacctactccgaccctctggctcttagagagtttaaagagttcgccgcgggccggagatctgtgagcggggatctgatcctcgagattggaaagctgccccagcacctgacacagcgggcccaaaatgctctcgacaaccttgtcatgctgcataattccgaacagggcgggcgcgcctatagacacgctatggaggagctgcctgataccatcgaaacactcatgctgcttgccctgattgccgtgctcaccggaggcgttacgctgtttttcctgtctggccgggggctcggaaaaacaagcatcggccttctgtgtgtgatggcttccagcgtgctgctctggatggcgtctgtcgagccccattggatcgccgcttccattatcctggaatttttccttatggttctgctcattccggagcctgaccgccagagaacaccccaggataaccaactggcctacgtggtgatcgggctgctctttatgattcttaccgtcgccgctaatgagatgggactgctggaaacaaccaagaaggacctcggcatcgggcacgtggccgttgagaaccaccatcacgcggccatgctggatgtggaccttcatcctgctagcgcctggacactgtacgctgtcgccacgaccattatcacacccatgatgcggcacaccatcgaaaacacaaccgcgaatatttctctcacggccatcgctaaccaggccgctattctgatgggactggataaaggctggcctatctccaagatggacattggcgtgcccctccttgccctggggtgctatagccaggtcaatccgctgaccctcacagctgccgtgctgatgcttgttgcgcattacgccatcatcggacctggcctgcaagctaaagccacccgcgaggctcagaagagaacagccgccgggattatgaaaaaccccaccgtggatggaatcgtcgcgattgacctcgatcccgtggtttatgacgctaagttcgaaaagcagctgggccagatcatgctgctcattctttgtacgtctcaaatcctgctgatgcggacaacctgggccctctgcgagagcatcacactggctaccgggcctcttaccacactgtgggagggatccccgggcaaattttggaatacgaccattgccgtgtctatggccaacatcttccgcggcagctacctcgctggggccggactggcgttctccctgatgaaaagcctcggcgggggaagacggggcacaggggcccagggagaaacccttggcgagaaatggaagagacagctgaatcagctgtccaaatctgaatttaacacatataagcgcagcggcattatggaggtcgaccggtccgaagctaaggaggggctcaaaagaggagagaccacgaagcacgccgtgtctcgcggcacagctaaactgcggtggttcgtggaaagaaatcttgttaagcccgaggggaaagtcatcgatctgggatgtggccgcgggggatggagctactattgcgccggcctcaagaaggtgaccgaagtgaaaggctacaccaaaggcgggcctgggcacgaggaacccattcctatggcgacatacgggtggaacctggtcaaactgcattccggaaaggacgtctttttcattccccctgagaaatgtgataccctcctttgcgacattggcgagtctagcccgaatcccacaatcgaagaggggcggacgctgagagtgctgaagatggtggaaccttggctccgcggaaaccaattttgtatcaaaattctgaatccctatatgccttccgtcgtggagacccttgagcagatgcagcggaagcacggcggcatgctggttagaaaccccctcagccgcaattctacacatgaaatgtactgggtgtcctgcgggaccggaaacatcgtcagcgccgtgaatatgacatctcggatgctgctgaacagattcaccatggctcaccgcaagccgacgtatgagagagatgttgacctcggcgccgggacccggcacgtggctgtcgaacctgaggtggccaacctggatattatcggacagcgcattgaaaatatcaaacatgagcacaagtccacatggcattacgacgaggataacccctataaaacctgggcttaccacggcagctatgaagtgaagccctctgggtccgccagctccatggtcaatggagttgtgaaacttctgacaaagccttgggacgtgatccccatggtcacccaaattgcgatgacagataccacgccttttggccagcagagagtgttcaaggagaaagttgacacacggaccccgaaggccaaaagaggcaccgctcaaatcatggaagtgacagccaagtggctctgggggtttctgagccggaacaaaaagccccgcatttgtacgagagaggagttcacccggaaggtccgctctaatgctgccatcggagccgtgtttgttgacgagaaccagtggaatagcgcgaaagaggctgtggaagatgagagattctgggaccttgtccatcgggaacgcgagctgcacaagcagggcaaatgcgccacatgcgtgtacaacatgatggggaagagagagaaaaagctcggagagtttggcaaggccaaagggtcccgggctatttggtacatgtggctgggcgcccgcttcctggagttcgaagctctcggatttatgaatgaggatcactggttctctagagaaaacagcctgtccggcgttgagggggagggacttcataagctgggctatatcctccgggacatctctaaaattcctgggggaaatatgtacgccgatgacaccgcgggctgggatacacgcatcaccgaagacgatctgcagaacgaggccagaattacagacatcatggaacccgagcacgcccttctggccaagagcatttttaaactcacctatcaaaataaggtggtccgggtgcagcgccctgctaaaaacgggacggtcatggatgtgatctccagacgggaccagagaggctctggacaggttggcacctacgggctgaatacattcaccaacatggaagcccaactgatccgccagatggagagcgagggaatcttttcccccagcgaactcgagacaccgaacctggcggaacgggtgcttgattggctggagaagtatggcgtcgaaagactcaagcgcatggccatctctggggacgactgtgtggtgaaacctattgatgaccggttcgctaccgccctgacggctcttaatgatatgggaaaggttagaaaagacatcccccagtgggagccttccaagggctggaacgattggcagcaagtgcccttttgcagccatcacttccaccagctgattatgaaagacgggcgcgagatcgtcgtgccttgtcggaatcaggatgaactcgttggcagagcccgcgtgtctcagggagctggctggtccctgcgggagacagcctgcctgggaaagagctacgcgcaaatgtggcagctcatgtattttcatagacgcgacctgcggcttgccgctaacgccatttgttccgccgtccccgtggattggatcccgacctctagaacaacctggagcatccacgctcatcaccagtggatgacgaccgaagacatgctgtccgtctggaatcgggtgtggattgaggaaaacccttggatggaggataagacacatatcagctcttggggagacgttccctacctcggcaaaagagaggaccaatggtgcgggtccctgattggacttaccgcccgcgcgacatgggctaccaatatccaggtggccattaaccaggtccggagactgatcggcaatgaaaactacctcgattatatgacaagcatgaagcgcttcaaaaatgagtctgaccccgaaggggccctgtggtga

SEQ ID NO: 18931 - RNA, 9879 nt, synthetic construct
  misc_feature 1..9879: note = derived and/or modified CDS sequence (opt5) from DENV-1__FJ410226__SS-prME
  source 1..9879: mol_type = other RNA
agcgtgaccatgctgctgatgctgatgcccacggcccttgctttccacctgacgaccagaggcggggagcctcatatgatcgtctccaagcaggaacggggaaagtctctcctgtttaagacaagcgccggcgttaatatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagataagcctgtgaacatcgaggccgaaccgcccttcggcgagtcttatattgtgatcggggccggagagaaagctctgaaacttagctggtttaagaaaggctcctctattgggaagatgttcgaagccaccgctagaggcgcccgccggatggcgatcctcggagacacagcctgggattttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgacagcggatgcgttgtgaactggaaaggccgcgagctcaagtgtgggtccggaatttttgtcacaaatgaagtgcacacctggacagagcaatataagttccaggccgactctcctaaacggctgagcgcggccatcggcaaggcttgggaagagggggtttgcggcattagatccgccacccgcctggagaacatcatgtggaaacagatctctaacgaactcaatcatattctgcttgagaacgatatgaagtttacggtggtcgtgggagacgtggctggcatcctggcccaggggaaaaagatgattcggccgcaacccatggaatacaaatatagctggaagtcctggggaaaggccaaaatcattggcgctgatgtccagaatacaaccttcatcatcgacgggcctaacacccccgagtgtcctgatgaccagagagcgtggaatatttgggaagttgaggattacggatttggcatcttcacaaccaacatttggctcaagctgcgcgacagctatacacaggtgtgcgatcaccggctgatgtctgccgctatcaaagactccaaggccgtgcacgccgatatgggctactggattgagagcgagaagaatgagacatggaaacttgctagagcctctttcatcgaagtcaagacctgtatctggcccaaatcccatacactctggagcaacggggtgctggagtctgaaatgattatcccgaagatttatggaggccctatcagccaacacaattaccgccccgggtactttacccagacagcgggaccttggcatctgggcaaactcgagctggacttcgatctttgcgaggggaccacggttgtggtcgacgaacactgcggaaaccggggcccctccctgagaaccacaaccgtgacaggcaagattatccacgagtggtgttgccggagctgtaccctccctcccctgcgctttaaaggggaagacggatgctggtatggcatggagatcagaccggttaaggagaaggaagagaatctggtgaaatctatggtctccgctgggagcggagaagtggattccttctctcttggcctcctgtgtattagcatcatgattgaggaagttatgcggtccagatggtctcgcaagatgctgatgacggggacactcgccgtgtttttcctgcttatcatgggacagctgacctggaacgacctcattcggctgtgcatcatggtcggcgccaatgctagcgatagaatgggcatggggacaacctacctggcccttatggcgacctttaaaatgcgccctatgttcgctgtgggactgctctttagacggctgacatcccgcgaggtgctcctgcttacgattggcctgtctctcgtcgccagcgttgagctgcccaactccctggaagaacttggggacggactggccatgggcatcatgatcctcaagctgctcaccgatttccaaagccatcagctgtgggctacacttctgtctctcacctttattaaaacaaccttctccctgcactatgcctggaagacgatggctatggtgctgagcatcgtgtctctttttcccctgtgtatgtccacaaccagccagaagaccacatggctccctgtcctgctcgggtctctgggatgcaaaccgcttaccatgttcctgattgccgaaaataagatctggggcagaaaatcctggcccctgaacgagggcattatggcggtggggatcgttagcatcctcctgtccagccttctgaagaacgacgtgcctctcgccggacccctgattgctggcgggatgctcatcgcctgttacgtcatttctggaagctccgctgatctgtctcttgaaaaagccgccgaggtgagctgggaggaagaggctgaacattccggcgcgtctcacaatatcctggttgaggtgcaggacgatgggacaatgaagattaaagacgaagaacgggatgacacgctgaccatcctcctgaaggccacacttctggctgtcagcggagtgtatcctctctccatccccgccaccctgttcgtctggtacttttggcaaaagaaaaagcagcgctctggcgtgctctgggatacaccttcccctcccgaggttgaaagagccgtgctggacgacggcatttatcggatcatgcagcgcgggcttctgggaagatcccaggtcggcgtgggggttttccaagagaacgtgtttcataccatgtggcacgtcacgcggggagctgtgctgatgtaccagggcaaacgcctcgaacccagctgggcctctgtgaagaaagatctgatttcctacgggggaggctggagacttcagggcagctggaataccggggaggaggttcaggtcatcgcggtggaacccggaaagaaccctaagaatgtgcaaacagctcccggcaccttcaaaacatctgagggggaagtcggagccattgccctggactttaagccgggcacctccgggagccctatcgtgaaccgggagggaaaaattgttggcctctatggcaatggggtggtcacaacgtccggaacctacgtgtctgctatcgcccaggcgaaggctagccaggaaggccccctgcctgagatcgaggatgaagttttcagaaaacgcaacctcacaattatggacctgcaccccgggtccggaaagacccggagatatcttcccgccatcgtgcgcgaggccattaagcggaaactgagaaccctgatcctcgctcctacacgcgtcgtggccagcgaaatggctgaggccctgaagggcatgccgattcggtaccaaacgaccgcggttaaatctgaacatacagggaaggagatcgtggatcttatgtgccacgccacctttacaatgagactgctctcccccgtccgcgtgcctaattataacatgatcattatggacgaggctcatttcaccgatcccagctctatcgccgctcggggctacattagcacgagagtgggaatgggcgaagccgccgctatctttatgacagcgacccctcccgggtccgtcgaggccttccctcagtctaatgctgttattcaggacgaggaacgggatatcccggaacgcagctggaactccggatatgagtggatcaccgactttcccggcaaaacagtgtggttcgtgccttctattaagagcgggaatgatatcgccaactgtctgagaaagaatggaaaacgggtcattcagctgtcccgcaagaccttcgacacagagtaccagaagaccaagaacaacgactgggattacgtggttacgacagacatcagcgaaatgggcgccaattttagagctgatcgggtgattgaccccagacgctgcctcaaacctgtcatccttaaggatgggcccgagcgggtgattctggccggcccgatgcctgttaccgtggcgtctgctgcccagagacgcggacggatcggcagaaaccacaataaggaaggggaccagtatgtctacatgggacagcccctgaacaatgatgaggaccatgcccactggacagaggctaaaatgctcctggataacatcaatacccccgaaggcattatccctgcccttttcgagcccgaacgcgagaagtccgcggccattgacggggaatatcggctgagaggagaggctcgcaaaacgtttgtggagctcatgagacggggcgatctgcctgtctggctgagctacaaggtggcctccgaagggttccaatattctgaccgcagatggtgctttgatggcgagcggaacaatcaggttctcgaagagaacatggacgtggaaatctggaccaaagagggagagcgcaagaaacttagaccgcggtggctggacgctagaacatacagcgatcccctggccctccgcgagttcaaggagtttgctgccggccggagatccgtgtctggggacctgattcttgaaatcggaaagctgcctcagcacctcacccagcgcgcgcaaaatgccctggataacctggtcatgctccataatagcgagcagggcgggcgggcttatagacacgccatggaggaacttcccgacacaatcgagaccctgatgctgctcgctctgattgccgttcttacaggaggcgtgaccctgttctttctctccggccgggggctgggaaaaacgagcatcggcctgctctgtgtgatggcctcttccgtccttctgtggatggctagcgtggaacctcattggattgcggcctctatcattctggagttctttctcatggttctgcttatccccgaaccggatcgccagagaacacctcaggacaaccaactggcttacgtggtcatcgggctcctgttcatgattctgaccgtggccgccaatgagatgggactccttgagaccacaaagaaagatctgggcatcgggcacgtcgctgtggaaaaccaccatcacgccgcgatgctggacgttgatctccatcccgcctccgcttggaccctgtacgccgtggctacaacgattatcacccctatgatgcggcacacaattgagaacaccacagccaatatcagccttaccgcgattgccaaccaggctgccatcctgatgggactcgacaagggctggcccatctctaaaatggatattggcgtccctctgctggctctcgggtgctatagccaggtgaatccccttacgctgaccgccgctgttctgatgctcgtggcccattacgcgatcattggaccgggcctgcaagccaaggctacacgcgaagcccagaagagaaccgctgccgggatcatgaaaaaccctacagtcgacggaattgtggccatcgatcttgaccccgtggtttatgacgcgaagtttgagaaacagctgggccagatcatgctcctgattctgtgtacctcccaaatcctccttatgcggacgacatgggctctgtgcgaatctattaccctggccacagggcccctcaccaccctgtgggagggaagccctggcaagttctggaatacaacgatcgctgtctccatggccaacattttccgcggcagctaccttgccggggctggactggccttttccctcatgaaatctctgggcgggggaagacggggcaccggggcgcagggagagacactgggcgaaaagtggaagcgccagctcaatcagcttagcaaatccgagttcaacacctataagagatctggcatcatggaagtggatcggagcgaggccaaagaagggctgaagagaggagagacaaccaaacacgctgtgtcccgcggcacggccaagctgcggtggtttgtcgagagaaatctcgttaagccggaagggaaagtgatcgacctgggatgtggccgcgggggatggtcttactattgcgctggccttaagaaagtgacagaggtcaagggctacaccaaagggggacccggccacgaggaacctattcccatggccacctacgggtggaacctggtgaagctccatagcggaaaagatgttttctttatccctcccgaaaagtgtgacacactgctgtgcgatattggcgagtccagccctaatccgaccatcgaggaagggcggacactcagagtgcttaagatggtcgagccctggctgcgcggaaaccaattctgtattaaaatcctgaatccttatatgccctctgtggttgaaacgctcgagcagatgcagcggaagcacggcggcatgctggtgagaaaccctctttcccgcaatagcacccatgagatgtactgggtctcttgcgggacaggaaacattgtgtccgcggtgaatatgaccagccggatgctgctcaacagatttacaatggcccaccgcaaacccacctatgaacgggacgtcgatctgggcgctgggacgagacacgttgccgtggagccggaagtggctaacctggacatcatcggacagcgcattgagaatatcaagcatgaacacaaatctacctggcattacgatgaggacaacccttataagacatgggcctaccacggctcctatgaggtcaagcccagcgggtccgctagctctatggtgaatggagttgtgaaactcctgaccaagccctgggatgtcattcctatggtgacacaaatcgccatgaccgacacaacccccttcggccagcagagagtttttaaagaaaaggtggacacgcggacacctaaagcgaagcgcggcaccgcccaaattatggaggtcaccgctaagtggctttgggggttcctgagcagaaacaaaaagccgcggatctgtacaagagaagagtttacgcggaaagtgcgctccaatgccgctatcggagccgttttcgtggatgaaaaccagtggaactctgccaaggaggcggtcgaggacgaaagattttgggatctcgtgcatcgggagcgcgaactgcacaaacagggcaagtgcgctacctgcgtctacaacatgatggggaagagagagaagaaacttggagagttcggcaaagccaaagggagccgggccatttggtacatgtggctgggcgctcgcttcctcgagtttgaggccctgggattcatgaatgaagaccactggttttccagagagaactctctgagcggcgtggaaggggagggactccataaactgggctatatccttcgggatatttccaagatccccgggggaaatatgtacgctgacgatacagccggctgggacacccgcattacagaggatgacctgcagaacgaagcgaaaatcaccgatatcatggagcctgaacacgccctcctggctaagtctattttcaaacttacatatcaaaataaagttgtgagagtccagcggcccgccaagaacgggaccgtgatggacgtgatcagccgcagagatcagcggggctccggacaggttggcacgtacgggctgaatacctttacaaacatggaggctcaactcattcgccagatggaaagcgagggaatcttctctccttccgagctggaaacccccaacctggccggcagagtgctcgactggctggagaaacatggggtcgaacggcttaagagaatggcgattagcggagacgattgtgtggttaaaccgatcgacgatcgctttgccacagctctgaccgccctcaatgacatgggcaaggtgcggaaggatatccctcagtgggagccctctaaagggtggaacgactggcagcaagtccctttctgctcccaccactttcatcagctgattatgaaggatggcagagaaatcgtggtcccctgtcgcaatcaggacgagcttgtgggacgggctagagttagccagggcgccgggtggtccctgcgcgagacggcttgcctcggaaaatcttatgcccaaatgtggcagctgatgtacttccaccggagagatctgcgcctcgcggccaacgctatttgtagcgccgtgcctgtcgactgggtgcccacatcccggaccacatggagcatccatgcccaccatcagtggatgaccacggaagatatgctgtctgtttggaatagagtgtggattgaggaaaacccgtggatggaggacaagacccacatctccagctggggcgacgtcccttatcttgggaaacgcgaagatcaatggtgcggatctctgattggcctcacagctcgggccacctgggcgacaaatatccaggtggctatcaaccaggtgagacggctgattgggaatgagaactaccttgactacatgaccagcatgaagagatttaagaatgagtccgatcccgaaggcgccctgtggtga

SEQ ID NO: 18932 - RNA, 9879 nt, synthetic construct
  misc_feature 1..9879: note = derived and/or modified CDS sequence (opt5) from DENV-1__FJ410227__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccaccacgcgcctggaaaacatcatgtggaagcagatttctaacgagctcaatcatatcctgcttgaaaacgacatgaaatttacagttgtggtcggagatgtggccggcattctggctcaggggaagaaaatgatccggccgcagcccatggagtacaagtatagctggaagtcctggggaaaagccaagattatcggcgccgacgtgcaaaataccaccttcatcattgatgggcctaacacacccgaatgtcctgacgatcagagagcttggaatatctgggaggtcgaggactacggatttggcattttcaccacgaacatctggctcaaactgcgcgatagctatacacaggtttgcgaccaccggctgatgtctgcggccattaaggattccaaagctgtgcacgccgacatgggctactggatcgaaagcgagaagaatgaaacctggaaacttgccagagcttctttcatcgaggtgaaaacatgtatttggcccaagtcccataccctctggagcaacggggtcctggaatctgagatgatcattccgaaaatctatggaggccctattagccagcacaattaccgccccgggtactttacacaaaccgccggaccttggcatctgggcaagctcgagctggatttcgacctttgcgaagggacgaccgtggttgtggatgagcactgcggaaaccggggcccctccctgagaacaaccacagtcaccggcaaaatcatccacgaatggtgttgccggagctgtacgctccctcccctgcgctttaagggggaggacggatgctggtatggcatggagattagaccggtgaaggaaaaagaggaaaatctggttaagtctatggtgtccgcggggagcggagaggtcgactccttctctcttggcctcctgtgtatcagcattatgatcgaagaggtgatgcggtccagatggtctcgcaaaatgctgatgacagggaccctcgctgtctttttcctgcttattatgggacagctgacatggaacgatctcatccggctgtgcattatggtgggcgccaatgccagcgacagaatgggcatggggaccacctacctggctcttatggccacatttaagatgcgccctatgttcgcggtcggactgctctttagacggctgacgtcccgcgaggtgctcctgcttaccatcggcctgtctctcgtggctagcgtcgaactgcccaactccctggaggaacttggggatggactggccatgggcatcatgattctcaaactgctcacagacttccagagccatcaactgtgggccacccttctgtctctcacatttatcaagaccacgttctccctgcactatgcttggaagacaatggccatggttctgagcattgtgtctctttttcccctgtgtctctccaccaccagccagaaaacaacctggctgcctgtgctcctggggtctcttggatgcaagccgctgacaatgttcctgatcgctgagaataaaatttggggcagaaagtcctggcccctcaacgaaggcatcatggccgtcgggatcgtgagcattctgctttccagcctgctcaaaaacgatgttcctctggcgggacccctcatcgccggcgggatgctgattgcttgttacgtgatctctggaagctccgccgacctttctctggagaaggctgccgaggtcagctgggaagaggaagccgagcattccggcgcttctcacaatattctggtggaagttcaggatgacgggacgatgaaaatcaaggatgaggagcgggacgataccctcacaatcctgcttaaggcgaccctgctcgccgtgagcggagtctatcctctgtccattcccgctacactcttcgtgtggtacttttggcagaaaaagaaacaacgctctggcgtcctgtgggacaccccttcccctcccgaagtggagagagccgttcttgatgacggcatctatcggattatgcagcgcgggctgctgggaagatcccaggtgggcgtcggggtgttccaggaaaacgtttttcatacgatgtggcacgtgacccggggagccgtcctcatgtaccaaggcaagcgcctggagcccagctgggcttctgtgaaaaaggaccttatctcctacgggggaggctggagactgcagggcagctggaatacaggggaggaagtgcaggttattgccgtcgagcccggaaagaaccctaaaaatgtgcagaccgcgcccggcacattcaagacctctgaaggggaggtgggagctatcgccctcgattttaaaccgggcacatccgggagccctattgtcaaccgggaaggaaagatcgtgggcctgtatggcaatggggttgtgacgacctccggaacatacgtctctgccatcgctcaagccaaagcgagccaggagggccccctccctgagattgaagacgaggtgttcagaaagcgcaacctgaccatcatggatcttcaccccgggtccggaaagacccggagatatctgcccgctattgttcgcgaagccatcaaacggaagctgagaacactcattctggcccctacgcgcgtggtcgctagcgagatggccgaagctcttaaaggcatgccgatccggtaccagaccacagccgtgaagtctgagcataccgggaaagagatcgttgacctgatgtgccacgcgacatttaccatgagactcctgtcccccgtgcgcgtccctaattataacatgattatcatggatgaagcccatttcacggaccccagctctattgctgcccggggctacatcagcacaagagtgggaatgggcgaggctgccgccatttttatgaccgctacccctcccgggtccgtggaagcgttccctcaatctaatgccgtcatccaggatgaggaacgggacatcccggagcgcagctggaactccggatatgagtggattacagattttcccggcaagaccgtttggttcgtgccttctatcaagagcgggaatgacattgctaactgtctgcgcaagaatggaaagcgggtgatccagctctcccgcaaaacattcgataccgaataccagaagacgaaaaacaacgactgggactacgtcgtgacaaccgatattagcgagatgggcgccaattttagagccgaccgggttatcgatcccagacgctgccttaagcctgtgattctgaaggacgggcccgaacgggtcatcctggctggcccgatgcctgtgacagttgcctctgcggctcaaagacgcggacggatcggcagaaaccacaataaagagggggatcagtatatttacatgggacagcccctcaacaatgacgaggatcatgcccactggaccgaagccaagatgctgcttgacaacatcaatacgcccgagggcattatccctgctctgttcgaacccgagcgcgaaaaatccgccgcgattgatggggagtatcggctcagaggagaggcccgcaagacctttgtggaactgatgagacggggcgacctgcctgtctggctcagctacaaagtggcttccgaggggttccagtattctgatcgcagatggtgctttgacggcgaacggaacaatcaagtccttgaggaaaacatggatgtggagatctggacaaaggagggagaacgcaaaaagctgagaccgcggtggctggacgccagaacctacagcgaccccctcgctctgcgcgagttcaaggaatttgccgctggccggagatccgtttctggggatcttatcctggagattggaaaactccctcagcacctgacacagcgcgcccagaatgcgctggacaacctcgtgatgcttcataatagcgaacaaggcgggcgggcctatagacacgctatggaggagctgcccgataccatcgaaacactgatgctcctggcccttattgctgtgctgaccggaggcgtcacgctgttctttctgtccggccgggggctgggaaagacaagcatcggcctcctttgtgttatggcctcttccgtgctgctgtggatggccagcgtggagcctcattggattgctgcgtctatcatcctcgagttctttctgatggtccttctgattcccgagccggaccgccagagaacccctcaggataaccagctcgcctacgtggttatcgggctgctgttcatgattctcaccgtggctgccaatgagatgggacttctggaaacaaccaaaaaggacctgggcatcgggcacgtcgccgctgagaaccaccatcacgccgcgatgctcgatgtggacctgcatcccgcctccgcttggacactttacgccgtcgctacgaccattatcacacctatgatgcggcacaccattgaaaacacaaccgccaatatcagcctgacggcgatcgccaaccaagctgccattctcatgggactggataaaggctggcccatctctaagatggacattggcgtgcctctgctcgctcttgggtgctatagccaggttaatcccctgaccctgacagccgctgtgctcatgctggtcgcccattacgcgatcattggaccgggccttcaggccaaggctacccgcgaggcccagaagagaacagctgccgggatcatgaagaaccctaccgtggatggaatcgttgccattgacctggatcccgtggtctatgacgcgaaatttgaaaagcagctcggccagatcatgctgctgattctctgtacgtcccagatccttctgatgcggacaacctgggctctgtgcgagtctattacactcgccaccgggcccctgaccacactttgggagggaagccctggcaaattctggaatacgaccatcgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcattatggaggtggaccggagcgaagccaaggaggggctgaaaagaggagagaccacgaagcacgctgtttcccgcggcacagccaagctccggtggtttgtcgaaagaaatctggtgaaaccggaggggaaggtgatcgatcttggatgtggccgcgggggatggtcttactattgcgctggcctgaaaaaggtcaccgaagttaaaggctacaccaaagggggacccggccacgaggaacctattcccatggccacatacgggtggaacctcgtgaaactgcatagcggaaaggacgtgttctttatccctcccgagaagtgtgataccctgctctgcgacattggcgagtccagccctaatccgacaatcgaagaggggcggacgcttagagtcctgaaaatggtggaaccctggctgcgcggaaaccagttctgtattaagatcctcaatccttatatgccctctgttgtggagaccctggagcaaatgcagcggaaacacggcggcatgcttgtcagaaaccctctgtcccgcaatagcacacatgaaatgtactgggtgtcttgcgggaccggaaacatcgtttccgcggtgaatatgacaagccggatgctcctgaacagatttaccatggcccaccgcaagcccacgtatgagcgggatgtcgacctgggcgctgggaccagacacgtggccgtggaaccggaggtcgctaacctcgatattatcggacagcgcattgaaaatatcaaacatgagcacaagtctacatggcattacgacgaggataacccttataagacctgggcctaccacggctcctatgaagttaaacccagcgggtccgctagctctatggtgaatggagtggtcaagctgcttacaaaaccctgggacgtgattcctatggttacccagatcgccatgacagataccacgcccttcggccaacagagagtgtttaaggagaaagtcgacacacggacccctaaggcgaagcgcggcaccgcccagatcatggaagtgacagctaaatggctgtgggggttcctcagcagaaacaagaaaccgcggatttgtacgagagaggaatttacccggaaggttcgctccaatgccgctatcggagccgtgttcgtcgacgagaaccaatggaactctgccaaagaggcggtggaagatgagagattttgggacctggttcatcgggaacgcgagcttcacaagcagggcaagtgcgctacatgcgtgtacaacatgatggggaaaagagaaaagaaactgggagagttcggcaaggccaaagggagccgggccatttggtacatgtggctcggcgctcgcttcctggagtttgaagccctgggattcatgaatgaggatcactggttttccagagaaaactctctcagcggcgtcgagggggagggactgcataaacttggctatatcctgcgggacatttccaaaatccccgggggaaatatgtacgctgatgacaccgccggctgggatacacgcatcaccgaagacgatctccagaacgaggcgaagattacagacatcatggaacctgagcacgccctgcttgctaagtctattttcaaactgacctatcagaataaggtggtcagagtgcaacggcccgccaaaaacgggacggttatggatgtgatcagccgcagagaccagcggggctccggacaggtcggcacctacgggctcaatacatttaccaacatggaagctcagctgattcgccaaatggagagcgagggaatcttctctccttccgaactggagacacccaacctcgccggcagagtgctggattggcttgaaaagcatggggtggagcggctgaaaagaatggcgatcagcggagacgactgtgttgtgaagccgattgatgaccgctttgccaccgctctcacggccctgaatgatatgggcaaggtccggaaagacatccctcagtgggaaccctctaaggggtggaacgattggcaacaggtgcctttctgctcccaccactttcatcaacttattatgaaagacggcagagagatcgttgtgccctgtcgcaatcaggatgagctggtcggacgggctagagtgagccagggcgccgggtggtccctccgcgaaacagcttgcctgggaaagtcttatgcccagatgtggcaactgatgtacttccaccggagagacctccgcctggcggccaacgctatttgtagcgccgtccctgtggattgggttcccacctcccggacaacctggagcatccatgcccaccatcagtggatgacgaccgaggacatgctttctgtgtggaatagagtctggattgaagagaacccgtggatggaagataaaacacacatctccagctggggcgacgtgccttatctggggaagcgcgaggaccagtggtgcggatctctcatcggcctgaccgctcgggccacatgggcgaccaatattcaagttgctatcaaccaggtgagacggcttattgggaatgagaactacctggattacatgacaagcatgaagagatttaaaaatgaatccgaccccgagggcgccctctggtga

SEQ ID NO: 18933 - RNA, 9879 nt, synthetic construct
  misc_feature 1..9879: note = derived and/or modified CDS sequence (opt5) from DENV-1__FJ859029__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaaatctctcctgtttaagacaagcgccggcgttaacatgtgcacccttattgccatggacctgggggagttctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggacatcttacgtgatgtgtaccggctccttcaagctggagaaagaagtcgccgagacccagcatggaacagtgctcgttcagatcaagtatgagggcaccgacgcgccgtgcaaaattccttttagcacacaggatgaaaagggggtgacgcaaaacggaagactgatcaccgctaatcccatcgtcacagacaaagagaagcctgtgaacattgaagccgagccgcccttcggcgagtcttacatcgtgattggggccggagaaaaggctctgaaacttagctggtttaagaaaggctcctctatcgggaagatgttcgaggccaccgctcggggcgccagacgcatggcgattctcggagatacagcctgggactttggcagcatcgggggagttttcacctccgtcggcaaactggtgcaccagatctttgggacggcttatggagtgctgttcagcggcgtctcttggaccatgaagattgggatcggcgtgctcctgacatggcttggactcaattcccggagcacctctctctccatgacatgtattgccgttggcctggtgaccctgtaccttggggtcatggtgcaggctgatagcggatgcgttatcaactggaagggcagagaactcaaatgtgggtccggaatttttgtgacaaatgaggtccatacctggacggaacagtacaagttccaagccgactctcctaaacgcctgagcgcggccatcggcaaggcttgggaggagggggtgtgcggcattcggtccgccacaagactggaaaacatcatgtggaaacagatctctaacgagctcaatcacattctgcttgaaaacgacatgaagtttaccgttgtggtcggagatgtggctggcatcctggcccaggggaaaaagatgattcgcccgcagcccatggagtataagtacagctggaaatcctggggaaaggccaaaatcattggcgctgacgtgcaaaataccacattcatcatcgatgggcctaacacccccgaatgtcctgacgatcagcgggcgtggaatatttgggaggtcgaggactatggatttggcatcttcacgacaaacatttggctcaagctgagagatagctacacccaggtttgcgaccaccgcctgatgtctgccgctatcaaagattccaaggccgtgcatgccgacatgggctattggattgaaagcgagaagaatgaaacatggaaacttgctcgggcctctttcatcgaggtgaagacctgtatctggcccaaatcccacacactctggagcaacggggtcctggaatctgagatgattatcccgaagatttacggaggccctatcagccagcataattatagacccgggtactttacccaaacggcgggaccttggcacctgggcaaactcgagctggatttcgacctttgcgaagggaccacagtggttgtggatgagcactgcggaaaccgcggcccctccctgcggaccacaaccgtcacgggcaagattatccatgaatggtgttgcagaagctgtacactccctcccctgcggtttaagggggaggacggatgctggtacggcatggagatccgcccggtgaaagaaaaggaggaaaatctggttaaatctatggtgtccgctgggagcggagaggtcgactccttctctcttggcctcctgtgtattagcatcatgattgaagaggtgatgagatcccggtggtctagaaagatgctgatgaccgggacactcgccgtttttctgcttctgatcatgggacagctcacctggaacgatctgattcgcctgtgcatcatggtgggcgccaatgctagcgaccggatgggcatggggaccacatatcttgccctgatggcgacgttcaaaatgagacctatgtttgctgtcggactcctgttccgcagactcacctcccgggaggtgctgcttctgacaattggcctctctctggtggccagcgtcgaactgcccaactcccttgaggaactgggggatggactcgccatgggcatcatgatcctgaagctcctgaccgactttcagagccaccaactttgggctacactgctctctctgaccttcattaagacgacattttccctgcattacgcctggaaaaccatggctatggttcttagcatcgtgtctctgttccccctctgtctgtccaccacaagccagaagaccacatggctccctgtgctgcttgggtctctgggatgcaaaccgctgacgatgtttctcattgccgagaataagatctggggccgcaaatcctggcccctgaacgaaggcattatggcggtcgggatcgtgagcatccttctgtccagcctcctgaagaacgatgttcctctcgccggacccctgattgctggcgggatgcttatcgcctgttatgtgatttctggaagctccgctgacctgtctctggagaaagccgccgaggtcagctgggaagaggaagctgagcactccggcgcgtctcataatatcctcgtggaagttcaggatgacgggaccatgaagattaaggatgaggagagagacgatacactgaccatccttctgaaagccacactcctggctgtgagcggagtctaccctctctccatccccgccaccctgttcgtgtggtatttctggcagaagaaaaagcaacggtctggcgtcctttgggacacgcctagccctcccgaagtggagcgcgccgttctggatgacggcatttacagaatcatgcagcgggggctgctcggacgctcccaggtgggcgtcggggtgtttcaggaaaacgttttccacaccatgtggcacgtgacaagaggagctgtcctgatgtatcaaggcaaacggcttgagcccagctgggcctctgtgaagaaggacctgatttcctacgggggaggctggcgcctccagggcagctggaataccggggaggaagtgcaggttatcgcggtcgagcccggcaaaaatcctaagaatgtgcagacagctcccggcacctttaaaacatctgaaggggaggtgggagccattgccctggatttcaagccgggcacgtccgggagccctatcgtcaacagagaaggaaaaattgtgggcctctacggcaatggggttgtgaccacatccggaacctatgtctctgctatcgcccaagcgaaggctagccaggagggccccctgcctgagatcgaagacgaggtgtttcggaagagaaaccttaccattatggatctgcatcccgggtccggaaaaacacgccggtacctgcccgccatcgttagagaagccattaagcgcaaactccggacgctgatccttgctcctaccagagtggtcgccagcgagatggctgaagccctgaagggcatgccgattcgctatcagacaaccgcggtgaaaggggagcacacaggcaaggagatcgttgacctcatgtgccatgccaccttcacgatgcggctgctgtctcccgtgagagtccctaattacaacatgatcattatggatgaagctcactttacagacccctccagcatcgccgctcgcggatatatttctacccgggtgggcatgggggaggccgccgctatcttcatgaccgcgacacctcccggaagcgtggaagcctttcctcaatccaatgctgtcattcaggatgaggaaagagacatcccggagcggtcttggaacagcggctacgagtggatcaccgatttccccgggaagacagtttggtttgtgccttccattaaatctggaaatgacatcgccaactgtctccgcaagaatggcaaaagagtgattcagcttagccggaagaccttcgatacggaatatcagaaaacaaagaacaacgactgggactacgtcgtgaccacagatatctccgagatgggggccaatttccgcgctgacagagttattgatccccggagatgcctgaagcctgtgatcctgaaagacggccccgaacgcgtcattctcgccggaccgatgcctgtgaccgttgcgagcgctgcccaacggagaggccgcatcgggcggaaccataataaggagggagatcagtacatctatatgggccagcccctgaacaatgacgaggatcacgcccactggacggaagctaaaatgcttctggacaacattaatacccccgaggggatcattcctgccctctttgaacccgagagagaaaagtctgcggccatcgatggagagtaccgcctgcggggcgaggctagaaaaacattcgtggaactgatgcgcagaggggacctccctgtctggctttcctataaggtggccagcgagggctttcagtactccgatcggcgctggtgcttcgacggagaaagaaacaatcaagtcctggaggaaaacatggatgtggagatttggaccaaagagggcgaacggaagaagctgcgcccgagatggctcgacgctcggacatattctgaccccctggcccttagagagtttaaagagttcgctgccgggcgccggagcgtttccggagatctgatcctcgagatcggcaagctgcctcagcatctgacccagagagcgcagaatgccctcgacaaccttgtgatgctgcacaattctgaacaagggggacgcgcttaccggcatgccatggaggagctgcccgatacaattgaaaccctcatgctgcttgctctgatcgccgtgctcacgggcggcgtcacactgtttttcctgagcgggagaggactcggcaaaacctccattgggcttctgtgtgttatggccagctctgctctgctctggatggcgtccgtggagcctcactggatcgccgctagcattatcctggaatttttccttatggtgctgctcatccccgagccggaccggcagcgcacccctcaggataaccagctggcctatgtcgtgattggactgctctttatgatccttacagttgccgctaatgagatgggcctgctggaaaccacaaagaaagacctcgggattggacacgtggccgtcgagaaccatcaccatgcggccatgctggatgtggaccttcaccccgcttctgcctggacgctgtacgctgtcgccaccacaatcattacccctatgatgagacatacaatcgaaaacaccacggcgaatatttccctcaccgccatcgctaaccaagccgctatcctgatgggcctggataagggctggcccattagcaagatggacatcggggtgcctctccttgccctgggatgctactctcaggttaatcccctgacactcaccgctgccgtgctgatgcttgtcgcgcactatgccattatcggcccggggctgcaggctaaagccacacgggaggctcaaaagcgcaccgccgccggaattatgaaaaaccctacggtggatggcatcgttgcgatcgacctcgatcccgtggtctacgacgctaagttcgaaaaacagctggggcagattatgctgctcgtgctttgtacaagccagatcctgctgatgagaaccacatgggccctctgcgagtccattaccctggctaccggaccccttacaacgctgtgggagggctctcctggcaagttttggaataccacaatcgccgtgagcatggccaacattttccgggggtcctatctcgctggagccggcctggcgttcagcctgatgaagtccctcgggggaggccgcagagggaccggagcccaaggcgaaacacttggcgagaaatggaagcggcagctgaatcagctgtctaaaagcgaatttaacacctacaagcgctccgggatcatggaggttgacagatctgaagctaaagagggactcaagcggggcgagacgacaaagcacgccgtcagcagagggaccgctaaactgcgctggttcgtggaacggaatcttgtgaagccggagggaaaagtcatcgatctgggctgtgggagaggaggctggtcctattactgcgccggcctcaagaaagttaccgaagtgaaggggtatacaaaaggaggccccgggcatgaggaacctattcccatggcgacctacggatggaacctggtgaagctgcactctggcaaggacgtctttttcatccctcccgagaaatgtgatacactcctttgcgacattggggagagctcccctaatccgacgatcgaagagggacgcaccctgcgggtgctgaagatggttgaaccctggctcagaggcaaccagttttgtattaaaatcctgaatccttacatgcccagcgtggtcgagacacttgagcaaatgcagcgcaagcatggcgggatgctggtgcggaaccctctctctagaaattccacccacgaaatgtattgggttagctgcggaacaggcaacattgtgtctgccgtcaatatgacctcccgcatgctgctgaaccggttcacgatggctcacagaaaacccacctacgagcgcgatgtggacctcggggccggaacacggcatgtggctgtcgaaccggaggttgccaacctggatatcatcggccagagaattgaaaatatcaagcacgagcataagagcacctggcactatgacgaggataacccttacaaaacatgggcttatcatgggtcttacgaagccaagccctccggaagcgcgtccagcatggtgaatggcgtggtcaaacttctgaccaagccctgggacgtgattcctatggttacacagatcgccatgaccgatacgacaccctttggccaacagcgcgtgttcaaagagaaggtcgacaccagaacccctaaggctaaacgggggacagcccagattatggaagtgacggctaagtggctctggggatttctgtctcgcaacaaaaagccgagaatctgtacccgggaggagttcacaagaaaagttcggagcaatgccgccatcggcgcggtgtttgtcgacgagaaccaatggaactccgctaaggaggccgtggaagatgagcgcttctgggaccttgttcacagagaacgggagctgcacaagcaggggaaatgcgcgacctgcgtgtataacatgatgggaaagcgcgagaaaaagctcggcgagtttgggaaagctaagggctctagagccatttggtacatgtggctgggagctcggttcctggagttcgaagccctcggctttatgaatgaggatcattggttcagccgcgaaaactccctgtctggggtcgagggagagggccttcacaaactggggtacatcctcagagacattagcaagatccccggaggcaatatgtatgcggatgacacagccgggtgggatacccggattacagaagacgatctgcagaacgaggctaagatcaccgacatcatggaacctgagcatgcccttctggctaaatccatttttaagctcacgtaccagaataaagtggtccgcgtgcaaagacccgccaagaacggcaccgttatggatgtgatctctcggcgcgaccagagaggaagcggccaggtcgggacatatggactgaataccttcacaaacatggaagcgcagctgattcggcaaatggagtccgaggaaatctttagcccttctgagctcgaaacccccaacctggccggccgcgtgcttgattggctggagaaacacggggtggaaagactcaagcggatggctatttccggagacgactgtgttgtgaagccgatcgatgacagattcgccacggctctgacagcccttaatgatatgggcaaagtccgcaaggacatccctcagtgggagcccagcaaagggtggaacgattggcaacaggtgcctttttgctctcaccatttccaccaactgattatgaaggacggccgggagatcgttgtgccctgtagaaatcaggatgaactcgtcggacgcgctcgggtgtcccagggcgccgggtggagcctgagagagaccgcgtgcctgggaaaatcctacgcccagatgtggcaactcatgtattttcatcgccgggacctgagacttgctgccaacgccatttgttctgctgtccctgtggattgggttcccacaagccgcaccacgtggtccatccacgcccatcaccagtggatgaccacagaagacatgctgagcgtgtggaatcgggtctggattgaggaaaacccgtggatggaggataagacccacatctcttcctggggcgacgtgccttacctcgggaagagagaggaccagtggtgcggaagcctgattggccttacagcgcgcgctacctgggccacaaatatccaagttgccatcaaccaggtgcggagactgattgggaatgaaaactatctcgattacatgacctctatgaaacggttcaagaatgagagcgaccccgaaggcgctctgtggtga

SEQ ID NO: 18934 - RNA, 9879 nt, synthetic construct
  misc_feature 1..9879: note = derived and/or modified CDS sequence (opt5) from DENV-1__FJ547065__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggaactctgtgaagataccatgacctacaaatgccccagaatcacagaaaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatctgagagcttggaatatctgggaggtcgaggactacggattcggcatttttacgacaaacatctggctgaaacttcgcgattcctatacccaggtttgcgaccaccggctcatgagcgcggccattaaagattctaaggctgtgcacgccgacatgggctactggatcgaatccgagaaaaatgaaacatggaagctggccagagctagcttcatcgaggtgaagacctgtatttggcccaaatctcatacactgtggtccaacggggtcctcgaaagcgagatgatcattccgaagatctatggaggccctatttctcagcacaattaccgccccgggtacttcacccaagccgcgggaccttggcatctgggcaaacttgagctggattttgacctctgcgaagggacgaccgtggttgtggatgagcactgcggaaaccggggccccagcctgagaacaaccacagtcaccggcaagatcatccacgaatggtgttgccggtcctgtacgctgcctccccttcgcttcagaggggaggacggatgctggtatggcatggagattcggccggtgaaagaaaaggaggaaaatctcgttaagagcatggtgtctgctgggtccggagaggtcgacagcttttccctgggcctgctctgtatctctattatgatcgaagaggtgatgagaagccgctggtcccggagaatgctgatgacagggacccttgccgttttctttctgctcattatgggacagctgacatggaacgatctgatccgcctttgcattatggtgggcgccaatgcttctgacagaatgggcatggggaccacctacctggccctcatggcgacattcaaaatgcggcctatgtttgctgtcggactcctgttccgcagactgacgagccgggaggtgcttctgctcaccatcggcctgtccctggtggcctctgtcgaacttcccaacagcctggaggaactcggggatggactggccatgggcatcatgattctcaagctgcttacagactttcagtcccatcaactgtgggctaccctcctgagcctgacattcatcaaaaccacgttttctcttcactatgcctggaagacaatggctatggttctgtccattgtgagcctcttccccctgtgtctctctaccacctcccagaaaacaacctggctgcctgtgcttctggggagcctgggatgcaagccgctcacaatgtttctgatcgccgagaataagatttggggccgcagatcttggccccttaacgaaggcatcatggcggtcgggatcgtgtccattctgctcagctccctgctcaaaaacgatgttcctctggccggaccccttatcgctggcgggatgctgattgcctgttacgtgatcagcggatctagcgctgacctgtccctcgagaaggccgccgaggtctcttgggaagaggaagctgagcatagcggcgcgtcccacaatattctggtggaagttcaggatgacgggacgatgaaaatcaaggatgaggagcgggacgatacccttacaatcctgctcaaagccaccctgctcgctgtgtctggagtctatcctctgagcattcccgccacacttttcgtgtggtacttctggcagaagaaaaagcaacgctccggcgtcctgtgggacaccccttctcccccggaagtggagagagccgttctggatgacggcatctatcggattatgcagcgcgggctcctgggaagaagccaggtgggcgtcggggtgtttcaggaaaacgttttccatacgatgtggcacgtgacccggggagctgtccttatgtaccaaggcaagagactggagccttcctgggccagcgtgaaaaaggacctcatctcttacgggggaggctggcgcctgcagggctcctggaatacaggggaggaagtgcaggttattgcggtcgagcccggcaagaaccctaagaatgtgcagaccgctcccggcacatttaaaaccccggaaggggaggtgggagccatcgccctcgatttcaagcctggcacaagcgggtctcccattgtcaaccgggaaggaaagatcgtgggcctgtatggcaatggggttgtgacgacctccggaacatacgtcagcgctatcgcccaagcgaaggcttcccaggagggccctcttcccgagattgaagacgaggtgtttagaaagcgcaacctgaccatcatggatctgcaccccgggtctggaaaaacccggagatatctccctgccattgttcgcgaagccatcaagcggaaactgagaacacttattctggctccgacgcgcgtggtcgccagcgagatggctgaagccctcaagggcatgcccatccggtaccagaccacagcggtgaagtccgagcataccgggaaagagatcgttgacctgatgtgccacgccacattcaccatgagactgctcagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcaaagcaatgctgtcatccaggatgaggaacgggacatccccgagcgctcctggaactctggatatgagtggattacagatttccctggcaagaccgtttggtttgtgcccagcatcaaatccgggaatgacattgccaactgtcttagaaagaatggaaaacgggtgatccagctgtctagaaagacattcgataccgaataccagaagacgcgcaacaacgactgggactacgtcgtgacaaccgatattagcgagatgggcgccaatttccgggctgacagagttatcgatcctcgccggtgcctgaaacccgtgattctcaaggacgggccggaaagagtcatcctggccggccctatgcccgtgacagttgcgtccgctgcccaacgccggggaagaatcggccgcaaccacaataaagagggggatcagtatatttacatgggacagccccttaacaatgacgaggatcatgcccactggaccgaagctaagatgctgctcgacaacatcaatacgcctgagggcattatccccgccctgtttgaacctgagagagaaaagagcgcggccattgatggggagtatcggctgcgcggagaggctagaaagaccttcgtggagctcatgcggcgcggcgaccttccggtctggctgtcttacaaggtggcctccgaggggtttcagtatagcgatagaaaatggtgcttcgacggcgaacggaacaatcaagtcctggaggaaaacatggatgtggagatctggacaaaggagggagaacgcaaaaagctccgcccccggtggctggacgctagaacctactccgaccctcttgccctgcgcgagtttaaagagttcgctgccggccggagatctgttagcggggatctcatcctggagattggaaagctgccccagcacctcacacagcgggcgcagaatgcccttgacaacctggtgatgctgcataattccgaacaaggcgggcgcgcttatagacacgccatggaggagctccctgataccatcgaaacactgatgcttctggctctcattgccgtgctgaccggaggcgtcacgctgtttttcctctctggccgggggcttggaaaaacaagcatcggcctgctgtgtgttatggcctccagcgtgctcctgtggatggcttctgtggagccccattggattgcggcctccatcatccttgaatttttcctgatggtcctcctgattccggagcctgaccgccagagaacaccccaggataaccagctggcttacgtggttatcgggctcctttttatgattctgaccgtggccgccaatgagatgggactgctcgaaacaaccaagaaggacctgggcatcgggcacgtcgctgtggagaaccaccatcacgccgcgatgcttgatgtcgacctgcatcctgccagcgcttggacactctacgccgtggctacgaccattatcacacccatgatgcggcacaccattgaaaacacaaccgccaatatctctctgacggcgatcgccaaccaagctgccattctgatgggactcgataaaggctggcctatctccaagatggacattggcgttccccttctggctctggggtgctatagccaggtgaatccgctcaccctgacagccgctgtccttatgctggtggcccattacgcgatcattggacctggcctccaggccaaagctacccgcgaggcccaaaagagaacagctgccgggatcatgaaaaaccccaccgttgatggaatcgtggccattgacctggatcccgtcgtgtatgacgcgaagttcgaaaagcagctgggccagatcatgctccttattctgtgtacgtctcagatcctgctcatgcggacaacctgggctctgtgcgagagcattacacttgccaccgggcctctgaccacactctgggagggatccccgggcaaattttggaatacgaccatcgctgtgtctatggccaacatcttccgcggcagctacctggccggggctggactggccttctccctcatgaaaagccttggcgggggaagacggggcacaggggcgcaaggagaaaccctgggcgagaaatggaagagacagctgaatcagctctccaaatctgaatttaacacatataagcgcagcggcattatggaggttgaccggtccgaagccaaggaggggctgaaaagaggagagaccacgaagcacgctgtctctcgcggcacagccaaacttcggtggttcgtggaaagaaatctggtgaagcccgaggggaaagtcatcgatctcggatgtggccgcgggggatggagctactattgcgctggcctgaagaaggttaccgaagtgaaaggctacaccaaaggcgggcctgggcacgaggaacccattcctatggccacatacgggtggaacctggtgaaactccattccggaaaggacgtctttttcattccccctgagaaatgtgatacccttctgtgcgacatcggcgagtctagcccgaatcccacaatcgaagaggggcggacgctgagagtgctcaagatggttgaaccttggctgcgcggaaaccagttttgtattaaaatccttaatccctatatgccttccgtggtcgagaccctggagcaaatgcagcggaagcacggcggcatgctcgtgagaaaccccctgagccgcaattctacacatgaaatgtactgggtttcctgcgggaccggaaacatcgtgagcgcggtcaatatgacatctcggatgctgctcaacagattcaccatggcccaccgcaagccgacgtatgagagagatgtggacctgggcgctgggacccggcacgtggccgtcgaacctgaggttgctaaccttgatattatcggacagcgcattgaaaatatcaaacatgagcacaagtccacatggcattacgacgaggataacccctataaaacctgggcctaccacggcagctatgaagtgaagccctctgggtccgctagctccatggtgaatggagtcgtgaaactgctcacaaagccttgggacgttattcccatggtgacccagatcgccatgacagataccacgccttttggccaacagagagtcttcaaggagaaagtggacacacggaccccgaaggcgaaaagaggcaccgcccagatcatggaagttacagctaagtggctgtgggggtttcttagccggaacaaaaagccccgcatttgtacgagagaggagttcacccggaaggtgcgctctaatgccgctatcggagccgtctttgtggacgagaaccaatggaatagcgccaaagaggcggttgaagatgagagattctgggacctggtgcatcgggaacgcgagctccacaagcagggcaaatgcgctacatgcgtctacaacatgatggggaagagagagaaaaagctgggagagtttggcaaggccaaagggtcccgggccatttggtacatgtggctgggcgctcgcttcctcgagttcgaagccctgggatttatgaatgaggatcactggttctctagagaaaacagcctttccggcgtggagggggagggactgcataagctcggctatatcctgcgggacatttctaaaatccctgggggaaatatgtacgctgatgacaccgccggctgggatacacgcatcaccgaagacgatcttcagaacgaggcgagaattacagacatcatggaacccgagcacgccctgctcgctaagagcatttttaaactgacctatcagaataaggtcgtgcgggttcaacgccctgccaaaaacgggacggtgatggatgtcatctccagacgggaccagagaggctctggacaggtgggcacctacgggctgaatacattcaccaacatggaagctcagctcattcgccaaatggagagcgagggaatcttttcccccagcgaactggagacaccgaaccttgccgaacgggtgctggattggctcgagaagtatggcgttgaaagactgaagcgcatggcgatctctggggacgactgtgtggtcaaacctattgatgaccggttcgccaccgctcttacggccctgaatgatatgggaaaggtgagaaaagacatcccccagtgggagccttccaagggctggaacgattggcagcaggttcccttttgcagccatcacttccaccaactcattatgaaagacgggcgcgagatcgtggtcccttgtcggaatcaggatgaactggtgggcagagctcgcgtctctcagggagccggctggtccctgcgggagacagcttgcctcggaaagagctacgcccagatgtggcaactgatgtattttcatagacgcgaccttcggctggcggccaacgctatttgttccgccgtgcccgttgattggatcccgacctctagaacaacctggagcattcacgcccatcaccagtggatgacgaccgaagacatgctctccgtgtggaatcgggtctggatcgaggaaaacccttggatggaggataagacacatatcagctcttggggagacgtgccctacctgggcaaaagagaggaccagtggtgcgggtcccttattggactgaccgctcgcgccacatgggcgaccaatatccaagttgctattaaccaggtgcggagactcatcggcaatgaaaactacctggattatatgacaagcatgaagcgcttcaaaaatgagtctgaccccgaaggggccctgtggtga

SEQ ID NO: 18935 - RNA, 9879 nt, synthetic construct
  misc_feature 1..9879: note = derived and/or modified CDS sequence (opt5) from DENV-1__FJ410230__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaaatctctcctgtttaagaccagcgccggcgttaatatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgattggggccaccgaaatccagacatccggaaccacaaccatttttgccggccatctcaaatgcagactgaagatggataaacttacgctgaaggggatgagctatgtgatgtgtacaggctctttcaaactcgagaaggaactggctgagacccagcacggaaccgtcctggtgcagatcaagtacgagggcacagacgccccgtgcaaaatccctttctccacccaagatgaaaagggggttacacagaacggacggcttattacggcgaatcccatcgtgaccgacaaagagaagcctgtcaacattgaagctgagccgccctttggcgagagctatatcgtgattggggccggagaaaaagccctcaagctgtcttggttcaagaaaggcagctccatcgggaagatgtttgaggctacagccagaggcgctcgccggatggccatcctgggagataccgcgtgggacttcggctctattgggggagtgtttacaagcgttggcaaactcgtccatcagatcttcgggaccgcctacggagtgctgttttccggcgtgagctggacgatgaagattgggatcggcgtccttctgacctggctcggactcaattctagatccacaagcctgtctatgacctgtattgctgtgggccttgttacactctacctgggggtgatggtccaggccgattccggatgcgtgatcaactggaaaggccgcgaactgaagtgtgggagcggaattttcgttaccaatgaggtgcacacatggaccgaacaatataagtttcaggctgactcccctaaacggctctctgccgcgatcggcaaggcctgggaggagggggtctgcggcatcagaagcgctacgcgcctggaaaacattatgtggaaacagatctccaacgagcttaatcatattctgctcgaaaacgacatgaagttcacagtggttgtgggagatgtcgccggcatcctggctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaaacttcgcgattcctacacacaggtctgcgaccaccggctcatgagcgcggccatcaaagattctaaggctgttcatgccgacatgggctattggatcgaatccgagaaaaatgaaacctggaagctggccagagctagcttcattgaggtgaagacatgtatctggcccaaatctcacaccctgtggtccaacggggtgctcgaaagcgagatgattatcccgaagatttacggaggccctatctctcaacataattatcgccccgggtacttcacacagaccgccggaccttggcacctgggcaaacttgagctggattttgacctctgcgaagggacgaccgtcgtggttgatgagcactgcggaaaccggggccccagcctgagaacaaccacagtgaccggcaagatcattcatgaatggtgttgccggtcctgtacgctgcctccccttcgcttcagaggggaggacggatgctggtacggcatggagatccggccggtcaaagaaaaggaggaaaatctcgtcaagagcatggtttctgcggggtccggagaggtggacagcttttccctgggcctgctctgtatttctatcatgattgaagaggtcatgagaagccgctggtcccggaaaatgctgatgacagggacccttgctgtgttctttctgctcatcatgggacagctgacatggaacgatctgattagactttgcatcatggttggcgccaatgcctctgaccgcatgggcatggggaccacctatctggctctcatggccacattcaagatgagacctatgtttgcggtgggactgctgttccggcgcctgacgagcagagaggtccttctgctcaccatcggcctgtccctggtggcttctgtggaacttcccaacagcctggaggaactcggggatggactggccatgggcattatgatcctcaaactgcttacagactttcaatcccaccagctgtgggccaccctcctgagcctgacattcattaagaccacgttttctcttcattacgcttggaaaacaatggccatggtcctgtccatcgttagcctcttccccctgtgtctctctaccacctcccagaagacaacctggctgcctgtgcttctggggagcctgggatgcaagccgctcacaatgtttctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttatgttattagcggatctagcgccgacctgtccctcgagaaagctgccgaggtgtcttgggaagaggaagccgagcacagcggcgcttcccataatatcctggtcgaagtgcaggatgacgggacgatgaagatcaaagatgaggagagagacgatacccttacaattctgctcaaggcgaccctgctcgccgtttctggagtgtaccctctgagcatccccgctacacttttcgtctggtatttctggcagaagaagaagcagcggtccggcgtgctgtgggacaccccttctcccccggaagtcgagcgcgccgtgctggatgacggcatttacagaatcatgcagcgggggctcctgggacgcagccaggttggcgtgggggtctttcaagaaaacgtgttccacacgatgtggcacgttaccagaggagccgtgcttatgtatcagggcaaacggctggagccttcctgggctagcgtcaagaaagacctcatttcttacgggggaggctggagactgcagggctcctggaatacaggggaggaagtccaggtgatcgccgttgagcccggaaagaaccctaaaaatgtccaaaccgcgcccggcacatttaagaccccggaaggggaggtgggagctattgccctcgatttcaagcctggcacaagcgggtctcccatcgtgaaccgcgaaggaaaaatcgtcggcctgtacggcaatggggtggttacgacctccggaacatatgtgagcgccattgctcaggccaaggcgtcccaggagggccctcttcccgagatcgaagacgaggtctttcggaaaagaaacctgaccattatggatctgcatcccgggtctggaaagacccgccggtacctccctgctatcgtgagagaagccattaaacgcaagctgcggacacttatcctggccccgacgagagttgtggctagcgagatggccgaagctctcaagggcatgcccatccgctatcaaaccacagccgtcaaatccgagcacaccgggaaggagattgtggacctgatgtgccatgcgacattcaccatgcggctgctcagccctgttagagtgcccaattacaacatgatcattatggatgaagcccactttacggacccttcttccatcgctgcccggggctatattagcacacgcgtcggaatgggcgaggctgccgccatcttcatgaccgctacaccccctgggtctgtggaagcgtttccgcagagcaatgccgtgatccaggatgaggaaagagacattcccgagcggtcctggaactctggatacgagtggatcacagatttccctggcaaaaccgtctggtttgttcccagcattaagtccgggaatgacatcgctaactgtcttcgcaaaaatggaaagagagtgattcagctgtctcggaagacattcgataccgaatatcagaagacgaagaacaacgactgggactacgtggtcacaaccgatatcagcgagatgggcgccaatttcagagccgaccgcgtgattgatcctcggagatgcctgaaacccgttatcctcaaggacgggccggaacgcgtgatcctggctggccctatgcccgtcacagtggcctccgcggctcagcggagaggacgcattggccggaaccataataaagagggggatcagtacatctatatgggacagccccttaacaatgacgaggatcacgcccactggaccgaagccaagatgctgctcgacaacattaatacgcctgagggcatcattcccgctctgtttgaacctgagagagaaaagagcgccgcgatcgatggggagtaccgcctgagaggagaggcccggaaaaccttcgttgaactcatgcgcagaggcgaccttccggtgtggctgtcttataaggtcgcttccgaggggtttcaatacagcgatcggcgctggtgcttcgacggcgaaagaaacaatcaggtgctggaggaaaacatggatgtcgagatctggacaaaagagggagaacggaagaaactcagaccccgctggctggacgcccggacctattccgaccctcttgctctgagagagtttaaggagttcgccgctggccgccggtctgtgagcggggatctcattctggagatcggaaaactgccccagcatctcacacagagagcccaaaatgcgcttgacaacctggttatgctgcacaattccgaacagggcgggcgggcctaccgccatgctatggaggagctccctgataccattgaaacactgatgcttctggccctcatcgctgtgctgaccggaggcgtgacgctgtttttcctctctggcagagggcttggaaagacaagcattggcctgctgtgtgtcatgtccagctctgttctcctgtggatggcctccgtggagccccactggatcgccgctagcatcattcttgaatttttcctgatggtgctcctgatcccggagcctgaccggcagcgcacaccccaggataaccaactggcgtatgtcgtgattgggctcctttttatgatcctgaccgttgccgctaatgagatgggactgctcgaaacaaccaagaaagacctgggcattgggcacgtggccgtcgagaaccatcaccatgccgctatgcttgatgtggacctgcaccctgcctctgcgtggacactctacgccgtcgctacgaccatcattacacccatgatgagacataccatcgaaaacacaaccgccaatatctccctgacggctattgccaaccaggcggccatcctgatgggactcgataagggctggcctattagccggatggacatcggcgtgccccttctggctctggggtgctactctcaggttaatccgctcaccctgacagccgctgtgcttatgctggtcgcccactatgctattatcggacctggcctccaagccaaagcgacccgcgaggcccagaagagaacagctgccgggatcatgaaaaaccccaccgtggatggaattgttgctatcgacctggatcccgtggtctacgacgccaagttcgaaaagcagctgggccagattatgctccttatcctgtgtacgagccaaattctgctcatgcggacaacctgggccctgtgcgagtccatcacacttgcgaccgggcctctgaccacactctgggagggatctccgggcaaattttggaatacgaccatcgctgtgagcatggccaacattttccgcggctcctatctggctggggccggactggccttcagcctcatgaagtcccttggcgggggaagacggggcacaggggctcagggagaaaccctgggcgagaaatggaagagacagctgaatcagctctctaaaagcgaatttaacacatacaagcgctccggcatcatggaggtggaccggtctgaagccaaggaggggctgaaaagaggagagaccacgaagcacgcggttagccgcggcacagccaaacttcggtggttcgtcgaaagaaatctggtgaagcccgaggggaaagtgattgatctcggatgtggccgcgggggatggtcctattactgcgctggcctgaagaaggtcaccgaagttaaaggctataccaaagggggacctggccatgaggaacccatccctatggccacatacgggtggaacctggtgaaactccactctggaaaggacgtgtttttcattccccctgagaaatgtgatacccttctgtgcgacatcggcgagagctccccgaatcccacaattgaagaggggcggacgctgagagtcctcaagatggtggaaccttggctgcgcggaaaccaattttgtatcaaaatccttaatccctacatgcctagcgttgtggagaccctggagcagatgcagcggaagcatggcggcatgctcgtcagaaaccccctgtctcgcaattccacacacgaaatgtattgggtgagctgcgggaccggaaacattgtttctgctgtgaatatgacatcccggatgctgctcaacagactgaccatggcccaccgcaagccgacgtacgagagagatgtcgaccttggcgcggggacccggcatgtggccgtggaacctgaggtcgctaacctggatatcattggacagcgcatcgaaaatattaaacacgagcataagagcacatggcactatgacgaggataacccctacaaaacctgggcctatcatggctcttacgaagttaagccctccgggagcgcttccagcatggtgaatggagtggtcaaactcctgacaaagccttgggacgtgatccccatggttacccaaatcgccatgacagataccacgcctttcggccagcagagagtgtttaaggagaaagtcgacacacggaccccgaaggctaaaagaggcaccgcccaaattatggaagtgacagcgaagtggctttgggggttcctgtctcggaacaaaaagccccgcatctgtacgagagaggaatttacccggaaggttcgcagcaatgccgctattggagccgtgttcgtcgacgagaaccagtggaactccgctaaagaggccgtggaagatgagagattttgggacctcgttcaccgggaacgcgagctgcacaagcagggcaaatgcgccacatgcgtgtataacatgatggggaagagagagaaaaagctgggagagttcggcaaggcgaaagggtctcgggctatctggtacatgtggctcggcgcccgctttctggagttcgaagcccttggattcatgaatgaggatcattggtttagcagagaaaactccctgtctggcgtcgagggggagggactccacaagctgggctacattcttcgggacatcagcaaaatccctgggggaaatatgtatgctgatgacaccgccggctgggatacacgcattaccgaagacgatctgcagaacgaggctagaatcacagacattatggaacccgagcatgccctcctggcgaagtccatcttcaaactgacctaccaaaataaggtggtccgggtgcagcgccctgccaaaaacgggacggttatggatgtgatttctagacgggaccagagaggcagcggacaggtcggcacctatgggctcaatacatttaccaacatggaagctcaactgatccgccagatggagtccgagggaatcttcagcccctctgaacttgagacaccgaacctggccgaacgggtgctcgattggctggagaagtacggcgtggaaagacttaagcgcatggctatttccggggacgactgtgttgtgaaacctatcgatgaccggtttgccaccgcgctgacggccctcaatgatatgggaaaggtcagaaaagacattccccagtgggagcctagcaagggctggaacgattggcagcaagtgcccttctgctctcaccactttcatcagctgatcatgaaagacgggcgcgagattgttgtgccttgtcggaatcaggatgaactggtcggcagagctcgcgtgtcccagggagccggctggagcctccgggagacagcttgcctggggaagtcctatgcccaaatgtggcagcttatgtacttccacagacgcgacctgcggctcgctgccaacgcgatctgttctgccgtccccgtggattggattccgaccagcagaacaacctggtccatccatgctcaccatcagtggatgacgaccgaagacatgctgagcgtttggaatcgggtgtggatcgaggaaaacccttggatggaggataagacacacatttcttcctggggagacgtcccctatcttggcaaaagagaggaccaatggtgcgggagcctgatcggactcaccgcccgcgccacatgggctaccaatattcaggtggccatcaaccaggttcggagactgattggcaatgaaaactacctggattacatgacatctatgaagcgctttaaaaatgagagcgaccccgaaggggcgctctggtga

SEQ ID NO: 18936 - RNA, 9879 nt, synthetic construct
  misc_feature 1..9879: note = derived and/or modified CDS sequence (opt5) from DENV-1__FJ410231__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttatcgcgatggacctgggggagctctgtgaagatacaatgacctacaagtgcccgagaatcacagaggtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaagcagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaggataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggcaaggggctcggaaaaacgagcatcggccttctgtgtgtgatggcttcttccgccctgctctggatggccagcgtcgagccccattggattgctgcgtctatcatcctggagttctttcttatggtgctgctcattccggagcctgaccgccagagaacaccccaggataaccaactggcctacgttgtgatcgggctcctgttcatgattcttaccgtcgctgccaatgagatgggactgctggaaaccacaaagaaagacctcggcatcgggcacgtggccgtcgagaaccaccatcacgctaccatgctggatgtggaccttcatcctgcctccgcgtggacactgtacgccgttgctacgaccattatcacacccatgatgcggcacaccattgaaaacacaaccgccaatatcagcctcacggctatcgccaaccaggcggccattctgatgggactggataagggctggcctatctctaaaatggacattggcgtgcccctccttgctctggggtgctatagccaggtcaatccgctgaccctcacagccgctgtgctgatgcttgttgcccattacgctatcattggacctggcctgcaagccaaggcgacccgcgaggcccagaagagaacagctgccgggatcatgaaaaaccccaccgtggatggaatcgtcgctattgacctcgatcccgtggtgtatgacgccaagtttgaaaaacagctgggccagatcatgctgctcattctttgtacgtcccaaatcctgctgatgcggacaacctgggccctctgcgagtctattacactggcgaccgggcctcttaccacactgtgggagggaagcccgggcaagttctggaatacgaccatcgctgtttccatggccaacatctttcgcggcagctacctcgctggggccggactggccttctccctgatgaaatctctcggcgggggaagacggggcacaggggctcagggagaaacccttggcgagaagtggaagcgccagctgaatcagctgagcaaatccgagttcaacacatataagagatctggcattatggaggtcgaccggagcgaagccaaagaggggctcagacgcggagagaccacgaagcacgcggtgtcccggggcacagccaaactgagatggtttgtggaacgcaatcttgtcaagcccgaggggaaggttatcgatctgggatgtggcagaggcgggtggtcttactattgcgctgggctcaaaaaggtgaccgaagtgaaaggctacaccaaagggggacctggccacgaggaacccattcctatggccacatacgggtggaacctggtcaaactgcatagcggaaaggacgtgttctttattccccctgagaaatgtgataccctcctttgcgacattggcgagtccagcccgaatcccacaatcgaagaggggagaacgctgcgcgttctgaagatggtggaaccttggctccggggaaaccaattctgtattaagatcctgaatccctatatgccttctgtcgtggagacccttgagcagatgcagagaaaacacggcggcatgctggttcgcaaccccctctcccggaatagcacacatgaaatgtactgggtgtcttgcgggaccggaaacatcgtctccgctgtgaatatgacaagcagaatgctgctgaaccgctttaccatggcccaccggaagccgacgtatgagagagatgtggacctcggcgcggggacccgccacgtcgccgttgaacctgaggtggctaacctggatattatcggacagagaattgaaaatatcaaacatgagcacaagtctacatggcattacgacgaggataacccctataaaacctgggcctaccacggctcctatgaagtgaagcccagcgggtccgctagctctatggtcaatggagtggttaaacttctgacaaaaccttgggacgtgattcccatggtcacccaaatcgccatgacagataccacgcctttcggccagcagcgggtgtttaaggagaaagttgacacacgcaccccgaaggctaaaagaggcaccgcccaaatcatggaagtgacagcgaagtggctctgggggttcctgagccggaacaagaaacccagaatttgtacgcgggaggaatttacccgcaaggtcagatccaatgccgctatcggagccgtgttcgttgacgagaaccagtggaactctgctaaagaggccgtggaagatgagcggttttgggaccttgtccatcgcgaaagagagctgcacaagcagggcaaatgcgccacatgcgtgtacaacatgatggggaagcgggaaaagaaactcggagagttcggcaaggcgaaagggagccgcgctatttggtacatgtggctgggcgccagatttctggagttcgaagccctcggattcatgaatgaggatcactggttttcccgggaaaactctctgagcggcgtcgagggggagggacttcataagctgggctatatcctccgcgacatttccaaaatccctgggggaaatatgtacgctgatgacaccgccggctgggatacaagaatcaccgaagacgatctgcagaacgaggctaagattacagacatcatggaacccgagcacgcccttctggcgacctctattttcaaactcacgtatcaaaataaggtggttcgggtgcagcgccctgccagaaacgggaccgtcatggatgtgatcagccggcgcgaccagagaggctccggacaggtgggcacatacgggctgaatacctttacaaacatggaagctcaactgattcggcagatggagagcgagggaatcttctctccctccgaactcgagaccccgaacctggccgaaagagttcttgattggctggagaagcatggcgtggaacgcctcaaacggatggctatcagcggggacgactgtgtcgtgaagcctattgatgacagatttgccacggcgctgtctgcccttaatgatatgggaaaagttcgcaaggacatcccccagtgggagccttccaaaggctggaacgattggcagcaagtgcccttctgcagccaccactttcatcagctgattatgaaggacgggcgggagatcgtcgtgccttgtagaaatcaggatgaactcgtcggccgcgctcgggtgtcccagggagccggctggtctctgagagagacagcttgcctgggaaagagctatgcccaaatgtggcagctcatgtacttccaccgccgggacctgagacttgctgccaacgcgatttgttccgccgttcccgtggattgggtcccgaccagccgcacaacctggtctatccatgctcaccatcagtggatgacgaccgaagacatgctgtccgtgtggaatcgggtttggattgaggaaaacccttggatggaggataaaacacacatcagctcttggggagacgtgccctatctcggcaagagagaggaccaatggtgcgggagcctgatcggacttaccgcccgggccacatgggctaccaatattcaggtcgccatcaaccaggtgagacgcctgattggcaatgaaaactacctcgattacatgacatccatgaaacggtttaagaatgagtctgaccccgaaggggcgctgtggtga

SEQ ID NO: 18937 - RNA, 9879 nt, synthetic construct
  misc_feature 1..9879: note = derived and/or modified CDS sequence (opt5) from DENV-1__FJ461323__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgccatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggtgctgcgccaccccggcttcaccgtcatcgctctttttctggcccatgcgattgggacatctatcacccagaagggaatcattttcatcctcctgatgcttgtgacccctagcatggccatgagatgcgttggcattgggtcccgggattttgtggagggactgagcggcgctacatgggtcgacgtggtgctcgagcacgggtcttgtgtcacgaccatggccaaggataaacccacactggacatcgaactgctcaagaccgaggttacaaaccctgctgtgctgcgcaaactttgcattgaagccaagatctccaataccacgacagatagcagatgtccgacccaaggagaggcgaccctggtggaagaacaggacgccaacttcgtctgccggcgcacatttgtggatagaggctggggcaatgggtgtggactcttcggcaaagggtctctgattacctgcgctaagtttaagtgcgttacaaaacttgagggaaagatcgtgcagtacgaaaacctgaaatattccgtcatcgtgacggttcacaccggcgaccagcatcaagtggggaatgagagcacagaacacggaaccacagccaccattacgccccaggctcctaccacagagatccagctcaccgactacggcgccctgacactggattgttctccccggaccggcctcgacttcaacgaaatggtcctgcttacgatgaaggagaaatcctggctggtgcataagcagtggtttctcgatctgcctcttccctggacaagcggggcctccacctctcaagagacatggaatcgccaggacctgctcgtcaccttcaaaaccgctcacgcgaagaagcaggaagtggttgtgctgggaagccaagagggcgccatgcacacagctctgacgggggccaccgaaattcagacatccggaaccacaaccatctttgccggccatctcaaatgcagactgaagatggataaacttacgctgaaggggatgagctatgtcatgtgtacaggctctttcaaactcgagaaggaagtggctgagacccagcacggaaccgttctggtgcagattaagtacgagggcacagacgccccgtgcaaaatccctttctccacccaagatgaaaagggggtcacacagaacggacggctgatcacggcgaatcccattgtgaccgacaaagagaagcctgtgaacatcgaagctgagccgccctttggcgagagctatattgttatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtctttacaagcgtgggcaaactggtgcatcagattttcgggaccgcctacggagtcctcttttccggcgtgagctggacgatgaagatcgggattggcgttctgcttacctggctgggactcaattctagatccacaagcctgtctatgacctgtatcgctgtgggcctggtcacactttacctcggggtgatggttcaggccgattccggatgcgtgattaactggaaaggccgcgaactgaagtgtgggagcggaatcttcgtcaccaatgaggtgcacacatggaccgaacaatataagtttcaggctgactcccctaaacggctgtctgccgcgattggcaaggcctgggaggagggggtttgcggcatcagaagcgctacgcgcctcgaaaacatcatgtggaaacagatttccaacgagctgaatcatatccttctggaaaacgacatgaagctcacagtggtcgtgggagatgtggccggcattctggggcagggcaagaagatgatccggccgcaacccatggagtacaaatattcttggaaaagctggggcaaggctaagattatcggggccgacgcccagaataccaccttcatcattgatggacctaacacacccgaatgtcctgacgatcagagagcttggaatatctgggaggtcgaggactacggctttggcattttcaccacgaacatctggctgaaacttcgcgattcctatacacaggtttgcgaccaccggctcatgagcgcggccattaaagattctaaggctgtgcacgccgacatggggtactggatcgaatccgagaaaaatgaaacctggaagctggccagagctagctttatcgaggtgaagacatgtatttggcccaaatctcataccctgtggtccaacggagtcctcgaaagcgagatgatcattccgaagatctatggcgggcctatttctcaacacaattaccgccccggatacttcacacagaccgccggcccttggcatctggggaaacttgagctggatttcgacctctgcgaaggaacgaccgtggttgtggatgagcactgcggcaaccggggccccagcctgagaacaaccacagtcaccgggaagatcatccacgaatggtgttgccggtcctgtacgctgcctccccttcgctttagaggagaggacggctgctggtatgggatggagattcggccggtgaaagaaaaggaggaaaatctcgttaagagcatggtgtctgcgggatccggcgaggtcgacagcttctccctggggctgctctgtatctctattatgatcgaagaggtgatgagaagccgctggtcccggaaaatgctgatgacaggaacccttgctgtctttttcctgctcattatgggccagctgacatggaacgatctgatcagactttgcattatggtgggcgccaatgcctctgaccgcatggggatgggaaccacctacctggctctcatggccacatttaagatgagacctatgttcgcggtcggcctgctctttcggcgcctgacgagcagagaggtgcttctgctcaccatcgggctgtccctggtggcttctgtcgaacttcccaacagcctggaggaactcggagatggcctggccatggggatcatgattctcaaactgcttacagacttccaatcccatcagctgtgggccaccctcctgagcctgacatttatcaagaccacgttctctcttcactatgcttggaaaacaatggccatggttctgtccattgtgagcctctttcccctgtgtctctctaccacctcccagaagacaacctggctgcctgtgcttctgggaagcctgggctgcaagccgctcacaatgttcctgatcgctgagaataaaatttggggccggaagtcttggccccttaacgaagggatcatggccgtcggaatcgtgtccattctgctcagctccctgctcaaaaacgatgttcctctggcgggcccccttatcgccgggggaatgctgattgcttgttacgtgatcagcggctctagcgccgacctgtccctcgagaaggctgccgaggtctcttgggaagaggaagccgagcatagcggggcttcccacaatattctggtggaagttcaggatgacggaacgatgaaaatcaaggatgaggagcgcgacgatacccttacaatcctgctcaaagcgaccctgctcgccgtgtctggcgtctatcctctgagcattcccgctacactttttgtgtggtacttctggcaaaagaagaaacagagatccggcgtcctgtgggacaccccttctcccccggaagtggagcgggccgttctggatgacgggatctatcgcattatgcagagaggactcctgggccggagccaggtgggggtcggagtgttccaagaaaacgtttttcatacgatgtggcacgtgacccgcggcgccgtccttatgtaccaggggaagagactggagccttcctgggctagcgtgaaaaaggacctcatctcttacggaggcggctggcggctgagagggtcctggaatacaggagaggaagtgcaggttattgccgtcgagcccggcaaaaaccctaagaatgtgcagaccgcgcccgggacattcaagaccccggaaggagaggtgggcgctatcgccctcgattttaaacctgggacaagcggatctcccattgtcaaccgcgaaggcaagatcgtgggcctgtatgggaatggagttgtgacgacctccggcacatacgtcagcgccatcgctcaagccaaagcgtcccaggaggggcctcttcccgagattgaagacgaggtgttccggaagagaaacctgaccatcatggatctgcaccccggatctggcaaaacccgccggtatctccctgctattgttagagaagccatcaagcgcaagctgcggacacttattctggccccgacgagagtggtcgctagcgagatggccgaagctctcaaagggatgcccatccgctaccagaccacagccgtgaagtccgagcataccggcaaagagatcgttgacctgatgtgccacgcgacatttaccatgcggctgctcagccctgtgagagtccccaattataacatgattatcatggatgaagcccatttcacggacccttcttccattgctgcccggggatacatcagcacacgcgtgggcatgggggaggctgccgccatttttatgaccgctacaccccctggatctgtggaagcgttcccgcaaagcaatgccgtcatccaggatgaggaaagagacatccccgagcggtcctggaactctggctatgagtggattacagattttcctgggaagaccgtttggttcgtgcccagcatcaaatccggaaatgacattgctaactgtcttcgcaagaatggcaagagagtgatccagctgtctcggaaaacatttgataccgaataccagaagacgaaaaacaacgactgggactacgtcgtgacaaccgatattagcgagatgggggccaatttcagagccgaccgcgttatcgatcctcggagatgcctgaagcccgtgattctcaaagacggcccggaacgcgtcatcctggctggacctatgcccgtgacagttgcctccgcggctcaacggagaggccgcatcgggcggaaccacaataaggagggagatcagtatatttacatgggccagccccttaacaatgacgaggatcatgcccactggaccgaagccaagatgctgctcgacaacatcaatacgcctgaggggattatccccgctctgttcgaacctgagagagaaaagagcgccgcggtggatggagagtatcgcctgagaggcgaggcccggaagacctttgtcgagctcatgcgcagaggggaccttccggtgtggctgtcttacaaagtcgcttccgagggcttccagtatagcgatcggcgctggtgctttgacggagaaagaaacaatcaagtgctggaggaaaacatggatgttgagatttggacaaaggagggcgaacggaaaaagctcagaccccgctggctggacgcccggacctactccgaccctcttgctctgagagagttcaaagaatttgccgctgggcgccggtctgtgagcggagatctcatcctggagatcggcaagctgccccagcacctcacacagagagcccagaatgcgcttgacaacctggtgatgctgcataattccgaacaagggggacgggcctatcgccacgctatggaggagctccctgataccattgaaacactgatgcttctggccctcatcgctgtcctgaccggcggcgttacgctgttctttctctctgggagaggacttggcaagacaagcattgggctgctgtgtgtgatggcctccagcgtgctcctgtggatggcctctgtcgagccccattggatcgctgcgtccattatccttgagttctttctgatggtgctcctgatcccggagcctgaccggcagcgcacaccccaggataaccagctggcctacgttgtgattggactccttttcatgatcctgaccgtcgctgccaatgagatgggcctgctcgaaacaaccaaaaaggacctggggattggacacgtggccgtcgagaaccaccatcacgctgccatgcttgatgtggacctgcatcctgcgagcgcctggacactctacgctgttgccacgaccatcattacacccatgatgagacacaccatcgaaaacacaaccgctaatatttctctgacggccatcgcgaaccaagccgctatcctgatgggcctcgataaaggctggcctatttccaagatggacatcggggtgccccttctggccctgggatgctatagccaggtcaatccgctcaccctgacagctgccgtgcttatgctggttgctcattacgccattatcggccctgggctccaggcgaaagccacccgggaggctcaaaagcgcacagccgctggaattatgaagaaccccaccgtggatggcatcgtcgccatcgacctggatcccgtggtgtatgacgccaaatttgaaaagcagctggggcagattatgctccttatcctgtgtacgtctcagattctgctcatgagaacaacctgggcgctgtgcgagagcatcacacttgctaccggacctctgaccacactctgggagggctccccgggcaaattctggaatacgaccattgccgtttctatggctaacatctttcgggggagctacctggccggagccggcctggctttctccctcatgaaaagccttgggggaggccgcagagggacaggagcccaaggcgaaaccctgggcgagaaatggaagcggcagctgaatcagctctccaagtctgagttcaacacatataaaagaagcgggatcatggaggtcgaccgctccgaagcgaaggagggactgaaacggggcgagaccacgaagcacgccgtgtctagagggacagctaaacttcgctggtttgtggaacggaatctggtcaagcccgagggaaaggttattgatctcggctgtgggagaggaggctggagctactattgcgccggcctgaaaaaggtgaccgaagtgaaagggtacaccaagggaggccctgggcacgaggaacccatccctatggctacatacggatggaacctggtcaaactccattccggcaaggacgtgttctttattccccctgagaaatgtgatacccttctgtgcgacatcggggagtctagcccgaatcccacaattgaagagggacgcacgctgcgggttctcaagatggtggaaccttggctgagaggcaaccagttctgtatcaagattcttaatccctatatgccttccgtcgtggagaccctggagcaaatgcagcgcaaacacggcgggatgctcgttcggaaccccctgagcagaaattctacacatgaaatgtactgggtgtcctgcggaaccggcaacatcgtcagcgccgtgaatatgacatctcgcatgctgctcaaccggtttaccatggcgcacagaaagccgacgtatgagcgcgatgtggacctggggaccggaacaagacacgtcgccgttgaacctgaggtggctaaccttgatatcattggccagcggatcgaaaatattaaacatgagcacaagtccacctggcattacgacgaggataacccctataaaacatgggcctaccacgggagctatgaagtgaagccctctggatccgctagctccatggtcaatggcgtggttaagctgctcaccaaaccttgggacgtgatccccatggtcacacagattgccatgaccgatacgacacctttcggccaacagcgcgtgtttaaggagaaagttgacaccagaaccccgaaggctaaacgggggacagcccagatcatggaagtgacggcgagatggctgtggggattccttagccggaacaagaagccccgcatctgtaccagagaggaatttacacggaaagtccgctctaatgccgctattggcgccgtgttcgttgacgagaaccaatggaatagcgctaaggaggccgtggaagatgagagattttgggacctggtccatcgggaacgcgagctccacaaacaggggaagtgcgcgacctgcgtgtacaacatgatgggaaaaagagaaaagaagctgggcgagttcgggaaagcgaagggctcccgggctatctggtacatgtggctgggagcccgctttctcgagttcgaagccctgggcttcatgaatgaggatcactggttttctagagaaaacagcctttccggggtcgagggagagggcctgcataaactcgggtatattctgcgggacatctctaagattcctggaggcaatatgtacgctgatgacacagccgggtgggatacccgcatcacagaagacgatcttcagaacgaggctaaaatcaccgacattatggaacccgagcacgccctgctcgcgaaggccatcttcaaactgacgtatcagaataaggtggttagagtgcaacggcctgctaagaacggcaccgtcatggatgtgattagccgcagagaccagcggggatccggccaggtggggacatacggactgaatacctttacaaacatggaagcccagctcatcagacaaatggagtctgagggcattttcagcccctccgaactggagaccccgaaccttgctgaacgcgccctggattggctcgagaaatatggggttgaacggctgaagagaatggcgatcagcggagacgactgtgtggtcaaacctatcgatgaccgctttgccacggctcttacagccctgaatgatatgggcaaggtgcggaaagacattccccagtgggagccttctaaggggtggaacgattggcagcaggttcccttctgctcccatcactttcaccaactcatcatgaaggacggcagagagattgtggtcccttgtcgcaatcaggatgaactggtgggacgggctagagtcagccagggcgccgggtggtctctgcgcgagaccgcttgcctcggaaaatcctacgcccagatgtggcaactgatgtatttccatcggagagaccttcgcctggcggccaacgctatctgtagcgccgtgcccgttgattgggtgccgacatcccggaccacgtggtctattcacgcccatcaccagtggatgaccacagaagacatgctcagcgtctggaatagagtgtggatcgaggaaaacccttggatggaggataagacccatatttccagctgggaggacgttccctacctgggcaaacgggaagaccagtggtgcgggtctcttatcggactgacagctagagccacctgggcgacaaatatccaagtggctattaaccaggtccgccggctcatcggcaatgagaactacctggattatatgacctccatgaagagatttaaaaatgaaacggaccccgagggggccctgtggtga
